United States Patent 9,192,651 (MODIFIED POLYNUCLEOTIDES FOR THE PRODUCTION OF SECRETED PROTEINS) - sequence listing, part 3

SEQ ID NO: 3079 - protein, 469 aa, Homo sapiens
MMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 3080 - protein, 378 aa, Homo sapiens; identical to SEQ ID NO: 2828
  MOD_RES (1)..(1): Any amino acid

SEQ ID NO: 3081 - protein, 225 aa, Homo sapiens; identical to SEQ ID NO: 2797
  MOD_RES (1)..(1): Any amino acid

SEQ ID NO: 3082 - protein, 281 aa, Homo sapiens; identical to SEQ ID NO: 2231

SEQ ID NO: 3083 - protein, 369 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGNSETSPGMFNFDTFWKNFKSKLGFINWDAINKDQRSSRIP

SEQ ID NO: 3084 - protein, 139 aa, Homo sapiens; identical to SEQ ID NO: 2817

SEQ ID NO: 3085 - protein, 171 aa, Homo sapiens
MRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALVHLCEVDSPQD

SEQ ID NO: 3086 - protein, 63 aa, Homo sapiens; identical to SEQ ID NO: 2934

SEQ ID NO: 3087 - protein, 378 aa, Homo sapiens; identical to SEQ ID NO: 2828
  MOD_RES (1)..(1): Any amino acid

SEQ ID NO: 3088 - protein, 844 aa, Homo sapiens; identical to SEQ ID NO: 2289

SEQ ID NO: 3089 - protein, 112 aa, Homo sapiens
MLTAALAPGAANSPTTNPVILIVDKVLETQDLNGDGLMTPAELINFPGVALRPYPPYIGVGPNSNMCSRSDLPEDSNTLYPGSHLWLRHALNSKGNLDARLDGGEKAMQPQW

SEQ ID NO: 3090 - protein, 891 aa, Homo sapiens; identical to SEQ ID NO: 2482

SEQ ID NO: 3091 - protein, 913 aa, Homo sapiens; identical to SEQ ID NO: 2128

SEQ ID NO: 3092 - protein, 129 aa, Homo sapiens; identical to SEQ ID NO: 2490

SEQ ID NO: 3093 - protein, 281 aa, Homo sapiens; identical to SEQ ID NO: 2231

SEQ ID NO: 3094 - protein, 147 aa, Homo sapiens; identical to SEQ ID NO: 2688

SEQ ID NO: 3095 - protein, 876 aa, Homo sapiens; identical to SEQ ID NO: 1912

SEQ ID NO: 3096 - protein, 582 aa, Homo sapiens
MDFLLALVLVSSLYLQAAAEFDGRWPRQIVSSIGLCRYGGRIDCCWGWARQSWGQCQPFYVLRQRIARIRCQLKAVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 3097 - protein, 533 aa, Homo sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLLHASLSSPGGEDAWLIGVGGSVPSGVAVRCPVCLEAPLVSGCLLQTPGALDPGTAGPPHPTGCCSGPHLPAPTVRPGPSAASAPPARGGLGGAAAPGGSAG

SEQ ID NO: 3098 - protein, 430 aa, Homo sapiens
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSKYRPVCIHLAGTGDHHYWRRRTLMARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 3099 - protein, 876 aa, Homo sapiens; identical to SEQ ID NO: 1912

SEQ ID NO: 3100 - protein, 78 aa, Homo sapiens; identical to SEQ ID NO: 2320

SEQ ID NO: 3101 - protein, 876 aa, Homo sapiens; identical to SEQ ID NO: 1912

SEQ ID NO: 3102 - protein, 418 aa, Homo sapiens; identical to SEQ ID NO: 2199

SEQ ID NO: 3103 - protein, 129 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPE

SEQ ID NO: 3104 - protein, 104 aa, Homo sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKF

SEQ ID NO: 3105 - protein, 212 aa, Homo sapiens; identical to SEQ ID NO: 2980

SEQ ID NO: 3106 - protein, 334 aa, Homo sapiens
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 3107 - protein, 328 aa, Homo sapiens
MGPAGCAFTLLLLLGISVCGQPVYSSRVVGGQDAAAGRWPWQVSLHFDHNFICGGSLVSERLILTAAHCIQPTWTTFSYTVWLGSITVGDSRKRVKYYVSKIVIHPKYQDTTADVALLKLSSQVTFTSAILPICLPSVTKQLAIPPFCWVTGWGKVKESSDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 3108 - protein, 150 aa, Homo sapiens; identical to SEQ ID NO: 2126

SEQ ID NO: 3109 - protein, 77 aa, Homo sapiens
MRVAGAAKLVVAVAVFLLTFYVISQVFEIKMDASLGNLFARSALDTAARSTKPPRYKCGISKACPEKHFAFKMASGA

SEQ ID NO: 3110 - protein, 380 aa, Homo sapiens; identical to SEQ ID NO: 2413

SEQ ID NO: 3111 - protein, 185 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQ

SEQ ID NO: 3112 - protein, 124 aa, Homo sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYA

SEQ ID NO: 3113 - protein, 1952 aa, Homo sapiens; identical to SEQ ID NO: 2311

SEQ ID NO: 3114 - protein, 203 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGKCSRVIESKPSESMNTRRVLGDSGEINILTGQAPLALAIF

SEQ ID NO: 3115 - protein, 836 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 3116 - protein, 436 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 3117 - protein, 313 aa, Homo sapiens; identical to SEQ ID NO: 2235

SEQ ID NO: 3118 - protein, 70 aa, Homo sapiens
MVAPAARVFLRAVRAALTSTVPDLLCLLARGSPRGLASGRLPLAVHSAQHGPGSGAPWLRIARRALSQRI

SEQ ID NO: 3119 - protein, 213 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTV

SEQ ID NO: 3120 - protein, 78 aa, Homo sapiens; identical to SEQ ID NO: 2320

SEQ ID NO: 3121 - protein, 216 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGT

SEQ ID NO: 3122 - protein, 150 aa, Homo sapiens; identical to SEQ ID NO: 2126

SEQ ID NO: 3123 - protein, 56 aa, Homo sapiens
MKTGLFFLCLLGTAAAIPTNARLLSDHSKPTAETVAPDNTAIPSLRAEAEENEKET

SEQ ID NO: 3124 - protein, 781 aa, Homo sapiens
MAVAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 3125 - protein, 72 aa, Homo sapiens
MAAATRGCRPWGSLLGLLGLVSAAAAAWDLASLRCTLGAFCECDFRPDLPEGSEELGPREPHCLWPLPLPLR

SEQ ID NO: 3126 - protein, 80 aa, Homo sapiens
MKVFFLFAVLFCLVQTNSGDVPPGIRNTICHMQQGICRLFFCHSGEKKRDICSDPWNRCCVSNTDEEGKEKPEMDGRSGI

SEQ ID NO: 3127 - protein, 286 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVH

SEQ ID NO: 3128 - protein, 285 aa, Homo sapiens
MRGQGRKESLSDSRDLDGSYDQLTGHPPGPTKKALKQRFLKLLPCCGPQALPSVSEIGRVFRFLGDSSLPSALAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 3129 - protein, 436 aa, Homo sapiens; identical to SEQ ID NO: 2285

SEQ ID NO: 3130 - protein, 405 aa, Homo sapiens; identical to SEQ ID NO: 1930

SEQ ID NO: 3131 - protein, 99 aa, Homo sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRN

SEQ ID NO: 3132 - protein, 156 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPH

SEQ ID NO: 3133 - protein, 82 aa, Homo sapiens
MGRVFLTGEKANSILKRYPRANGFFEEIRQGNIERECKEEFCTFEEAREAFENNEKTGLVLLPRLECSCEHGSLQPQLPVPK

SEQ ID NO: 3134 - protein, 123 aa, Homo sapiens
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAK

SEQ ID NO: 3135 - protein, 279 aa, Homo sapiens
MGRVFLTGEKANSILKRYPRANGFFEEIRQGNIERECKEEFCTFEEAREAFENNEKTITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 3136 - protein, 187 aa, Homo sapiens
MWCASPVAVVAFCAGLLVSHPVLTQGQEAGGRPGADCEVCKEFLNRFYKSLIDRGVNFSLDTIEKELISFCLDTKGKENRLCYYLGATKDAATKILSEVTRPMSVHMPAMKICEKLKKLDSQICELKYEKTLDLASVDLRKMRVAELKQILHSWGEECRACAEKTDYVNLIQELAPKYAATHPKTEL

SEQ ID NO: 3137 - protein, 436 aa, Homo sapiens; identical to SEQ ID NO: 2285

SEQ ID NO: 3138 - protein, 149 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFL

SEQ ID NO: 3139 - protein, 311 aa, Homo sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 3140 - protein, 206 aa, Homo sapiens
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKK

SEQ ID NO: 3141 - protein, 405 aa, Homo sapiens; identical to SEQ ID NO: 1930

SEQ ID NO: 3142 - protein, 132 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQAT

SEQ ID NO: 3143 - protein, 201 aa, Homo sapiens; identical to SEQ ID NO: 2486

SEQ ID NO: 3144 - protein, 361 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAEYPPANREPHPSTPPPPSSR

SEQ ID NO: 3145 - protein, 53 aa, Homo sapiens
MWTNFFKLRLFCCLLAVLMVVVLVINVTQVEYLDHETVSATFIDSSGQFVSSQ

SEQ ID NO: 3146 - protein, 434 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENSVTGHPVFYLPLCDSFLPPKAAPVTELYTDGPVMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 3147 - protein, 436 aa, Homo sapiens; identical to SEQ ID NO: 2285

SEQ ID NO: 3148 - protein, 405 aa, Homo sapiens; identical to SEQ ID NO: 1930

SEQ ID NO: 3149 - protein, 169 aa, Homo sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYA

SEQ ID NO: 3150 - protein, 402 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 3151 - protein, 559 aa, Homo sapiens; identical to SEQ ID NO: 1951

SEQ ID NO: 3152 - protein, 133 aa, Homo sapiens [sequence omitted]

SEQ ID NO: 3153 - protein, 201 aa, Homo sapiens; identical to SEQ ID NO: 2486

SEQ ID NO: 3154 - protein, 201 aa, Homo sapiens; identical to SEQ ID NO: 2486

SEQ ID NO: 3155 - protein, 243 aa, Homo sapiens; identical to SEQ ID NO: 3045

SEQ ID NO: 3156 - protein, 85 aa, Homo sapiens
MKIPVLPAVVLLSLLVLHSAQGATLGGPEEESTIENYASRPEAFKADEFLNWHALFESIKRKLPFLNWDAFPKLKGLRSATPDAQ

SEQ ID NO: 3157 - protein, 115 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTV

SEQ ID NO: 3158 - protein, 201 aa, Homo sapiens; identical to SEQ ID NO: 2486

SEQ ID NO: 3159 - protein, 436 aa, Homo sapiens; identical to SEQ ID NO: 2285

SEQ ID NO: 3160 - protein, 201 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 3161 - protein, 24 aa, Homo sapiens
MLVDGPSERPALCFLLLAVAMSFF

SEQ ID NO: 3162 - protein, 83 aa, Homo sapiens
MRPRGLPPLLVVLLGCWASVSAQTDATPAVTTEGLNSTEAALATFGTFPSTRPPGTPRAPGPSSGPRPTPVTDGSHSVTQAGV

SEQ ID NO: 3163 - protein, 417 aa, Homo sapiens; identical to SEQ ID NO: 1973

SEQ ID NO: 3164 - protein, 559 aa, Homo sapiens; identical to SEQ ID NO: 1951

SEQ ID NO: 3165 - protein, 32 aa, Homo sapiens
MQGTPGGGTRPGPSPVDRRTLLVFSFILAAAL

SEQ ID NO: 3166 - protein, 59 aa, Homo sapiens
MLALLVLVTVALASAHHGGEHFEGEKVFRVNVEDENHINIIRELASTTQIDFWKPDSVT

SEQ ID NO: 3167 - protein, 100 aa, Homo sapiens
MRPRGLPPLLVVLLGCWASVSAQTDATPAVTTEGLNSTEAALATFGTFPSTRPPGTPRAPGPSSGPRPTPVTDGGYHVPAPGVHSDPTSRGQPRCCSLCL

SEQ ID NO: 3168 - protein, 77 aa, Homo sapiens
MRSPRMRVCAKSVLLSHWLFLAYVLMVCCKLMSASSQHLRGHAGHHQIKQGTCEVVAVHRCCNKNRIEERSQTVKCS

SEQ ID NO: 3169 - protein, 3 aa, Homo sapiens
MWT

SEQ ID NO: 3170 - protein, 133 aa, Homo sapiens [sequence omitted]

SEQ ID NO: 3171 - protein, 199 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWVRSPRRGLQEQEELCFHMWGGKGGLCQSSL

SEQ ID NO: 3172 - protein, 347 aa, Homo sapiens
MGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 3173 - protein, 8 aa, Homo sapiens
MQGTPGGG

SEQ ID NO: 3174 - protein, 122 aa, Homo sapiens
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 3175 - protein, 102 aa, Homo sapiens
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLN

SEQ ID NO: 3176 - protein, 219 aa, Homo sapiens; identical to SEQ ID NO: 2252

SEQ ID NO: 3177 - protein, 622 aa, Homo sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 3178 - protein, 55 aa, Homo sapiens
MGPEALSSLLLLLLVASGDADMKGHFDPAKCRYALGMQDRTIPDSDISASSSWSD

SEQ ID NO: 3179 - protein, 51 aa, Homo sapiens
MGPEALSSLLLLLLVASGDADMKGHFDPAKCRYALGMQDRTIPDSDISASS

SEQ ID NO: 3180 - protein, 539 aa, Homo sapiens; identical to SEQ ID NO: 2982

SEQ ID NO: 3181 - protein, 196 aa, Homo sapiens
MPHLASLFTASSRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 3182 - protein, 53 aa, Homo sapiens
MLPCLALLLLMELSVCTVAGDGGEEQTLSTEAETWVIVALEVLLGRGSDEGRG

SEQ ID NO: 3183 - protein, 41 aa, Homo sapiens
MGPEALSSLLLLLLVASGDADMKGHFDPAKCRYALGMQDRT

SEQ ID NO: 3184 - protein, 73 aa, Homo sapiens
MGPEALSSLLLLLLVASGDADMKGHFDPAKCRYALGMQDRTIPDSDISASSSWSDSTAARHSRLESSDGDGAW

SEQ ID NO: 3185 - protein, 122 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRY

SEQ ID NO: 3186 - protein, 160 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMV

SEQ ID NO: 3187 - protein, 179 aa, Homo sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKQPCPKIKVECEVEEIDQCTKPRDCPENMKCCPFSRGKKCLDFRKASLST

SEQ ID NO: 3188 - protein, 145 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFE

SEQ ID NO: 3189 - protein, 132 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGW

SEQ ID NO: 3190 - protein, 101 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVG

SEQ ID NO: 3191 - protein, 130 aa, Homo sapiens; identical to SEQ ID NO: 2082

SEQ ID NO: 3192 - protein, 139 aa, Homo sapiens
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPC

SEQ ID NO: 3193 - protein, 169 aa, Homo sapiens
MRLLILTCLVAVALARPKLPLRYPERLQNPSESSEPIPLESREEYMNGMNRQRNILREKQTDEIKNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 3194 - protein, 306 aa, Homo sapiens
MKKDEPPLDFPDTLEGFEYAFNEKGQLRHIKTGEPFVFNYREDLHRWNQKRYEALGEIITKYVYELLEKDCNLKKVSIPEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 3195 - protein, 953 aa, Homo sapiens
  MOD_RES (1)..(1): Any amino acid
XQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 3196 - protein, 152 aa, Homo sapiens; identical to SEQ ID NO: 2696

SEQ ID NO: 3197 - protein, 566 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 3198 - protein, 70 aa, Homo sapiens
MGPEALSSLLLLLLVASGDADMKGHFDPAKCRYALGMQDRTIPDSDISASSSWSDSTAARHSRLESSDGD

SEQ ID NO: 3199 - protein, 78 aa, Homo sapiens
MGPEALSSLLLLLLVASGDADMKGHFDPAKCRYALGMQDRTIPDSDISASSSWSDSTAARHSRLESSDGDGAWCPAGS

SEQ ID NO: 3200 - protein, 112 aa, Homo sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTN

SEQ ID NO: 3201 - protein, 894 aa, Homo sapiens
MSLPRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 3202 - protein, 127 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGR

SEQ ID NO: 3203 - protein, 370 aa, Homo sapiens
MKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 3204 - protein, 144 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPG

SEQ ID NO: 3205 - protein, 446 aa, Homo sapiens
LTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTNIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 3206 - protein, 26 aa, Homo sapiens
MKLLLWACIVCVAFARKNAGLGFLWL

SEQ ID NO: 3207 - protein, 115 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFS

SEQ ID NO: 3208 - protein, 54 aa, Homo sapiens
MYIPLDPDYNADCPNVTAPVCASNGHTFQNECFFCVEQREFHYRIKFEKYGKCD

SEQ ID NO: 3209 - protein, 116 aa, Homo sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQ

SEQ ID NO: 3210 - protein, 143 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISG

SEQ ID NO: 3211 - protein, 248 aa, Homo sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKSSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 3212 - protein, 120 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTL

SEQ ID NO: 3213 - protein, 112 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGK

SEQ ID NO: 3214 - protein, 170 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 3215 - protein, 138 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQ

SEQ ID NO: 3216 - protein, 94 aa, Homo sapiens; identical to SEQ ID NO: 2723

SEQ ID NO: 3217 - protein, 51 aa, Homo sapiens; identical to SEQ ID NO: 3179

SEQ ID NO: 3218 - protein, 919 aa, Homo sapiens; identical to SEQ ID NO: 2501

SEQ ID NO: 3219 - protein, 105 aa, Homo sapiens
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSK

SEQ ID NO: 3220 - protein, 41 aa, Homo sapiens
MKLSGMFLLLSLALFCFLTGVFSQGGQVDCGEFQDPKVYCT

SEQ ID NO: 3221 - protein, 152 aa, Homo sapiens; identical to SEQ ID NO: 2696

SEQ ID NO: 3222 - protein, 536 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 3223 - protein, 95 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFI

SEQ ID NO: 3224 - protein, 70 aa, Homo sapiens
MASDLIRTILAVALISKLGTAVDAELMPSGAILQNKRENLPRVCHALAFLGMARCQDLFLVRLQGWKLGT

SEQ ID NO: 3225 - protein, 138 aa, Homo sapiens; identical to SEQ ID NO: 3215

SEQ ID NO: 3226 - protein, 72 aa, Homo sapiens
MAVSVLRLTVVLGLLVLFLTCYADDKPDKPDDKPDDSGKDPKPDFPKFLSLLGTEIIENAVEFILRSMSRST

SEQ ID NO: 3227 - protein, 145 aa, Homo sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGL

SEQ ID NO: 3228 - protein, 85 aa, Homo sapiens
MGPEALSSLLLLLLVASGDADMKGHFDPAKCRYALGMQDRTIPDSDISASSSWSDSTAARHSRLESSDGDGAWCPAGSVFPKEEE

SEQ ID NO: 3229 - protein, 469 aa, Homo sapiens
MLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 3230 - protein, 130 aa, Homo sapiens
MLPFLFFSTLFSSIFTEAQKQYWVCNSSDASISYTYCGRDLKQLYFNLYITVNTMNLPKRKEVICRGSDDDYSFCRALKGETVNTTISFSFKGIKFSKGKYKCVVEAISGSPEEMLFCLEFVILHQPNSN

SEQ ID NO: 3231 - protein, 105 aa, Homo sapiens
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLW

SEQ ID NO: 3232 - protein, 188 aa, Homo sapiens
MTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 3233 - protein, 424 aa, Homo sapiens
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGITVFFDRIQIIYQCLSSNKGSFVHYPLKNKHSF

SEQ ID NO: 3234 - protein, 604 aa, Homo sapiens
MAVLVCPASCHGLKEFRIRRGMWRLCLVYYFYPASSTLYVLRIDVLNYTSKDEGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 3235 - protein, 312 aa, Homo sapiens
MNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 3236 - protein, 258 aa, Homo sapiens; identical to SEQ ID NO: 1915

SEQ ID NO: 3237 - protein, 404 aa, Homo sapiens; identical to SEQ ID NO: 2740

SEQ ID NO: 3238 - protein, 311 aa, Homo sapiens; identical to SEQ ID NO: 3139

SEQ ID NO: 3239 - protein, 184 aa, Homo sapiens
MASERLPNRPACLLVASGAAEGVSAQSFLHCFTMASTAFNLQVATPGGKAMEFVDVTESNARWVQDFRLKAYASPAKLESIDEPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 3240 - protein, 418 aa, Homo sapiens; identical to SEQ ID NO: 2309

SEQ ID NO: 3241 - protein, 474 aa, Homo sapiens
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 3242 - protein, 145 aa, Homo sapiens; identical to SEQ ID NO: 2075

SEQ ID NO: 3243 - protein, 575 aa, Homo sapiens
  MOD_RES (1)..(1): Any amino acid
XIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPCDTFLKLEGWEKGVVFINGQNLGRYWNIGPQKTLYLPGPWLSSGINQVIVFEETMAGPALQFTETPHLGRNQYIK

SEQ ID NO: 3244 - protein, 84 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGY

SEQ ID NO: 3245 - protein, 247 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYD

SEQ ID NO: 3246 - protein, 38 aa, Homo sapiens
MRTLFNLLWLALACSPVHTTLSKSDAKKAASKTLLEKV

SEQ ID NO: 3247 - protein, 249 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDE

SEQ ID NO: 3248 - protein, 66 aa, Homo sapiens
MKPLLVVFVFLFLWDPVLAGINSLSSEMHKKCYKNGICRLECYESEMLVAYCMFQLECCVKGNPAP

SEQ ID NO: 3249 - protein, 333 aa, Homo sapiens; identical to SEQ ID NO: 2641

SEQ ID NO: 3250 - protein, 214 aa, Homo sapiens
MRPKTGQVGCETPEELGPGPRQRWPLLLLGLAMVAHGLLRPMVAPQSGDPDPGASVGSSRSSLRSLWGRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 3251 - protein, 349 aa, Homo sapiens
  MOD_RES (1)..(1): Any amino acid
XLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKRWSLTMLTSLVSISWLRAILPCQPPKVLGL

SEQ ID NO: 3252 - protein, 199 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPC

SEQ ID NO: 3253 - protein, 154 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSV

SEQ ID NO: 3254 - protein, 311 aa, Homo sapiens; identical to SEQ ID NO: 1965

SEQ ID NO: 3255 - protein, 467 aa, Homo sapiens; identical to SEQ ID NO: 2319

SEQ ID NO: 3256 - protein, 26 aa, Homo sapiens
MRTLFNLLWLALACSPVHTTLSKSDA

SEQ ID NO: 3257 - protein, 182 aa, Homo sapiens
MRRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 3258 - protein, 50 aa, Homo sapiens
MKVFFLFAVLFCLVQTNSVHISHREARGPSFRICVDFLGPRWARGCSTGN

SEQ ID NO: 3259 - protein, 221 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKP

SEQ ID NO: 3260 - protein, 418 aa, Homo sapiens; identical to SEQ ID NO: 2199

SEQ ID NO: 3261 - protein, 203 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNA

SEQ ID NO: 3262 - protein, 163 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINF

SEQ ID NO: 3263 - protein, 189 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRV

SEQ ID NO: 3264 - protein, 194 aa, Homo sapiens
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGL

SEQ ID NO: 3265 - protein, 361 aa, Homo sapiens; identical to SEQ ID NO: 2968

SEQ ID NO: 3266 - protein, 108 aa, Homo sapiens
  MOD_RES (1)..(1): Any amino acid
XPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 3267 - protein, 167 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKR

SEQ ID NO: 3268 - protein, 402 aa, Homo sapiens; identical to SEQ ID NO: 2149

SEQ ID NO: 3269 - protein, 324 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQVRGGPA

SEQ ID NO: 3270 - protein, 329 aa, Homo sapiens; identical to SEQ ID NO: 1856

SEQ ID NO: 3271 - protein, 116 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRR

SEQ ID NO: 3272 - protein, 93 aa, Homo sapiens; identical to SEQ ID NO: 2525

SEQ ID NO: 3273 - protein, 84 aa, Homo sapiens
MRPKTGQVGCETPEELGPGPRQRWPLLLLGLAMVAHGLLRPMVAPQSGDPDPGASVGSSRSSLRSLWGRSAQGQPHCHSVPALL

SEQ ID NO: 3274 - protein, 8 aa, Homo sapiens
MSLDIQSL

SEQ ID NO: 3275 - protein, 191 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRIT

SEQ ID NO: 3276 - protein, 40 aa, Homo sapiens
MSLDIQSLDIQCEELSDARWAELLPLLQQCQVVRLDDCGL

SEQ ID NO: 3277 - protein, 215 aa, Homo sapiens
MRPKTGQVGCETPEELGPGPRQRWPLLLLGLAMVAHGLLRPMVAPQSGDPDPGASVGSSRSSLRSLWGSRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 3278 - protein, 332 aa, Homo sapiens
MCPAGWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 3279 - protein, 295 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMG

SEQ ID NO: 3280 - protein, 132 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQG

SEQ ID NO: 3281 - protein, 119 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGRE

SEQ ID NO: 3282 - protein, 129 aa, Homo sapiens; identical to SEQ ID NO: 1961

SEQ ID NO: 3283 - protein, 461 aa, Homo sapiens [sequence omitted]

SEQ ID NO: 3284 - protein, 150 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSS

SEQ ID NO: 3285 - protein, 418 aa, Homo sapiens; identical to SEQ ID NO: 2309

SEQ ID NO: 3286 - protein, 333 aa, Homo sapiens; identical to SEQ ID NO: 2641

SEQ ID NO: 3287 - protein, 328 aa, Homo sapiens
MCPAGWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 3288 - protein, 194 aa, Homo sapiens; identical to SEQ ID NO: 1914

SEQ ID NO: 3289 - protein, 461 aa, Homo sapiens [sequence omitted]

SEQ ID NO: 3290 - protein, 664 aa, Homo sapiens
MPQAPSTGSSLIRDPSIAHRNTQILWTEAGRDLAQDTRYTGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWERTKLDLPLQCYNWTLTLGNKWKTFFETVHIYLRSRIKSNGPNGNESIYYEPLEFIDPSRNLGYMKINNIQVFGYSMHFDPEAIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 3291 - protein, 152 aa, Homo sapiens
MARDYDHLFKLLIIGDSGVGKSSLLLRFADNTFSGSYITTIGVDFKIRTVEINGEKVKLQIWDTAGQERFRTITSTYYRGTHGVIVVYDVTSAESFVNVKRWLHEINQNCDDVCRILDVQLHHGAGPPSKERQPGKTAAATTERCGEAHEEQ

SEQ ID NO: 3292 - protein, 231 aa, Homo sapiens
MLYIGIAEYFFKSASFAHFTAGVFNVTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 3293 - protein, 636 aa, Homo sapiens; identical to SEQ ID NO: 2224

SEQ ID NO: 3294 - protein, 457 aa, Homo sapiens
MGCSLPLSCIMVRSVAWAGFMVLLMIPWGSAAKLVCYFTNWAQYRQGEARFLPKDLDPSLCTHLIYAFAGMTNHQLSTTEWNDETLYQEFNGLKKMFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 3295 - protein, 374 aa, Homo sapiens
MYVSTRERYKWLRFSEDCLYLNVYAPARAPGDPQLPVMVWFPGGAFIVGAASSYEGSDLAAREKVVLVFLQHRLGIFGFLRWRGRTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 3296 - protein, 127 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMS

SEQ ID NO: 3297 - protein, 94 aa, Homo sapiens; identical to SEQ ID NO: 2593

SEQ ID NO: 3298 - protein, 137 aa, Homo sapiens
MAALSRALGPLRTPAPPLWIGLFLVATGSQQSLAQPLPGNTTEATPRSLRASGSLCGPHAKAPYLCEATHEPAAARIRAQVPDTRWSRVGGQRFYSRVLSPLHRGPSGHTEASAQRSHMGKLKEPQPQDHKPGLGAS

SEQ ID NO: 3299 - protein, 75 aa, Homo sapiens
MLKVHYPKFGVSEDCLYLNIYAPAHADTGSKLPVLVWFPGGAFKTGSASIFDGSALAAYEDVLVVVVQYRLGIFG

SEQ ID NO: 3300 - protein, 496 aa, Homo sapiens
MAPARTMARARLAPADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 3301 - protein, 175 aa, Homo sapiens
MPPGTRACRVPRPGRRAPRPRRDGEPGGHGVAPASAEEVGARPGLRAVARLLPQQHLQAGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 3302 - protein, 626 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGDQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 3303 - protein, 536 aa, Homo sapiens
MPTLCSSFGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKESSPRSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 3304 - protein, 140 aa, Homo sapiens
MSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 3305 - protein, 372 aa, Homo sapiens
MAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 3306 - protein, 413 aa, Homo sapiens; identical to SEQ ID NO: 2399

SEQ ID NO: 3307 - protein, 846 aa, Homo sapiens; identical to SEQ ID NO: 2548

SEQ ID NO: 3308 - protein, 193 aa, Homo sapiens; identical to SEQ ID NO: 1844

SEQ ID NO: 3309 - protein, 270 aa, Homo sapiens
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGAEGPDKPSVVSGLNSGPGHVWGPLLGLLLLPPLVLAGIF

SEQ ID NO: 3310 - protein, 233 aa, Homo sapiens
MDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTNTCV

SEQ ID NO: 3311 - protein, 455 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNNQRCKTRNRYICQFAQEHISRWGPGS

SEQ ID NO: 3312 - protein, 153 aa, Homo sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSDFMILWLHGENGTGPAKFNIPHSVT

SEQ ID NO: 3313 - protein, 124 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQAPARRTGSGSVTKNHAWWIQT

SEQ ID NO: 3314 - protein, 258 aa, Homo sapiens [sequence omitted]

SEQ ID NO: 3315 - protein, 576 aa, Homo sapiens; identical to SEQ ID NO: 2667

SEQ ID NO: 3316 - protein, 452 aa, Homo sapiens
MADMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 3317 - protein, 510 aa, Homo sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 3318 - protein, 37 aa, Homo sapiens
MNSTLNFFIQSYNNASNDTYLYRVQRLIRSQMQQVHC

SEQ ID NO: 3319 - protein, 421 aa, Homo sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 3320 - protein, 330 aa, Homo sapiens
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 3321 - protein, 604 aa, Homo sapiens; identical to SEQ ID NO: 1834

SEQ ID NO: 3322 - protein, 315 aa, Homo sapiens [sequence omitted]

SEQ ID NO: 3323 - protein, 68 aa, Homo sapiens
MQVSTAALAVLLCTMALCNQVLSAPLAADTPTACCFSYTSRQIPQNFIADYFETSSQCSKPSVMAAPG

SEQ ID NO: 3324 - protein, 1122 aa, Homo sapiens
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 3325 - protein, 298 aa, Homo sapiens
MLHPETSPGRGHLLAVLLALLGTAWAEVWPPQLQEQAPMAGALNRKESFLLLSLHNRLRSWVQPPAADMRRLDWSDSLNWLKPGPLWNPNPEPGVRPVAHPASGLEHAACPRAWRPLLKWSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYEPSVPPRCIFPSTPVT

SEQ ID NO: 3326 - protein, 575 aa, Homo sapiens
MDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 3327 - protein, 109 aa, Homo sapiens
  MOD_RES (1)..(1): Any amino acid
XSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 3328 - protein, 103 aa, Homo sapiens [sequence omitted]

SEQ ID NO: 3329 - protein, 962 aa, Homo sapiens; identical to SEQ ID NO: 2516

SEQ ID NO: 3330 - protein, 303 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGEPSVPPRCIFPSTPVT

SEQ ID NO: 3331 - protein, 451 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKFSSKEKYPLFTFVNGHSRDYDFTSTTTNEEDLFSEDEKKQKKKKK

SEQ ID NO: 3332 - protein, 518 aa, Homo sapiens
MRTWDYRWSLALVAQTGVHCCNLSSLQPLPPRFKRFSCLSLSSGWDYSNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 3333 - protein, 571 aa, Homo sapiens
VEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 3334 - protein, 242 aa, Homo sapiens
MLKKISVGVAGDLNTVTMKLGCVLMAWALYLSLGVLWVAQMLLAAGCHAELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 3335 - protein, 463 aa, Homo sapiens
MYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRDAGLPVYLYEFEHHARGIIVKPRTDGADHGDEMYFLFGGPFATGLSMGKEKALSLQMMKYWANFARTGNPNDGNLPCWPRYNKDEKYLQLDFTTRVGMKLKEKKMAFWMSLYQSQRPEKQRQF

SEQ ID NO: 3336 - protein, 404 aa, Homo sapiens
MFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATVSVCMAPRTGKSLPLLLKSLFKGRALGVLTYQH

SEQ ID NO: 3337 - protein, 426 aa, Homo sapiens
MGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTSSYGYGDLFSDTWNAFTDYDVIHLKTYDSKRVCFKEAVFSLLPRMRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 3338 - protein, 365 aa, Homo sapiens
MKLGCVLMAWALYLSLGVLWVAQMLLVASSFSAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 3339 - protein, 468 aa, Homo sapiens
MRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 3340 - protein, 251 aa, Homo sapiens
MSSYGYGDLFSDTWNAFTDYDVIHLKTYDSKRVCFKEAVFSLLPRMRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 3341 - protein, 308 aa, Homo sapiens [sequence omitted]

SEQ ID NO: 3342 - protein, 953 aa, Homo sapiens
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTEPEAGLREVMLLVQGLPGLQRLPSP

SEQ ID NO: 3343 - protein, 157 aa, Homo sapiens
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRSSVVHPLLQLVPHLHERRMKRFRVDEEFQSPFASQSRGYFLFRPRNGRRSAGFI

SEQ ID NO: 3344 - protein, 514 aa, Homo sapiens
MPSTVLPSTVLPSLLPTAGAGWSMRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYNITKEQVPLVVEEYLDNVNEHDWKMLRNRMMDIVQDATFVYATLQTAHYHRGLSMGKEKALSLQMMKYWANFARTGNPNDGNLPCWPRYNKDEKYLQLDFTTRVGMKLKEKKMAFWMSLYQSQRPEKQRQF

SEQ ID NO: 3345 - protein, 353 aa, Homo sapiens
MSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 3346 - protein, 357 aa, Homo sapiens
MEIEHTLDQMISKVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 3347 - protein, 446 aa, Homo sapiens; identical to SEQ ID NO: 2086

SEQ ID NO: 3348 - protein, 299 aa, Homo sapiens; identical to SEQ ID NO: 2115

SEQ ID NO: 3349 - protein, 485 aa, Homo sapiens
MDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 3350 - protein, 785 aa, Homo sapiens
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAGVGLSFLFAAPLILLVFATFLVGGNVQTLVCQSWENGELFEFADTPGNLPPSMNLSQLLGLRKNISIHQAYQQCKEGAALWTVLQLNDSYDLEEHLDINQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 3351 - protein, 263 aa, Homo sapiens
MGRVLEEARFAVAFTESMKEMAQAQWKARQISLAVTSAVPVQPHAKGKVYVQSQGIATTPNAAFNWNTFLQRSEINQSADNLHIFLLICGLRQVKDPLYLVDAFSAWHQEEPNVHLVIVGPEVDPVFTREVKAKVKRAAGVRLIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 3352 - protein, 151 aa, Homo sapiens
MKTAVMKELYSFLHHQNRYGSEQEFVDDLKNMWFGLYSRGNEEGDSSGFEHVFSGEVKKGKVTGFHNWIRFYLEEKEGLVDYYSHIYDGPVPVKPGRISLSCPDIYLGQVHLWEWQEVHRHSLHSVFHLIELRARKGHEGSCETEVLSSLD

SEQ ID NO: 3353 - protein, 120 aa, Homo sapiens
MLPQWLLLLFLLFFFLFLLTRGSLSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFF

SEQ ID NO: 3354 - protein, 316 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKVPWIPLDPLAPDLARYPSYSQAQALRCTVRAGEMLYLPALWFHHVQQSQGCIAVNFWYDMEYDLKYSYFQLLDSLTKASGLD

SEQ ID NO: 3355 - protein, 218 aa, Homo sapiens; identical to SEQ ID NO: 2537

SEQ ID NO: 3356 - protein, 302 aa, Homo sapiens
MAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 3357 - protein, 152 aa, Homo sapiens
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPT

SEQ ID NO: 3358 - protein, 1316 aa, Homo sapiens
MEPRLFCWTTLFLLAGWCLPGLPCPSRCLCFKSTVRCMHLMLDHIPQVPQQTTVLDLRFNRIREIPGSAFKKLKNLNTLLLNNNHIRKISRNAFEGLENLLYLYLYKNEIHALDKQTFKGLISLEHLYIHFNQLEMLQPETFGDLLRLERLFLHNNKLSKIPAGSFSNLDSLKRLRLDSNALVCDCDLMWLGELLQGFAQHGHTQAAATCEYPRRLHGRAVASVTVEEFNCQSPRITFEPQDVEVPSGNTVYFTCRAEGNPKPEIIWIHNNHSLDLEDDTRLNVFDDGTLMIRNTRESDQGVYQCMARNSAGEAKTQSAMLRYSSLPAKPSFVIQPQDTEVLIGTSTTLECMATGHPHPLITWTRDNGLELDGSRHVATSSGLYLQNITQRDHGRFTCHANNSHGTVQAAANIIVQAPPQFTVTPKDQVVLEEHAVEWLCEADGNPPPVIVWTKTGGQLPVEGQHTVLSSGTLRIDRAAQHDQGQYECQAVSSLGVKKVSVQLTVKPKALAVFTQLPQDTSVEVGKNINISCHAQGEPQPIITWNKEGVQITESGKFHVDDEGTLTIYDAGFPDQGRYECVARNSFGLAVTNMFLTVTAIQGRQAGDDFVESSILDAVQRVDSAINSTRRHLFSQKPHTSSDLLAQFHYPRDPLIVEMARAGEIFEHTLQLIRERVKQGLTVDLEGKEFRYNDLVSPRSLSLIANLSGCTARRPLPNCSNRCFHAKYRAHDGTCNNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADKQAGGTPEAGRVYRC

SEQ ID NO: 3359 - protein, 296 aa, Homo sapiens
MDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 3360 - protein, 935 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 3361 - protein, 89 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGK

SEQ ID NO: 3362 - protein, 218 aa, Homo sapiens; identical to SEQ ID NO: 2537

SEQ ID NO: 3363 - protein, 179 aa, Homo sapiens
MSLGPEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQEAGLISPLSPLNPLGPPTPLPPPPPPPPGLPTYEQALAASGVHDAPPPPYTSLRRPH

SEQ ID NO: 3364 - protein, 254 aa, Homo sapiens
MTLEDIVQREVWGTVVARGAPAPPGPVPTRGAASRRLSVSPASTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 3365 - protein, 632 aa, Homo sapiens
MTPPVLTTAETSVKPSVSAFTHSPPENTTGISSTISFHSRTLNLTDVIEELAQASTQTLKSTIASETTLSSKSHQSTTTRKAIIRHSTIPPFLSSSATLMPVPISPPFTQRAVTDNVATPISGLMTNTVVKLHESSRHNAKPQQLVAEVATSPKVHPNAKFTIGTTHFIYSNLLHSTPMPALTTVKSQNSKLTPSPWAENQFWHKPYSEIAEKGKKPEVSMLATTGLSEATTLVSDWDGQKNTKKSDFDKKPVQEATTSKLLPFDSLSRYIFEKPRIVGGKAASFTIPANSDAFLPCEAVGNPLPTIHWTRVPSGLDLSKRKQNSRVQVLPNGTLSIQRVEIQDRGQYLCSASNLFGTDHLHVTLSVVSYPPRILERRTKEITVHSGSTVELKCRAEGRPSPTVTWILANQTVVSESSQGSRQAVVTVDGTLVLHNLSIYDRGFYKCVASNPGGQDSLLVKIQVIAAPPVILEQRRQVIVGTWGESLKLPCTAKGTPQPSVYWVLSDGTEVKPLQFTNSKLFLFSNGTLYIRNLASSDRGTYECIATSSTGSERRVVMLTMEERVTSPRIEAASQKRTEVNFGDKLLLNCSATGEPKPQIMWRLPSKAVVDQQHRVAAGSTSTLMDPCLLDQ

SEQ ID NO: 3366 - protein, 226 aa, Homo sapiens
MDIIVLLPKGHCTKIQELQMTTVLKQNVHVFGVEGNSDELDEPIKTVFADVAFVKKHNLMSLNSINWSRVLVQMAHHFFAYFQCTPSLDTHPLPLVEVVVPTGAAGNLAAGYIAQKIGLPIRLVVAVNRNDIIHRTVQQGDFSLSEAVKSTLASAMDIQVPYNMERVFWLLSGSDSQVTRALMEQFERTQSVNLPKELHSKHSPVLPRPCLCSQVPGSCPGCWPDP

SEQ ID NO: 3367 - protein, 242 aa, Homo sapiens
MFQTGGLIVFYGLLAQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 3368 - protein, 473 aa, Homo sapiens
MSLEASLCSLEECAAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 3369 - protein, 769 aa, Homo sapiens
MLSKKGIFPWILTCISEEMAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 3370 - protein, 313 aa, Homo sapiens
MPGWLTLPTLCRFLLWAFTIFHKAQGDPASHPGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 3371 - protein, 362 aa, Homo sapiens
MAWTFECSRTTSPEPLSTSPCRTTSSRNSPTMSCPASVACEPSTSTTTSSPPKACLTRPSSPSPSCSTSAWHNKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 3372 - protein, 299 aa, Homo sapiens
MLHPETSPGRGHLLAVLLALLGTAWAEVWPPQLQEQAPMAGALNRKESFLLLSLHNRLRSWVQPPAADMRRLDWSDSLAQLAQGSPLWNPNPEPGVRPVAHPASGLEHAAAPRAWCPLSKWSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYEPSVPPRCIFPSTPVT

SEQ ID NO: 3373 - protein, 348 aa, Homo sapiens
MLDTNLILLPLFQFIVPKEWNSKYRPVCIHLAGTGDHHYWRRRTLMARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 3374 - protein, 347 aa, Homo sapiens
MRACISLVLAVLCGLAWADLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 3375 - protein, 287 aa, Homo sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 3376 - protein, 604 aa, Homo sapiens; identical to SEQ ID NO: 1834

SEQ ID NO: 3377 - protein, 334 aa, Homo sapiens
MRSAGGRGEIKVRRELQPSKQVSGLTNHARTGQEKRNLQRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKVS

SEQ ID NO: 3378 - protein, 354 aa, Homo sapiens
MAPARRPAGARLLLVYAGLLAAAAAGLGSPEPGAPSRSRARREPPPGNELPRGPGESRAGPAARPPEPTAERAHSVDPRDAWMLFVRQSDKGVNGKKRSRGKAKKLKFGLPGPPGPPGPQGPPGPIIPPEALLKEFQLLLKGAVRQRERAEPEPCTCGPAGPVAASLAPVSATAGEDDDDVVGDVLALLAAPLAPGPRAPRVEAAFLCRLRRDALVERRALHELGVYYLPDAEGAFRRGPGLNLTSGQYRAPVAGFYALAATLHVALGEPPRRGPPRPRDHLRLLICIQSRCQRNASLEAIMGLESSSELFTISVNGVLYLQMGQWTSVFLDNASGCSLTVRSGSHFSAVLLGV

SEQ ID NO: 3379 - protein, 894 aa, Homo sapiens; identical to SEQ ID NO: 3201

SEQ ID NO: 3380 - protein, 894 aa, Homo sapiens; identical to SEQ ID NO: 3201

SEQ ID NO: 3381 - protein, 961 aa, Homo sapiens; identical to SEQ ID NO: 2513

SEQ ID NO: 3382 - protein, 852 aa, Homo sapiens; identical to SEQ ID NO: 2481

SEQ ID NO: 3383 - protein, 251 aa, Homo sapiens
MPHLASLFTASSRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRGEWLSFLGICFLSRGLEGGECGEWASRIPSPAGKLSL

SEQ ID NO: 3384 - protein, 241 aa, Homo sapiens
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 3385 - protein, 511 aa, Homo sapiens
MAKGLSVQNDKHPGYQPALLLSPGAPLFADGPAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 3386 - protein, 688 aa, Homo sapiens [sequence omitted]

SEQ ID NO: 3387 - protein, 852 aa, Homo sapiens; identical to SEQ ID NO: 2481

SEQ ID NO: 3388 - protein, 578 aa, Homo sapiens; identical to SEQ ID NO: 2508

SEQ ID NO: 3389 - protein, 441 aa, Homo sapiens; identical to SEQ ID NO: 2345

SEQ ID NO: 3390 - protein, 894 aa, Homo sapiens; identical to SEQ ID NO: 3201

SEQ ID NO: 3391 - protein, 71 aa, Homo sapiens; identical to SEQ ID NO: 2529

SEQ ID NO: 3392 - protein, 919 aa, Homo sapiens; identical to SEQ ID NO: 2501

SEQ ID NO: 3393 - protein, 148 aa, Homo sapiens; identical to SEQ ID NO: 2485

SEQ ID NO: 3394 - protein, 1698 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 3395 - protein, 661 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 3396 - protein, 171 aa, Homo sapiens; identical to SEQ ID NO: 3085

SEQ ID NO: 3397 - protein, 661 aa, Homo sapiens; identical to SEQ ID NO: 3395

SEQ ID NO: 3398 - protein, 578 aa, Homo sapiens; identical to SEQ ID NO: 2508

SEQ ID NO: 3399 - protein, 441 aa, Homo sapiens; identical to SEQ ID NO: 2345

SEQ ID NO: 3400 - protein, 148 aa, Homo sapiens; identical to SEQ ID NO: 2485

SEQ ID NO: 3401 - protein, 243 aa, Homo sapiens; identical to SEQ ID NO: 3045

SEQ ID NO: 3402 - protein, 243 aa, Homo sapiens; identical to SEQ ID NO: 3045

SEQ ID NO: 3403 - protein, 407 aa, Homo sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 3404 - protein, 251 aa, Homo sapiens; identical to SEQ ID NO: 3383

SEQ ID NO: 3405 - protein, 251 aa, Homo sapiens; identical to SEQ ID NO: 3383

SEQ ID NO: 3406 - protein, 151 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVY

SEQ ID NO: 3407 - protein, 71 aa, Homo sapiens; identical to SEQ ID NO: 2529

SEQ ID NO: 3408 - protein, 148 aa, Homo sapiens; identical to SEQ ID NO: 2485

SEQ ID NO: 3409 - protein, 148 aa, Homo sapiens; identical to SEQ ID NO: 2485

SEQ ID NO: 3410 - protein, 441 aa, Homo sapiens; identical to SEQ ID NO: 2345

SEQ ID NO: 3411 - protein, 688 aa, Homo sapiens [sequence omitted]

SEQ ID NO: 3412 - protein, 441 aa, Homo sapiens
MEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTLLPVSPMALRCCSPIQPTASFWPLTPVPLEARAPPHPPGPNPPTPRGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHFWGERHRFLH

SEQ ID NO: 3413 - protein, 852 aa, Homo sapiens; identical to SEQ ID NO: 2481

SEQ ID NO: 3414 - protein, 243 aa, Homo sapiens; identical to SEQ ID NO: 3045

SEQ ID NO: 3415 - protein, 919 aa, Homo sapiens; identical to SEQ ID NO: 2501

SEQ ID NO: 3416 - protein, 899 aa, Homo sapiens; identical to SEQ ID NO: 2512

SEQ ID NO: 3417 - protein, 148 aa, Homo sapiens; identical to SEQ ID NO: 2485

SEQ ID NO: 3418 - protein, 171 aa, Homo sapiens; identical to SEQ ID NO: 3085

SEQ ID NO: 3419 - protein, 221 aa, Homo sapiens
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 3420 - protein, 148 aa, Homo sapiens; identical to SEQ ID NO: 2485

SEQ ID NO: 3421 - protein, 578 aa, Homo sapiens; identical to SEQ ID NO: 2508

SEQ ID NO: 3422 - protein, 578 aa, Homo sapiens; identical to SEQ ID NO: 2508

SEQ ID NO: 3423 - protein, 251 aa, Homo sapiens; identical to SEQ ID NO: 3383

SEQ ID NO: 3424 - protein, 587 aa, Homo sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 3425 - protein, 688 aa, Homo sapiens [sequence omitted]

SEQ ID NO: 3426 - protein, 100 aa, Homo sapiens
MTTQLRVVHLLPLLLACFVQTSPKQEKMKMDCHKDEKGTIYDYEAIALNKNEYVSFKQYVGKHILFVNVATYCGLTAQYPGMSVQGEDLYLVSSFLRKGM

SEQ ID NO: 3427 - protein, 234 aa, Homo sapiens
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFK

SEQ ID NO: 3428 - protein, 852 aa, Homo sapiens; identical to SEQ ID NO: 2481

SEQ ID NO: 3429 - protein, 919 aa, Homo sapiens; identical to SEQ ID NO: 2501

SEQ ID NO: 3430 - protein, 578 aa, Homo sapiens; identical to SEQ ID NO: 2508

SEQ ID NO: 3431 - protein, 171 aa, Homo sapiens; identical to SEQ ID NO: 3085

SEQ ID NO: 3432 - protein, 688 aa, Homo sapiens [sequence omitted]

SEQ ID NO: 3433 - protein, 1698 aa, Homo sapiens; identical to SEQ ID NO: 3394

SEQ ID NO: 3434 - protein, 241 aa, Homo sapiens; identical to SEQ ID NO: 3384

SEQ ID NO: 3435 - protein, 243 aa, Homo sapiens; identical to SEQ ID NO: 3045

SEQ ID NO: 3436 - protein, 661 aa, Homo sapiens; identical to SEQ ID NO: 3395

SEQ ID NO: 3437 - protein, 919 aa, Homo sapiens; identical to SEQ ID NO: 2501

SEQ ID NO: 3438 - protein, 71 aa, Homo sapiens; identical to SEQ ID NO: 2529

SEQ ID NO: 3439 - protein, 894 aa, Homo sapiens; identical to SEQ ID NO: 3201

SEQ ID NO: 3440 - protein, 90 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQ

SEQ ID NO: 3441 - protein, 205 aa, Homo sapiens; identical to SEQ ID NO: 2215

SEQ ID NO: 3442 - protein, 9 aa, Homo sapiens
MSFSATILF

SEQ ID NO: 3443 - protein, 199 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNP

SEQ ID NO: 3444 - protein, 210 aa, Homo sapiens; identical to SEQ ID NO: 2772

SEQ ID NO: 3445 - protein, 406 aa, Homo sapiens; identical to SEQ ID NO: 2150

SEQ ID NO: 3446 - protein, 199 aa, Homo sapiens; identical to SEQ ID NO: 2193

SEQ ID NO: 3447 - protein, 136 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFK

SEQ ID NO: 3448 - protein, 83 aa, Homo sapiens
MSFSATILFSPPSGSEARCCCCACKSETNGGNTGSQGGNPPPSTPITVTGHGLAVQSSEQLLHVIYQRVDKAVGLAEAALGLA

SEQ ID NO: 3449 - protein, 9 aa, Homo sapiens
MSFSATILF

SEQ ID NO: 3450 - protein, 172 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQI

SEQ ID NO: 3451 - protein, 204 aa, Homo sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGMYPSSPEGEGSGLLWASASCSESEGGVG

SEQ ID NO: 3452 - protein, 406 aa, Homo sapiens; identical to SEQ ID NO: 2150

SEQ ID NO: 3453 - protein, 1278 aa, Homo sapiens; identical to SEQ ID NO: 2907

SEQ ID NO: 3454 - protein, 86 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSS

SEQ ID NO: 3455 - protein, 301 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRYFQT

SEQ ID NO: 3456 - protein, 136 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPS

SEQ ID NO: 3457 - protein, 406 aa, Homo sapiens; identical to SEQ ID NO: 2150

SEQ ID NO: 3458 - protein, 205 aa, Homo sapiens; identical to SEQ ID NO: 2215

SEQ ID NO: 3459 - protein, 79 aa, Homo sapiens
MSFSATILFSPPSGSEARCCCCACKSETNGGNTGSQGGNPPPSTPITVTGHGLAVQSSEQLLHVIYQRVDKAVGLAEAA

SEQ ID NO: 3460 - protein, 205 aa, Homo sapiens; identical to SEQ ID NO: 2215

SEQ ID NO: 3461 - protein, 1262 aa, Homo sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHDWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 3462 - protein, 106 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVS

SEQ ID NO: 3463 - protein, 147 aa, Homo sapiens; identical to SEQ ID NO: 2716

SEQ ID NO: 3464 - protein, 144 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDT

SEQ ID NO: 3465 - protein, 179 aa, Homo sapiens; identical to SEQ ID NO: 3187

SEQ ID NO: 3466 - protein, 147 aa, Homo sapiens; identical to SEQ ID NO: 2716

SEQ ID NO: 3467 - protein, 199 aa, Homo sapiens; identical to SEQ ID NO: 2193

SEQ ID NO: 3468 - protein, 50 aa, Homo sapiens
MSFSATILFSPPSGSEARCCCCACKSETNGGNTGSQGGNPPPSTPITVTG

SEQ ID NO: 3469 - protein, 24 aa, Homo sapiens
MQLFLLLCLVLLSPQGASLHRHHP

SEQ ID NO: 3470 - protein, 210 aa, Homo sapiens; identical to SEQ ID NO: 2772

SEQ ID NO: 3471 - protein, 11 aa, Homo sapiens
MSFSATILFSP

SEQ ID NO: 3472 - protein, 147 aa, Homo sapiens; identical to SEQ ID NO: 2596

SEQ ID NO: 3473 - protein, 231 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVV

SEQ ID NO: 3474 - protein, 541 aa, Homo sapiens
MAKFGVHRILLLAISLTKCLESTKLLADLKKCGDLECEALINRVSAMRDYRGPDCRYLNFTKGEEISVYVKLAGEREDLWAGKGKEFGYFPRDAVQIEEVFISEEIQMSTKESDFLCLLGVSYTFDNEDSELNGDYGENIYPYEEDKDEKSSIYESDFQIEPGFYATYESTLFEDQVPALEAPEDIGSTSESKDWEEVVVESMEQDRIPEVHVPPSSAVSGVKEWFGLGGEQAEEKAFESVIEPVQESSFRSRKIAVEDENDLEELNNGEPQTEHQQESESEIDSVPKTQSELASESEHIPKPQSTGWFGGGFTSYLGFGDEDTGLELIAEESNPPLQDFPNSISSDKEATVPCTEILTEKKDTITNDSLSLKPSWFDFGFAILGFAYAKEDKIMLDDRKNEEDGGADEHEHPLTSELDPEKEQEIETIKIIETEDQIDKKPVSEKTDESDTIPYLKKFLYNFDNPWNFQNIPKETELPFPKQILDQNNVIENEETGEFSIDNYPTDNTKVMIFKSSYSLSGWYENIYIRIYFIFKHNLFL

SEQ ID NO: 3475 - protein, 414 aa, Homo sapiens; identical to SEQ ID NO: 2234

SEQ ID NO: 3476 - protein, 205 aa, Homo sapiens; identical to SEQ ID NO: 2215

SEQ ID NO: 3477 - protein, 171 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQY

SEQ ID NO: 3478 - protein, 210 aa, Homo sapiens; identical to SEQ ID NO: 2772

SEQ ID NO: 3479 - protein, 178 aa, Homo sapiens; identical to SEQ ID NO: 3020

SEQ ID NO: 3480 - protein, 157 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADT

SEQ ID NO: 3481 - protein, 344 aa, Homo sapiens
MPPRMLVAPLPLHFLLAAVSSENRSGRRQWQQAVAAGSGPGRNSSRAIHWSLPRALVPATGTRASGSQKRQRPPKGQEALWSRPHSRHSAERAGGSHSDPGRLSAPLGLGLPSGRGRLTAMPGRAPLRTVPGALGAWLLGGLWAWTLCGLCSLGAVGAPRPCQAPQQWEGRQVMYQQSSGRNSRALLSYDGLNQRVRVLDERKALIPCKRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 3482 - protein, 106 aa, Homo sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 3483 - protein, 223 aa, Homo sapiens
MRLQRPRQAPAGGRRAPRGGRGSPYRPDPGRGARRLRRFQKGGEGAPRADPPWAPLGTMALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 3484 - protein, 135 aa, Homo sapiens
MTPTPTAAWTPPPPLRPSAAAAGAQCRSCPFRGGCAPSTARTPPACMRPAGPCAPPTWPAPSTTTSTCTSRRAGCTASSASYSTLAAACSLRRSGVRWPPSSAYSTWAFASCCASSASCRCCCCCWAAGAWTSAW

SEQ ID NO: 3485 - protein, 513 aa, Homo sapiens; identical to SEQ ID NO: 2936

SEQ ID NO: 3486 - protein, 446 aa, Homo sapiens; identical to SEQ ID NO: 2086

SEQ ID NO: 3487 - protein, 311 aa, Homo sapiens
MGVMAMLMLPLLLLGISGLLFIYQEVSRLWSKSAVQNKVVVITDAISGLGKECARVFHTGGARLVLCGKNWERLENLYDALISVADPSKTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 3488 - protein, 197 aa, Homo sapiens; identical to SEQ ID NO: 2033

SEQ ID NO: 3489 - protein, 234 aa, Homo sapiens
MKVLLLTGLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 3490 - protein, 75 aa, Homo sapiens
MKVLLLTGLGALFFAYYWDDNFDPASLQGARVLLTGANAGVGEELAYHYARLGSHLVLTAHTEALLQKAGWTTSC

SEQ ID NO: 3491 - protein, 74 aa, Homo sapiens
MQPSEMVMNPKQVFLSVLIFGVAGLLLFMYLQVWIEEQHTGRVEKRREQKVTSGWGPVKYLRPVPRIKPQVSHA

SEQ ID NO: 3492 - protein, 286 aa, Homo sapiens; identical to SEQ ID NO: 2219

SEQ ID NO: 3493 - protein, 152 aa, Homo sapiens
MQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 3494 - protein, 951 aa, Homo sapiens
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTEPEAGAPRGDAPRSRTARVAAPP

SEQ ID NO: 3495 - protein, 2809 aa, Homo sapiens; identical to SEQ ID NO: 1943

SEQ ID NO: 3496 - protein, 96 aa, Homo sapiens; identical to SEQ ID NO: 2549

SEQ ID NO: 3497 - protein, 629 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 3498 - DNA, 591 bp, Artificial Sequence
  Description of Artificial Sequence: Synthetic coding sequence
atgagcagaagaagcatgctgctggcctgggccctgcccagcctgctgagactgggcgccgcccaggagaccgaggaccccgcctgctgcagccccatcgtgcccagaaacgagtggaaggccctggccagcgagtgcgcccagcacctgagcctgcccctgagatacgtggtggtgagccacaccgccggcagcagctgcaacacccccgccagctgccagcagcaggccagaaacgtgcagcactaccacatgaagaccctgggctggtgcgacgtgggctacaacttcctgatcggcgaggacggcctggtgtacgagggcagaggctggaacttcaccggcgcccacagcggccacctgtggaaccccatgagcatcggcatcagcttcatgggcaactacatggacagagtgcccaccccccaggccatcagagccgcccagggcctgctggcctgcggcgtggcccagggcgccctgagaagcaactacgtgctgaagggccacagagacgtgcagagaaccctgagccccggcaaccagctgtaccacctgatccagaactggccccactacagaagcccctag

SEQ ID NO: 3499 - DNA, 1056 bp, Artificial Sequence
  Description of Artificial Sequence: Synthetic coding sequence
atggaggccttcgccctgggccccgccagaagaggcagaagaagaaccagagccgccggcagcctgctgagcagagccgccatcctgctgttcatcagcgccttcctggtgagagtgcccagcagcgtgggccacctggtgagactgcccagagccttcagactgaccaaggacagcgtgaagatcgtgggcagcaccagcttccccgtgaaggcctacgtgatgctgcaccagaagagcccccacgtgctgtgcgtgacccagcagctgagaaacgccgagctgatcgaccccagcttccagtggtacggccccaagggcaaggtggtgagcgtggagaacagaaccgcccagatcaccagcaccggcagcctggtgttccagaacttcgaggagagcatgagcggcatctacacctgcttcctggagtacaagcccaccgtggaggagatcgtgaagagactgcagctgaagtacgccatctacgcctacagagagccccactactactaccagttcaccgccagataccacgccgccccctgcaacagcatctacaacatcagcttcgagaagaagctgctgcagatcctgagcaagctgctgctggacctgagctgcgagatcagcctgctgaagagcgagtgccacagagtgaagatgcagagagccggcctgcagaacgagctgttcttcgccttcagcgtgagcagcctggacaccgagaagggccccaagagatgcaccgaccacaactgcgagccctacaagagactgttcaaggccaagaacctgatcgagagattcttcaaccagcaggtggagatcctgggcagaagagccgagcagctgccccagatctactacatcgagggcaccctgcagatggtgtggatcaacagatgcttccccggctacggcatgaacgtgcagcagcaccccaagtgccccgagtgctgcgtgatctgcagccccggcagctacaaccccagagacggcatccactgcctgcagtgcaacagcagcctggtgtacggcgccaagacctgcctgtag

SEQ ID NO: 3500 - DNA, 420 bp, Artificial Sequence
  Description of Artificial Sequence: Synthetic coding sequence
atggagaccaacgtgttccacctgatgctgtgcgtgaccagcgccagaacccacaagagcaccagcctgtgcttcggccacttcaacagctaccccagcctgcccctgatccacgacctgctgctggagatcagcttccagctgagcgccccccacgaggacgccagactgacccccgaggagctggagagagccagcctgctgcagatcctgcccgagatgctgggcgccgagagaggcgacatcctgagaaaggccgacagcagcaccaacatcttcaaccccagaggcaacctgagaaagttccaggacttcagcggccaggaccccaacatcctgctgagccacctgctggccagaatctggaagccctacaagaagagagagacccccgactgcttctggaagtactgcgtgtag

SEQ ID NO: 3501 - DNA, 606 bp, Artificial Sequence
  Description of Artificial Sequence: Synthetic coding sequence
atgggcagcggcagaagagccctgagcgccgtgcccgccgtgctgctggtgctgaccctgcccggcctgcccgtgtgggcccagaacgacaccgagcccatcgtgctggagggcaagtgcctggtggtgtgcgacagcaaccccgccaccgacagcaagggcagcagcagcagccccctgggcatcagcgtgagagccgccaacagcaaggtggccttcagcgccgtgagaagcaccaaccacgagcccagcgagatgagcaacaagaccagaatcatctacttcgaccagatcctggtgaacgtgggcaacttcttcaccctggagagcgtgttcgtggcccccagaaagggcatctacagcttcagcttccacgtgatcaaggtgtaccagagccagaccatccaggtgaacctgatgctgaacggcaagcccgtgatcagcgccttcgccggcgacaaggacgtgaccagagaggccgccaccaacggcgtgctgctgtacctggacaaggaggacaaggtgtacctgaagctggagaagggcaacctggtgggcggctggcagtacagcaccttcagcggcttcctggtgttccccctgtag

SEQ ID NO: 3502 - DNA, 264 bp, Artificial Sequence
  Description of Artificial Sequence: Synthetic coding sequence
atgaaggtgctgagagcctggctgctgtgcctgctgatgctgggcctggccctgagaggcgccgccagcagaacccacagacacagcatggagatcagaacccccgacatcaaccccgcctggtacgccagcagaggcatcagacccgtgggcagattcggcagaagaagagccaccctgggcgacgtgcccaagcccggcctgagacccagactgacctgcttccccctggagggcggcgccatgagcagccaggacggctag

SEQ ID NO: 3503 - DNA, 1098 bp, Artificial Sequence
  Description of Artificial Sequence: Synthetic coding sequence
atgcccggcggcaagaaggtggccggcggcggcagcagcggcgccacccccaccagcgccgccgccaccgcccccagcggcgtgagaagactggagaccagcgagggcaccagcgcccagagagacgaggagcccgaggaggagggcgaggaggacctgagagacggcggcgtgcccttcttcgtgaacagaggcggcctgcccgtggacgaggccacctgggagagaatgtggaagcacgtggccaagatccaccccgacggcgagaaggtggcccagagaatcagaggcgccaccgacctgcccaagatccccatccccagcgtgcccaccttccagcccagcacccccgtgcccgagagactggaggccgtgcagagatacatcagagagctgcagtacaaccacaccggcacccagttcttcgagatcaagaagagcagacccctgaccggcctgatggacctggccaaggagatgaccaaggaggccctgcccatcaagtgcctggaggccgtgatcctgggcatctacctgaccaacagcatgcccaccctggagagattccccatcagcttcaagacctacttcagcggcaactacttcagacacatcgtgctgggcgtgaacttcgccggcagatacggcgccctgggcatgagcagaagagaggacctgatgtacaagccccccgccttcagaaccctgagcgagctggtgctggacttcgaggccgcctacggcagatgctggcacgtgctgaagaaggtgaagctgggccagagcgtgagccacgacccccacagcgtggagcagatcgagtggaagcacagcgtgctggacgtggagagactgggcagagacgacttcagaaaggagctggagagacacgccagagacatgagactgaagatcggcaagggcaccggcccccccagccccaccaaggacagaaagaaggacgtgagcagcccccagagagcccagagcagcccccacagaagaaacagcagaagcgagagaagacccagcggcgacaagaagaccagcgagcccaaggccatgcccgacctgaacggctaccagatcagagtgtag

SEQ ID NO: 3504 - DNA, 1377 bp, Artificial Sequence
  Description of Artificial Sequence: Synthetic coding sequence
atggcctgggccagcagactgggcctgctgctggccctgctgctgcccgtggtgggcgccagcacccccggcaccgtggtgagactgaacaaggccgccctgagctacgtgagcgagatcggcaaggcccccctgcagagagccctgcaggtgaccgtgccccacttcctggactggagcggcgaggccctgcagcccaccagaatcagaatcctgaacgtgcacgtgcccagactgcacctgaagttcatcgccggcttcggcgtgagactgctggccgccgccaacttcaccttcaaggtgttcagagcccccgagcccctggagctgaccctgcccgtggagctgctggccgacaccagagtgacccagagcagcatcagaacccccgtggtgagcatcagcgcctgcagcctgttcagcggccacgccaacgagttcgacggcagcaacagcaccagccacgccctgctggtgctggtgcagaagcacatcaaggccgtgctgagcaacaagctgtgcctgagcatcagcaacctggtgcagggcgtgaacgtgcacctgggcaccctgatcggcctgaaccccgtgggccccgagagccagatcagatacagcatggtgagcgtgcccaccgtgaccagcgactacatcagcctggaggtgaacgccgtgctgttcctgctgggcaagcccatcatcctgcccaccgacgccacccccttcgtgctgcccagacacgtgggcaccgagggcagcatggccaccgtgggcctgagccagcagctgttcgacagcgccctgctgctgctgcagaaggccggcgccctgaacctggacatcaccggccagctgagaagcgacgacaacctgctgaacaccagcgccctgggcagactgatccccgaggtggccagacagttccccgagcccatgcccgtggtgctgaaggtgagactgggcgccacccccgtggccatgctgcacaccaacaacgccaccctgagactgcagcccttcgtggaggtgctggccaccgccagcaacagcgccttccagagcctgttcagcctggacgtggtggtgaacctgagactgcagctgagcgtgagcaaggtgaagctgcagggcaccaccagcgtgctgggcgacgtgcagctgaccgtggccagcagcaacgtgggcttcatcgacaccgaccaggtgagaaccctgatgggcaccgtgttcgagaagcccctgctggaccacctgaacgccctgctggccatgggcatcgccctgcccggcgtggtgaacctgcactacgtggcccccgagatcttcgtgtacgagggctacgtggtgatcagcagcggcctgttctaccagagctag

SEQ ID NO: 3505 - DNA, 1815 bp, Artificial Sequence
  Description of Artificial Sequence: Synthetic coding sequence
atgatgagagccgtgtgggaggccctggccgccctggccgccgtggcctgcctggtgggcgccgtgagaggcggccccggcctgagcatgttcgccggccaggccgcccagcccgacccctgcagcgacgagaacggccaccccagaagatgcatccccgacttcgtgaacgccgccttcggcaaggacgtgagagtgagcagcacctgcggcagaccccccgccagatactgcgtggtgagcgagagaggcgaggagagactgagaagctgccacctgtgcaacgccagcgaccccaagaaggcccacccccccgccttcctgaccgacctgaacaacccccacaacctgacctgctggcagagcgagaactacctgcagttcccccacaacgtgaccctgaccctgagcctgggcaagaagttcgaggtgacctacgtgagcctgcagttctgcagccccagacccgagagcatggccatctacaagagcatggactacggcagaacctgggtgcccttccagttctacagcacccagtgcagaaagatgtacaacagaccccacagagcccccatcaccaagcagaacgagcaggaggccgtgtgcaccgacagccacaccgacatgagacccctgagcggcggcctgatcgccttcagcaccctggacggcagacccagcgcccacgacttcgacaacagccccgtgctgcaggactgggtgaccgccaccgacatcagagtggccttcagcagactgcacaccttcggcgacgagaacgaggacgacagcgagctggccagagacagctacttctacgccgtgagcgacctgcaggtgggcggcagatgcaagtgcaacggccacgccgccagatgcgtgagagacagagacgacagcctggtgtgcgactgcagacacaacaccgccggccccgagtgcgacagatgcaagcccttccactacgacagaccctggcagagagccaccgccagagaggccaacgagtgcgtggcctgcaactgcaacctgcacgccagaagatgcagattcaacatggagctgtacaagctgagcggcagaaagagcggcggcgtgtgcctgaactgcagacacaacaccgccggcagacactgccactactgcaaggagggctactacagagacatgggcaagcccatcacccacagaaaggcctgcaaggcctgcgactgccaccccgtgggcgccgccggcaagacctgcaaccagaccaccggccagtgcccctgcaaggacggcgtgaccggcatcacctgcaacagatgcgccaagggctaccagcagagcagaagccccatcgccccctgcatcaagatccccgtggccccccccaccaccgccgccagcagcgtggaggagcccgaggactgcgacagctactgcaaggccagcaagggcaagctgaagatcaacatgaagaagtactgcaagaaggactacgccgtgcagatccacatcctgaaggccgacaaggccggcgactggtggaagttcaccgtgaacatcatcagcgtgtacaagcagggcaccagcagaatcagaagaggcgaccagagcctgtggatcagaagcagagacatcgcctgcaagtgccccaagatcaagcccctgaagaagtacctgctgctgggcaacgccgaggacagccccgaccagagcggcatcgtggccgacaagagcagcctggtgatccagtggagagacacctgggccagaagactgagaaagttccagcagagagagaagaagggcaagtgcaagaaggcctag

SEQ ID NO: 3506 - DNA, 675 bp, Artificial Sequence
  Description of Artificial Sequence: Synthetic coding sequence
atgcccggcagagcccccctgagaaccgtgcccggcgccctgggcgcctggctgctgggcggcctgtgggcctggaccctgtgcggcctgtgcagcctgggcgccgtgggcgcccccagaccctgccaggccccccagcagtgggagggcagacaggtgatgtaccagcagagcagcggcagaaacagcagagccctgctgagctacgacggcctgaaccagagagtgagagtgctggacgagagaaaggccctgatcccctgcaagagactgttcgagtacatcctgctgtacaaggacggcgtgatgttccagatcgaccaggccaccaagcagtgcagcaagatgaccctgacccagccctgggaccccctggacatcccccagaacagcaccttcgaggaccagtacagcatcggcggcccccaggagcagatcaccgtgcaggagtggagcgacagaaagagcgccagaagctacgagacctggatcggcatctacaccgtgaaggactgctaccccgtgcaggagaccttcaccatcaactacagcgtgatcctgagcaccagattcttcgacatccagctgggcatcaaggaccccagcgtgttcaccccccccagcacctgccagatggcccagctggagaagatgagcgaggactgcagctggtag

SEQ ID NO: 3507 - DNA, 5106 bp, Artificial Sequence
  Description of Artificial Sequence: Synthetic coding sequence
atgggcttcctgcccaagctgctgctgctggccagcttcttccccgccggccaggccagctggggcgtgagcagcccccaggacgtgcagggcgtgaagggcagctgcctgctgatcccctgcatcttcagcttccccgccgacgtggaggtgcccgacggcatcaccgccatctggtactacgactacagcggccagagacaggtggtgagccacagcgccgaccccaagctggtggaggccagattcagaggcagaaccgagttcatgggcaaccccgagcacagagtgtgcaacctgctgctgaaggacctgcagcccgaggacagcggcagctacaacttcagattcgagatcagcgaggtgaacagatggagcgacgtgaagggcaccctggtgaccgtgaccgaggagcccagagtgcccaccatcgccagccccgtggagctgctggagggcaccgaggtggacttcaactgcagcaccccctacgtgtgcctgcaggagcaggtgagactgcagtggcagggccaggaccccgccagaagcgtgaccttcaacagccagaagttcgagcccaccggcgtgggccacctggagaccctgcacatggccatgagctggcaggaccacggcagaatcctgagatgccagctgagcgtggccaaccacagagcccagagcgagatccacctgcaggtgaagtacgcccccaagggcgtgaagatcctgctgagccccagcggcagaaacatcctgcccggcgagctggtgaccctgacctgccaggtgaacagcagctaccccgccgtgagcagcatcaagtggctgaaggacggcgtgagactgcagaccaagaccggcgtgctgcacctgccccaggccgcctggagcgacgccggcgtgtacacctgccaggccgagaacggcgtgggcagcctggtgagcccccccatcagcctgcacatcttcatggccgaggtgcaggtgagccccgccggccccatcctggagaaccagaccgtgaccctggtgtgcaacacccccaacgaggcccccagcgacctgagatacagctggtacaagaaccacgtgctgctggaggacgcccacagccacaccctgagactgcacctggccaccagagccgacaccggcttctacttctgcgaggtgcagaacgtgcacggcagcgagagaagcggccccgtgagcgtggtggtgaaccacccccccctgacccccgtgctgaccgccttcctggagacccaggccggcctggtgggcatcctgcactgcagcgtggtgagcgagcccctggccaccctggtgctgagccacggcggccacatcctggccagcaccagcggcgacagcgaccacagccccagattcagcggcaccagcggccccaacagcctgagactggagatcagagacctggaggagaccgacagcggcgagtacaagtgcagcgccaccaacagcctgggcaacgccaccagcaccctggacttccacgccaacgccgccagactgctgatcagccccgccgccgaggtggtggagggccaggccgtgaccctgagctgcagaagcggcctgagccccacccccgacgccagattcagctggtacctgaacggcgccctgctgcacgagggccccggcagcagcctgctgctgcccgccgccagcagcaccgacgccggcagctaccactgcagagccagagacggccacagcgccagcggccccagcagccccgccgtgctgaccgtgctgtacccccccagacagcccaccttcaccaccagactggacctggacgccgccggcgccggcgccggcagaagaggcctgctgctgtgcagagtggacagcgacccccccgccagactgcagctgctgcacaaggacagagtggtggccaccagcctgcccagcggcggcggctgcagcacctgcggcggctgcagccccagaatgaaggtgaccaaggcccccaacctgctgagagtggagatccacaaccccctgctggaggaggagggcctgtacctgtgcgaggccagcaacgccctgggcaacgccagcaccagcgccaccttcaacggccaggccaccgtgctggccatcgcccccagccacaccctgcaggagggcaccgaggccaacctgacctgcaacgtgagcagagaggccgccggcagccccgccaacttcagctggttcagaaacggcgtgctgtgggcccagggccccctggagaccgtgaccctgctgcccgtggccagaaccgacgccgccctgtacgcctgcagaatcctgaccgaggccggcgcccagctgagcacccccgtgctgctgagcgtgctgtacccccccgacagacccaagctgagcgccctgctggacatgggccagggccacatggccctgttcatctgcaccgtggacagcagacccctggccctgctggccctgttccacggcgagcacctgctggccaccagcctgggcccccaggtgcccagccacggcagattccaggccaaggccgaggccaacagcctgaagctggaggtgagagagctgggcctgggcgacagcggcagctacagatgcgaggccaccaacgtgctgggcagcagcaacaccagcctgttcttccaggtgagaggcgcctgggtgcaggtgagccccagccccgagctgcaggagggccaggccgtggtgctgagctgccaggtgcacaccggcgtgcccgagggcaccagctacagatggtacagagacggccagcccctgcaggagagcaccagcgccaccctgagattcgccgccatcaccctgacccaggccggcgcctaccactgccaggcccaggcccccggcagcgccaccaccagcctggccgcccccatcagcctgcacgtgagctacgcccccagacacgtgaccctgaccaccctgatggacaccggccccggcagactgggcctgctgctgtgcagagtggacagcgacccccccgcccagctgagactgctgcacggcgacagactggtggccagcaccctgcagggcgtgggcggccccgagggcagcagccccagactgcacgtggccgtggcccccaacaccctgagactggagatccacggcgccatgctggaggacgagggcgtgtacatctgcgaggccagcaacaccctgggccaggccagcgccagcgccgacttcgacgcccaggccgtgaacgtgcaggtgtggcccggcgccaccgtgagagagggccagctggtgaacctgacctgcctggtgtggaccacccaccccgcccagctgacctacacctggtaccaggacggccagcagagactggacgcccacagcatccccctgcccaacgtgaccgtgagagacgccaccagctacagatgcggcgtgggcccccccggcagagcccccagactgagcagacccatcaccctggacgtgctgtacgcccccagaaacctgagactgacctacctgctggagagccacggcggccagctggccctggtgctgtgcaccgtggacagcagaccccccgcccagctggccctgagccacgccggcagactgctggccagcagcaccgccgccagcgtgcccaacaccctgagactggagctgagaggcccccagcccagagacgagggcttctacagctgcagcgccagaagccccctgggccaggccaacaccagcctggagctgagactggagggcgtgagagtgatcctggcccccgaggccgccgtgcccgagggcgcccccatcaccgtgacctgcgccgaccccgccgcccacgcccccaccctgtacacctggtaccacaacggcagatggctgcaggagggccccgccgccagcctgagcttcctggtggccaccagagcccacgccggcgcctacagctgccaggcccaggacgcccagggcaccagaagcagcagacccgccgccctgcaggtgctgtacgccccccaggacgccgtgctgagcagcttcagagacagcagagccagaagcatggccgtgatccagtgcaccgtggacagcgagccccccgccgagctggccctgagccacgacggcaaggtgctggccaccagcagcggcgtgcacagcctggccagcggcaccggccacgtgcaggtggccagaaacgccctgagactgcaggtgcaggacgtgcccgccggcgacgacacctacgtgtgcaccgcccagaacctgctgggcagcatcagcaccatcggcagactgcaggtggagggcgccagagtggtggccgagcccggcctggacgtgcccgagggcgccgccctgaacctgagctgcagactgctgggcggccccggccccgtgggcaacagcaccttcgcctggttctggaacgacagaagactgcacgccgagcccgtgcccaccctggccttcacccacgtggccagagcccaggccggcatgtaccactgcctggccgagctgcccaccggcgccgccgccagcgcccccgtgatgctgagagtgctgtacccccccaagacccccaccatgatggtgttcgtggagcccgagggcggcctgagaggcatcctggactgcagagtggacagcgagcccctggccagcctgaccctgcacctgggcagcagactggtggccagcagccagccccagggcgcccccgccgagccccacatccacgtgctggccagccccaacgccctgagagtggacatcgaggccctgagacccagcgaccagggcgagtacatctgcagcgccagcaacgtgctgggcagcgccagcaccagcacctacttcggcgtgagagccctgcacagactgcaccagttccagcagctgctgtgggtgctgggcctgctggtgggcctgctgctgctgctgctgggcctgggcgcctgctacacctggagcagcctgatcctgatgcagccccacgtgagaccccagcccgtgccccacccctgggccgaccagtggtgctgcctgcccagcggcggcgagagcggccagaacctgtag

SEQ ID NO: 3508 - DNA, 708 bp, Artificial Sequence
  Description of Artificial Sequence: Synthetic coding sequence
atgaccgtgctggcccccgcctggagccccaccacctacctgctgctgctgctgctgctgagcagcggcctgagcggcacccaggactgcagcttccagcacagccccatcagcagcgacttcgccgtgaagatcagagagctgagcgactacctgctgcaggactaccccgtgaccgtggccagcaacctgcaggacgaggagctgtgcggcggcctgtggagactggtgctggcccagagatggatggagagactgaagaccgtggccggcagcaagatgcagggcctgctggagagagtgaacaccgagatccacttcgtgaccaagtgcgccttccagcccccccccagctgcctgagattcgtgcagaccaacatcagcagactgctgcaggagaccagcgagcagctggtggccctgaagccctggatcaccagacagaacttcagcagatgcctggagctgcagtgccagcccgacagcagcaccctgccccccccctggagccccagacccctggaggccaccgcccccaccgccccccagccccccctgctgctgctgctgctgctgcccgtgggcctgctgctgctggccgccgcctggtgcctgcactggcagagaaccagaagaagaacccccagacccggcgagcaggtgccccccgtgcccagcccccaggacctgctgctggtggagcactag

SEQ ID NO: 3509 - DNA, 3297 bp, Artificial Sequence
  Description of Artificial Sequence: Synthetic coding sequence
atgaccctgcaggagctggtgcacaaggccgccagctgctacatggacagagtggccgtgtgcttcgacgagtgcaacaaccagctgcccgtgtactacacctacaagaccgtggtgaacgccgccagcgagctgagcaacttcctgctgctgcactgcgacttccagggcatcagagagatcggcctgtactgccagcccggcatcgacctgcccagctggatcctgggcatcctgcaggtgcccgccgcctacgtgcccatcgagcccgacagcccccccagcctgagcacccacttcatgaagaagtgcaacctgaagtacatcctggtggagaagaagcagatcaacaagttcaagagcttccacgagaccctgctgaactacgacaccttcaccgtggagcacaacgacctggtgctgttcagactgcactggaagaacaccgaggtgaacctgatgctgaacgacggcaaggagaagtacgagaaggagaagatcaagagcatcagcagcgagcacgtgaacgaggagaaggccgaggagcacatggacctgagactgaagcactgcctggcctacgtgctgcacaccagcggcaccaccggcatccccaagatcgtgagagtgccccacaagtgcatcgtgcccaacatccagcacttcagagtgctgttcgacatcacccaggaggacgtgctgttcctggccagccccctgaccttcgaccccagcgtggtggagatcttcctggccctgagcagcggcgccagcctgctgatcgtgcccaccagcgtgaagctgctgcccagcaagctggccagcgtgctgttcagccaccacagagtgaccgtgctgcaggccacccccaccctgctgagaagattcggcagccagctgatcaagagcaccgtgctgagcgccaccaccagcctgagagtgctggccctgggcggcgaggccttccccagcctgaccgtgctgagaagctggagaggcgagggcaacaagacccagatcttcaacgtgtacggcatcaccgaggtgagcagctgggccaccatctacagaatccccgagaagaccctgaacagcaccctgaagtgcgagctgcccgtgcagctgggcttccccctgctgggcaccgtggtggaggtgagagacaccaacggcttcaccatccaggagggcagcggccaggtgttcctgggcggcagaaacagagtgtgcttcctggacgacgaggtgaccgtgcccctgggcaccatgagagccaccggcgacttcgtgaccgtgaaggacggcgagatcttcttcctgggcagaaaggacagccagatcaagagacacggcaagagactgaacatcgagctggtgcagcaggtggccgaggagctgcagcaggtggagagctgcgccgtgacctggtacaaccaggagaagctgatcctgttcatggtgagcaaggacgccagcgtgaaggagtacatcttcaaggagctgcagaagtacctgcccagccacgccgtgcccgacgagctggtgctgatcgacagcctgcccttcaccagccacggcaagatcgacgtgagcgagctgaacaagatctacctgaactacatcaacctgaagagcgagaacaagctgagcggcaaggaggacctgtgggagaagctgcagtacctgtggaagagcaccctgaacctgcccgaggacctgctgagagtgcccgacgagagcctgttcctgaacagcggcggcgacagcctgaagagcatcagactgctgagcgagatcgagaagctggtgggcaccagcgtgcccggcctgctggagatcatcctgagcagcagcatcctggagatctacaaccacatcctgcagaccgtggtgcccgacgaggacgtgaccttcagaaagagctgcgccaccaagagaaagctgagcgacatcaaccaggaggaggccagcggcaccagcctgcaccagaaggccatcatgaccttcacctgccacaacgagatcaacgccttcgtggtgctgagcagaggcagccagatcctgagcctgaacagcaccagattcctgaccaagctgggccactgcagcagcgcctgccccagcgacagcgtgagccagaccaacatccagaacctgaagggcctgaacagccccgtgctgatcggcaagagcaaggaccccagctgcgtggccaaggtgagcgaggagggcaagcccgccatcggcacccagaagatggagctgcacgtgagatggagaagcgacaccggcaagtgcgtggacgccagccccctggtggtgatccccaccttcgacaagagcagcaccaccgtgtacatcggcagccacagccacagaatgaaggccgtggacttctacagcggcaaggtgaagtgggagcagatcctgggcgacagaatcgagagcagcgcctgcgtgagcaagtgcggcaacttcatcgtggtgggctgctacaacggcctggtgtacgtgctgaagagcaacagcggcgagaagtactggatgttcaccaccgaggacgccgtgaagagcagcgccaccatggaccccaccaccggcctgatctacatcggcagccacgaccagcacgcctacgccctggacatctacagaaagaagtgcgtgtggaagagcaagtgcggcggcaccgtgttcagcagcccctgcctgaacctgatcccccaccacctgtacttcgccaccctgggcggcctgctgctggccgtgaaccccgccaccggcaacgtgatctggaagcacagctgcggcaagcccctgttcagcagcccccagtgctgcagccagtacatctgcatcggctgcgtggacggcaacctgctgtgcttcacccacttcggcgagcaggtgtggcagttcagcaccagcggccccatcttcagcagcccctgcaccagccccagcgagcagaagatcttcttcggcagccacgactgcttcatctactgctgcaacatgaagggccacctgcagtggaagttcgagaccaccagcagagtgtacgccacccccttcgccttccacaactacaacggcagcaacgagatgctgctggccgccgccagcaccgacggcaaggtgtggatcctggagagccagagcggccagctgcagagcgtgtacgagctgcccggcgaggtgttcagcagccccgtggtgctggagagcatgctgatcatcggctgcagagacaactacgtgtactgcctggacctgctgggcggcaaccagaagtag

SEQ ID NO: 3510 - DNA, 774 bp, Artificial Sequence
  Description of Artificial Sequence: Synthetic coding sequence
atggccagcaagatcggcagcagaagatggatgctgcagctgatcatgcagctgggcagcgtgctgctgaccagatgccccttctggggctgcttcagccagctgatgctgtacgccgagagagccgaggccagaagaaagcccgacatccccgtgccctacctgtacttcgacatgggcgccgccgtgctgtgcgccagcttcatgagcttcggcgtgaagagaagatggttcgccctgggcgccgccctgcagctggccatcagcacctacgccgcctacatcggcggctacgtgcactacggcgactggctgaaggtgagaatgtacagcagaaccgtggccatcatcggcggcttcctggtgctggccagcggcgccggcgagctgtacagaagaaagcccagaagcagaagcctgcagagcaccggccaggtgttcctgggcatctacctgatctgcgtggcctacagcctgcagcacagcaaggaggacagactggcctacctgaaccacctgcccggcggcgagctgatgatccagctgttcttcgtgctgtacggcatcctggccctggccttcctgagcggctactacgtgaccctggccgcccagatcctggccgtgctgctgccccccgtgatgctgctgatcgacggcaacgtggcctactggcacaacaccagaagagtggagttctggaaccagatgaagctgctgggcgagagcgtgggcatcttcggcaccgccgtgatcctggccaccgacggctag

SEQ ID NO: 3511 - DNA, 2118 bp, Artificial Sequence
  Description of Artificial Sequence: Synthetic coding sequence
atggagaagcccagaagcatcgaggagacccccagcagcgagcccatggaggaggaggaggacgacgacctggagctgttcggcggctacgacagcttcagaagctacaacagcagcgtgggcagcgagagcagcagctacctggaggagagcagcgaggccgagaacgaggacagagaggccggcgagctgcccaccagccccctgcacctgctgagccccggcacccccagaagcctggacggcagcggcagcgagcccgccgtgtgcgagatgtgcggcatcgtgggcaccagagaggccttcttcagcaagaccaagagattctgcagcgtgagctgcagcagaagctacagcagcaacagcaagaaggccagcatcctggccagactgcagggcaagccccccaccaagaaggccaaggtgctgcacaaggccgcctggagcgccaagatcggcgccttcctgcacagccagggcaccggccagctggccgacggcacccccaccggccaggacgccctggtgctgggcttcgactggggcaagttcctgaaggaccacagctacaaggccgcccccgtgagctgcttcaagcacgtgcccctgtacgaccagtgggaggacgtgatgaagggcatgaaggtggaggtgctgaacagcgacgccgtgctgcccagcagagtgtactggatcgccagcgtgatccagaccgccggctacagagtgctgctgagatacgagggcttcgagaacgacgccagccacgacttctggtgcaacctgggcaccgtggacgtgcaccccatcggctggtgcgccatcaacagcaagatcctggtgccccccagaaccatccacgccaagttcaccgactggaagggctacctgatgaagagactggtgggcagcagaaccctgcccgtggacttccacatcaagatggtggagagcatgaagtaccccttcagacagggcatgagactggaggtggtggacaagagccaggtgagcagaaccagaatggccgtggtggacaccgtgatcggcggcagactgagactgctgtacgaggacggcgacagcgacgacgacttctggtgccacatgtggagccccctgatccaccccgtgggctggagcagaagagtgggccacggcatcaagatgagcgagagaagaagcgacatggcccaccaccccaccttcagaaagatctactgcgacgccgtgccctacctgttcaagaaggtgagagccgtgtacaccgagggcggctggttcgaggagggcatgaagctggaggccatcgaccccctgaacctgggcaacatctgcgtggccaccgtgtgcaaggtgctgctggacggctacctgatgatctgcgtggacggcggccccagcaccgacggcctggactggttctgctaccacgccagcagccacgccatcttccccgccaccttctgccagaagaacgacatcgagctgaccccccccaagggctacgaggcccagaccttcaactgggagaactacctggagaagaccaagagcaaggccgcccccagcagactgttcaacatggactgccccaaccacggcttcaaggtgggcatgaagctggaggccgtggacctgatggagcccagactgatctgcgtggccaccgtgaagagagtggtgcacagactgctgagcatccacttcgacggctgggacagcgagtacgaccagtgggtggactgcgagagccccgacatctaccccgtgggctggtgcgagctgaccggctaccagctgcagccccccgtggccgccgagcccgccacccccctgaaggccaaggaggccaccaagaagaagaagaagcagttcggcaagaagagaaagagaatcccccccaccaagaccagacccctgagacagggcagcaagaagcccctgctggaggacgacccccagggcgccagaaagatcagcagcgagcccgtgcccggcgagatcatcgccgtgagagtgaaggaggagcacctggacgtggccagccccgacaaggccagcagccccgagctgcccgtgagcgtggagaacatcaagcaggagaccgacgactag

SEQ ID NO: 3512 - DNA, 2103 bp, Artificial Sequence
  Description of Artificial Sequence: Synthetic coding sequence
atgagcagaagaaccagatgcgaggacctggacgagctgcactaccaggacaccgacagcgacgtgcccgagcagagagacagcaagtgcaaggtgaagtggacccacgaggaggacgagcagctgagagccctggtgagacagttcggccagcaggactggaagttcctggccagccacttccccaacagaaccgaccagcagtgccagtacagatggctgagagtgctgaaccccgacctggtgaagggcccctggaccaaggaggaggaccagaaggtgatcgagctggtgaagaagtacggcaccaagcagtggaccctgatcgccaagcacctgaagggcagactgggcaagcagtgcagagagagatggcacaaccacctgaaccccgaggtgaagaagagctgctggaccgaggaggaggacagaatcatctgcgaggcccacaaggtgctgggcaacagatgggccgagatcgccaagatgctgcccggcagaaccgacaacgccgtgaagaaccactggaacagcaccatcaagagaaaggtggacaccggcggcttcctgagcgagagcaaggactgcaagccccccgtgtacctgctgctggagctggaggacaaggacggcctgcagagcgcccagcccaccgagggccagggcagcctgctgaccaactggcccagcgtgccccccaccatcaaggaggaggagaacagcgaggaggagctggccgccgccaccaccagcaaggagcaggagcccatcggcaccgacctggacgccgtgagaacccccgagcccctggaggagttccccaagagagaggaccaggagggcagcccccccgagaccagcctgccctacaagtgggtggtggaggccgccaacctgctgatccccgccgtgggcagcagcctgagcgaggccctggacctgatcgagagcgaccccgacgcctggtgcgacctgagcaagttcgacctgcccgaggagcccagcgccgaggacagcatcaacaacagcctggtgcagctgcaggccagccaccagcagcaggtgctgccccccagacagcccagcgccctggtgcccagcgtgaccgagtacagactggacggccacaccatcagcgacctgagcagaagcagcagaggcgagctgatccccatcagccccagcaccgaggtgggcggcagcggcatcggcaccccccccagcgtgctgaagagacagagaaagagaagagtggccctgagccccgtgaccgagaacagcaccagcctgagcttcctggacagctgcaacagcctgacccccaagagcacccccgtgaagaccctgcccttcagccccagccagttcctgaacttctggaacaagcaggacaccctggagctggagagccccagcctgaccagcacccccgtgtgcagccagaaggtggtggtgaccacccccctgcacagagacaagacccccctgcaccagaagcacgccgccttcgtgacccccgaccagaagtacagcatggacaacaccccccacacccccacccccttcaagaacgccctggagaagtacggccccctgaagcccctgccccagaccccccacctggaggaggacctgaaggaggtgctgagaagcgaggccggcatcgagctgatcatcgaggacgacatcagacccgagaagcagaagagaaagcccggcctgagaagaagccccatcaagaaggtgagaaagagcctggccctggacatcgtggacgaggacgtgaagctgatgatgagcaccctgcccaagagcctgagcctgcccaccaccgcccccagcaacagcagcagcctgaccctgagcggcatcaaggaggacaacagcctgctgaaccagggcttcctgcaggccaagcccgagaaggccgccgtggcccagaagcccagaagccacttcaccacccccgcccccatgagcagcgcctggaagaccgtggcctgcggcggcaccagagaccagctgttcatgcaggagaaggccagacagctgctgggcagactgaagcccagccacaccagcagaaccctgatcctgagctag

SEQ ID NO: 3513 - DNA, 528 bp, Artificial Sequence
  Description of Artificial Sequence: Synthetic coding sequence
atgctgagaaccgaggtgcccagactgcccagaagcaccaccgccatcgtgtggagctgccacctgatggccaccgccagcgccatggccggccccagcagcgagaccaccagcgaggagcagctgatcacccaggagcccaaggaggccaacagcaccaccagccagaagcagagcaagcagagaaagagaggcagacacggccccagaagatgccacagcaactgcagaggcgacagcttcgccacctacttcagaagagtgctgaagcaggtgcaccagggcctgagcctgagcagagaggccgtgagcgtgatggacagcctggtgcacgacatcctggacagaatcgccaccgaggccggcagactggccagaagcaccaagagacagaccatcaccgcctgggagaccagaatggccgtgagactgctgctgcccggccagatgggcaagctggccgagagcgagggcaccaaggccgtgctgagaaccagcctgtacgccatccagcagcagagaaagtag

SEQ ID NO: 3514 - DNA, 624 bp, Artificial Sequence
  Description of Artificial Sequence: Synthetic coding sequence
atggcccccttcgagcccctggccagcggcatcctgctgctgctgtggctgatcgcccccagcagagcctgcacctgcgtgcccccccacccccagaccgccttctgcaacagcgacctggtgatcagagccaagttcgtgggcacccccgaggtgaaccagaccaccctgtaccagagatacgagatcaagatgaccaagatgtacaagggcttccaggccctgggcgacgccgccgacatcagattcgtgtacacccccgccatggagagcgtgtgcggctacttccacagaagccacaacagaagcgaggagttcctgatcgccggcaagctgcaggacggcctgctgcacatcaccacctgcagcttcgtggccccctggaacagcctgagcctggcccagagaagaggcttcaccaagacctacaccgtgggctgcgaggagtgcaccgtgttcccctgcctgagcatcccctgcaagctgcagagcggcacccactgcctgtggaccgaccagctgctgcagggcagcgagaagggcttccagagcagacacctggcctgcctgcccagagagcccggcctgtgcacctggcagagcctgagaagccagatcgcctag

SEQ ID NO: 3515 - DNA, 1686 bp, Artificial Sequence
  Description of Artificial Sequence: Synthetic coding sequence
atggccgaccacaaccccgacagcgacagcacccccagaaccctgctgagaagagtgctggacaccgccgaccccagaacccccagaagacccagaagcgccagagccggcgccagaagagccctgctggagaccgccagccccagaaagctgagcggccagaccagaaccatcgccagaggcagaagccacggcgccagaagcgtgggcagaagcgcccacatccaggccagcggccacctggaggagcagacccccagaaccctgctgaagaacatcctgctgaccgcccccgagagcagcatcctgatgcccgagagcgtggtgaagcccgtgcccgccccccaggccgtgcagcccagcagacaggagagcagctgcggcagcctggagctgcagctgcccgagctggagccccccaccaccctggcccccggcctgctggcccccggcagaagaaagcagagactgagactgagcgtgttccagcagggcgtggaccagggcctgagcctgagccaggagccccagggcaacgccgacgccagcagcctgaccagaagcctgaacctgaccttcgccacccccctgcagccccagagcgtgcagagacccggcctggccagaagaccccccgccagaagagccgtggacgtgggcgccttcctgagagacctgagagacaccagcctggccccccccaacatcgtgctggaggacacccagcccttcagccagcccatggtgggcagccccaacgtgtaccacagcctgccctgcaccccccacaccggcgccgaggacgccgagcaggccgccggcagaaagacccagagcagcggccccggcctgcagaagaacagccccggcaagcccgcccagttcctggccggcgaggccgaggaggtgaacgccttcgccctgggcttcctgagcaccagcagcggcgtgagcggcgaggacgaggtggagcccctgcacgacggcgtggaggaggccgagaagaagatggaggaggagggcgtgagcgtgagcgagatggaggccaccggcgcccagggccccagcagagtggaggaggccgagggccacaccgaggtgaccgaggccgagggcagccagggcaccgccgaggccgacggccccggcgccagcagcggcgacgaggacgccagcggcagagccgccagccccgagagcgccagcagcacccccgagagcctgcaggccagaagacaccaccagttcctggagcccgcccccgcccccggcgccgccgtgctgagcagcgagcccgccgagcccctgctggtgagacacccccccagacccagaaccaccggccccagacccagacaggacccccacaaggccggcctgagccactacgtgaagctgttcagcttctacgccaagatgcccatggagagaaaggccctggagatggtggagaagtgcctggacaagtacttccagcacctgtgcgacgacctggaggtgttcgccgcccacgccggcagaaagaccgtgaagcccgaggacctggagctgctgatgagaagacagggcctggtgaccgaccaggtgagcctgcacgtgctggtggagagacacctgcccctggagtacagacagctgctgatcccctgcgcctacagcggcaacagcgtgttccccgcccagtag

SEQ ID NO: 3516 - DNA, 1134 bp, Artificial Sequence
  Description of Artificial Sequence: Synthetic coding sequence
atgaccgacgacgagagcgagagcgtgctgagcgacagccacgagggcagcgagctggagctgcccgtgatccagctgtgcggcctggtggaggagctgagctacgtgaacagcgccctgaagaccgagaccgagatgttcgagaagtactacgccaagctggagcccagagaccagagaccccccagactgagcgagatcaagatcagcgccgccgactacgcccagttcagaggcagaagaagaagcaagagcagaaccggcatggacagaggcgtgggcctgaccgccgaccagaagctggagctggtgcagaaggaggtggccgacatgaaggacgacctgagacacaccagagccaacgccgagagagacctgcagcaccacgaggccatcatcgaggaggccgagatcagatggagcgaggtgagcagagaggtgcacgagttcgagaaggacatcctgaaggccatcagcaagaagaagggcagcatcctggccacccagaaggtgatgaagtacatcgaggacatgaacagaagaagagacaacatgaaggagaagctgagactgaagaacgtgagcctgaaggtgcagagaaagaagatgctgctgcagctgagacagaaggaggaggtgagcgaggccctgcacgacgtggacttccagcagctgaagatcgagaacgcccagttcctggagaccatcgaggccagaaaccaggagctgacccagctgaagctgagcagcggcaacaccctgcaggtgctgaacgcctacaagagcaagctgcacaaggccatggagatctacctgaacctggacaaggagatcctgctgagaaaggagctgctggagaagatcgagaaggagaccctgcaggtggaggaggacagagccaaggccgaggccgtgaacaagagactgagaaagcagctggccgagttcagagccccccaggtgatgacctacgtgagagagaagatcctgaacgccgacctggagaagagcatcagaatgtgggagagaaaggtggagatcgccgagatgagcctgaagggccacagaaaggcctggaacagaatgaagatcaccaacgagcagctgcaggccgactacctggccggcaagtag

SEQ ID NO: 3517 - DNA, 1548 bp, Artificial Sequence
  Description of Artificial Sequence: Synthetic coding sequence
atggaggccagagagcccggcagacccacccccacctaccacctggtgcccaacaccagccagagccaggtggaggaggacgtgagcagccccccccagagaagcagcgagaccatgcagctgaagaaggagatcagcctgctgaacggcgtgagcctggtggtgggcaacatgatcggcagcggcatcttcgtgagccccaagggcgtgctggtgcacaccgccagctacggcatgagcctgatcgtgtgggccatcggcggcctgttcagcgtggtgggcgccctgtgctacgccgagctgggcaccaccatcaccaagagcggcgccagctacgcctacatcctggaggccttcggcggcttcatcgccttcatcagactgtgggtgagcctgctggtggtggagcccaccggccaggccatcatcgccatcaccttcgccaactacatcatccagcccagcttccccagctgcgaccccccctacctggcctgcagactgctggccgccgcctgcatctgcctgctgaccttcgtgaactgcgcctacgtgaagtggggcaccagagtgcaggacaccttcacctacgccaaggtggtggccctgatcgccatcatcgtgatgggcctggtgaagctgtgccagggccacagcgagcacttccaggacgccttcgagggcagcagctgggacatgggcaacctgagcctggccctgtacagcgccctgttcagctacagcggctgggacaccctgaacttcgtgaccgaggagatcaagaaccccgagagaaacctgcccctggccatcggcatcagcatgcccatcgtgaccctgatctacatcctgaccaacgtggcctactacaccgtgctgaacatcagcgacgtgctgagcagcgacgccgtggccgtgaccttcgccgaccagaccttcggcatgttcagctggaccatccccatcgccgtggccctgagctgcttcggcggcctgaacgccagcatcttcgccagcagcagactgttcttcgtgggcagcagagagggccacctgcccgacctgctgagcatgatccacatcgagagattcacccccatccccgccctgctgttcaactgcaccatggccctgatctacctgatcgtggaggacgtgttccagctgatcaactacttcagcttcagctactggttcttcgtgggcctgagcgtggtgggccagctgtacctgagatggaaggagcccaagagacccagacccctgaagctgagcgtgttcttccccatcgtgttctgcatctgcagcgtgttcctggtgatcgtgcccctgttcaccgacaccatcaacagcctgatcggcatcggcatcgccctgagcggcgtgcccttctacttcatgggcgtgtacctgcccgagagcagaagacccctgttcatcagaaacgtgctggccgccatcaccagaggcacccagcagctgtgcttctgcgtgctgaccgagctggacgtggccgaggagaagaaggacgagagaaagaccgactag

SEQ ID NO: 3518 - DNA, 1623 bp, Artificial Sequence
  Description of Artificial Sequence: Synthetic coding sequence
atgaacggcgaggccatctgcagcgccctgcccaccatcccctaccacaagctggccgacctgagatacctgagcagaggcgccagcggcaccgtgagcagcgccagacacgccgactggagagtgcaggtggccgtgaagcacctgcacatccacacccccctgctggacagcgagagaaaggacgtgctgagagaggccgagatcctgcacaaggccagattcagctacatcctgcccatcctgggcatctgcaacgagcccgagttcctgggcatcgtgaccgagtacatgcccaacggcagcctgaacgagctgctgcacagaaagaccgagtaccccgacgtggcctggcccctgagattcagaatcctgcacgagatcgccctgggcgtgaactacctgcacaacatgaccccccccctgctgcaccacgacctgaagacccagaacatcctgctggacaacgagttccacgtgaagatcgccgacttcggcctgagcaagtggagaatgatgagcctgagccagagcagaagcagcaagagcgcccccgagggcggcaccatcatctacatgccccccgagaactacgagcccggccagaagagcagagccagcatcaagcacgacatctacagctacgccgtgatcacctgggaggtgctgagcagaaagcagcccttcgaggacgtgaccaaccccctgcagatcatgtacagcgtgagccagggccacagacccgtgatcaacgaggagagcctgccctacgacatcccccacagagccagaatgatcagcctgatcgagagcggctgggcccagaaccccgacgagagacccagcttcctgaagtgcctgatcgagctggagcccgtgctgagaaccttcgaggagatcaccttcctggaggccgtgatccagctgaagaagaccaagctgcagagcgtgagcagcgccatccacctgtgcgacaagaagaagatggagctgagcctgaacatccccgtgaaccacggcccccaggaggagagctgcggcagcagccagctgcacgagaacagcggcagccccgagaccagcagaagcctgcccgccccccaggacaacgacttcctgagcagaaaggcccaggactgctacttcatgaagctgcaccactgccccggcaaccacagctgggacagcaccatcagcggcagccagagagccgccttctgcgaccacaagaccaccccctgcagcagcgccatcatcaaccccctgagcaccgccggcaacagcgagagactgcagcccggcatcgcccagcagtggatccagagcaagagagaggacatcgtgaaccagatgaccgaggcctgcctgaaccagagcctggacgccctgctgagcagagacctgatcatgaaggaggactacgagctggtgagcaccaagcccaccagaaccagcaaggtgagacagctgctggacaccaccgacatccagggcgaggagttcgccaaggtgatcgtgcagaagctgaaggacaacaagcagatgggcctgcagccctaccccgagatcctggtggtgagcagaagccccagcctgaacctgctgcagaacaagagcatgtag

SEQ ID NO: 3519 - DNA, 2079 bp, Artificial Sequence
  Description of Artificial Sequence: Synthetic coding sequence
atgagagcctgcgccggcagcaccagagaggccggcagcggcgcccaggacctgagcaccctgctgtgcctggaggagagcatggaggagcaggacgagaagccccccgagccccccaaggcctgcgcccaggacagcttcctgccccaggagatcatcatcaaggtggagggcgaggacaccggcagcctgaccatccccagccaggagggcgtgaacttcaagatcgtgaccgtggacttcaccagagaggagcagggcacctggaaccccgcccagagaaccctggacagagacgtgatcctggagaaccacagagacctggtgagctgggacctggccaccgccgtgggcaagaaggacagcaccagcaagcagagaatcttcgacgaggagcccgccaacggcgtgaagatcgagagattcaccagagacgacccctggctgagcagctgcgaggaggtggacgactgcaaggaccagctggagaagcagcaggagaagcaggagatcctgctgcaggaggtggccttcacccagagaaaggccgtgatccacgagagagtgtgcaagagcgacgagaccggcgagaagagcggcctgaacagcagcctgttcagcagccccgtgatccccatcagaaaccacttccacaagcacgtgagccacgccaagaagtggcacctgaacgccgccgtgaacagccaccagaagatcaacgagaacgagaccctgtacgagaacaacgagtgcggcaagcccccccagagcatccacctgatccagttcaccagaacccagaccaaggacaagtgctacggcttcagcgacagaatccagagcttctgccacggcacccccctgcacatccacgagaagatccacggcggcggcaagaccttcgacttcaaggagtgcggccaggtgctgaaccccaagatcagccacaacgagcagcagagaatccccttcgaggagagccagtacaagtgcagcgagaccagccacagcagcagcctgacccagaacatgagaaacaacagcgaggagaagcccttcgagtgcaaccagtgcggcaagagcttcagctggagcagccacctggtggcccaccagagaacccacaccggcgagaagccctacgagtgcagcgagtgcggcaagagcttcagcagaagcagccacctggtgagccaccagagaacccacaccggcgagaagccctacagatgcaaccagtgcggcaagagcttcagccagagctacgtgctggtggtgcaccagagaacccacaccggcgagaagccctacgagtgcaaccagtgcggcaagagcttcagacagagctacaagctgatcgcccaccagagaacccacaccggcgagaagccctacgagtgcaaccagtgcggcaagagcttcatccagagctacaagctgatcgcccaccagagaatccacaccggcgagaagccctacgagtgcaaccagtgcggcaagagcttcagccagagctacaagctggtggcccaccagagaacccacaccggcgagaagcccttcgagtgcaaccagtgcggcaagagcttcagctggagcagccagctggtggcccaccagagaacccacaccggcgagaagccctacgagtgcagcgagtgcggcaagagcttcaacagaagcagccacctggtgatgcaccagagaatccacaccggcgagaagccctacgagtgcaaccagtgcggcaagagcttcagccagagctacgtgctggtggtgcaccagagaacccacaccggcgagaagccctacgagtgcagccagtgcggcaagagcttcagacagagcagctgcctgacccagcaccagagaacccacaccggcgagaagcccttcgagtgcaaccagtgcggcaagaccttcagcctgagcgccagactgatcgtgcaccagagaacccacaccggcgagaagcccttcacctgcatccagtgcggcaaggccttcatcaacagctacaagctgatcagacaccaggccacccacaccgaggagaagctgtacgagtgcaactag

SEQ ID NO: 3520 - DNA, 942 bp, Artificial Sequence
  Description of Artificial Sequence: Synthetic coding sequence
atggacaacaagaagagactggcctacgccatcatccagttcctgcacgaccagctgagacacggcggcctgagcagcgacgcccaggagagcctggaggtggccatccagtgcctggagaccgccttcggcgtgaccgtggaggacagcgacctggccctgccccagaccctgcccgagatcttcgaggccgccgccaccggcaaggagatgccccaggacctgagaagccccgccagaaccccccccagcgaggaggacagcgccgaggccgagagactgaagaccgagggcaacgagcagatgaaggtggagaacttcgaggccgccgtgcacttctacggcaaggccatcgagctgaaccccgccaacgccgtgtacttctgcaacagagccgccgcctacagcaagctgggcaactacgccggcgccgtgcaggactgcgagagagccatctgcatcgaccccgcctacagcaaggcctacggcagaatgggcctggccctgagcagcctgaacaagcacgtggaggccgtggcctactacaagaaggccctggagctggaccccgacaacgagacctacaagagcaacctgaagatcgccgagctgaagctgagagaggcccccagccccaccggcggcgtgggcagcttcgacatcgccggcctgctgaacaaccccggcttcatgagcatggccagcaacctgatgaacaacccccagatccagcagctgatgagcggcatgatcagcggcggcaacaaccccctgggcacccccggcaccagccccagccagaacgacctggccagcctgatccaggccggccagcagttcgcccagcagatgcagcagcagaaccccgagctgatcgagcagctgagaagccagatcagaagcagaacccccagcgccagcaacgacgaccagcaggagtag

SEQ ID NO: 3521 - DNA, 1584 bp, Artificial Sequence
  Description of Artificial Sequence: Synthetic coding sequence
atgtaccagcccgaggacgacaacaacagcgacgtgaccagcgacgacgacatgaccagaaacagaagagagagcagccccccccacagcgtgcacagcttcagcggcgacagagactgggacagaagaggcagaagcagagacatggagcccagagacagatggagccacaccagaaaccccagaagcagaatgccccccagagacctgagcctgcccgtggtggccaagaccagcttcgagatggacagagaggacgacagagacagcagagcctacgagagcagaagccaggacgccgagagctaccagaacgtggtggacctggccgaggacagaaagccccacaacaccatccaggacaacatggagaactacagaaagctgctgagcctgggcttcctggcccaggacagcgtgcccgccgagaagagaaacaccgagatgctggacaacctgcccagcgccggcagccagttccccgacttcaagcacctgggcaccttcctggtgttcgaggagctggtgaccttcgaggacgtgctggtggacttcagccccgaggagctgagcagcctgagcgccgcccagagaaacctgtacagagaggtgatgctggagaactacagaaacctggtgagcctgggccaccagttcagcaagcccgacatcatcagcagactggaggaggaggagagctacgccatggagaccgacagcagacacaccgtgatctgccagggcgagagccacgacgaccccctggagccccaccagggcaaccaggagaagctgctgacccccatcaccatgaacgaccccaagaccctgacccccgagagaagctacggcagcgacgagttcgagagaagcagcaacctgagcaagcagagcaaggaccccctgggcaaggacccccaggagggcaccgcccccggcatctgcaccagcccccagagcgccagccaggagaacaagcacaacagatgcgagttctgcaagagaaccttcagcacccaggtggccctgagaagacacgagagaatccacaccggcaagaagccctacgagtgcaagcagtgcgccgaggccttctacctgatgccccacctgaacagacaccagaagacccacagcggcagaaagaccagcggctgcaacgagggcagaaagcccagcgtgcagtgcgccaacctgtgcgagagagtgagaatccacagccaggaggactacttcgagtgcttccagtgcggcaaggccttcctgcagaacgtgcacctgctgcagcacctgaaggcccacgaggccgccagagtgctgccccccggcctgagccacagcaagacctacctgatcagataccagagaaagcacgactacgtgggcgagagagcctgccagtgctgcgactgcggcagagtgttcagcagaaacagctacctgatccagcactacagaacccacacccaggagagaccctaccagtgccagctgtgcggcaagtgcttcggcagacccagctacctgacccagcactaccagctgcacagccaggagaagaccgtggagtgcgaccactgctag

SEQ ID NO: 3522 - DNA, 444 bp, Artificial Sequence
  Description of Artificial Sequence: Synthetic coding sequence
atggccctgaagagaatccagaaggagctgaccgacctgcagagagacccccccgcccagtgcagcgccggccccgtgggcgacgacctgttccactggcaggccaccatcatgggccccaacgacagcccctaccagggcggcgtgttcttcctgaccatccacttccccaccgactaccccttcaagccccccaaggtggccttcaccaccaagatctaccaccccaacatcaacagcaacggcagcatctgcctggacatcctgagaagccagtggagccccgccctgaccgtgagcaaggtgctgctgagcatctgcagcctgctgtgcgaccccaaccccgacgaccccctggtgcccgagatcgcccacacctacaaggccgacagagagaagtacaacagactggccagagagtggacccagaagtacgccatgtag

SEQ ID NO: 3523 - DNA, 3072 bp, Artificial Sequence
  Description of Artificial Sequence: Synthetic coding sequence
atgttccacctgagaacctgcgccgccaagctgagacccctgaccgccagccagaccgtgaagaccttcagccagaacagacccgccgccgccagaaccttccagcagatcagatgctacagcgcccccgtggccgccgagcccttcctgagcggcaccagcagcaactacgtggaggagatgtactgcgcctggctggagaaccccaagagcgtgcacaagagctgggacatcttcttcagaaacaccaacgccggcgccccccccggcaccgcctaccagagccccctgcccctgagcagaggcagcctggccgccgtggcccacgcccagagcctggtggaggcccagcccaacgtggacaagctggtggaggaccacctggccgtgcagagcctgatcagagcctaccagatcagaggccaccacgtggcccagctggaccccctgggcatcctggacgccgacctggacagcagcgtgcccgccgacatcatcagcagcaccgacaagctgggcttctacggcctggacgagagcgacctggacaaggtgttccacctgcccaccaccaccttcatcggcggccaggagagcgccctgcccctgagagagatcatcagaagactggagatggcctactgccagcacatcggcgtggagttcatgttcatcaacgacctggagcagtgccagtggatcagacagaagttcgagacccccggcatcatgcagttcaccaacgaggagaagagaaccctgctggccagactggtgagaagcaccagattcgaggagttcctgcagagaaagtggagcagcgagaagagattcggcctggagggctgcgaggtgctgatccccgccctgaagaccatcatcgacaagagcagcgagaacggcgtggactacgtgatcatgggcatgccccacagaggcagactgaacgtgctggccaacgtgatcagaaaggagctggagcagatcttctgccagttcgacagcaagctggaggccgccgacgagggcagcggcgacgtgaagtaccacctgggcatgtaccacagaagaatcaacagagtgaccgacagaaacatcaccctgagcctggtggccaaccccagccacctggaggccgccgaccccgtggtgatgggcaagaccaaggccgagcagttctactgcggcgacaccgagggcaagaaggtgatgagcatcctgctgcacggcgacgccgccttcgccggccagggcatcgtgtacgagaccttccacctgagcgacctgcccagctacaccacccacggcaccgtgcacgtggtggtgaacaaccagatcggcttcaccaccgaccccagaatggccagaagcagcccctaccccaccgacgtggccagagtggtgaacgcccccatcttccacgtgaacagcgacgaccccgaggccgtgatgtacgtgtgcaaggtggccgccgagtggagaagcaccttccacaaggacgtggtggtggacctggtgtgctacagaagaaacggccacaacgagatggacgagcccatgttcacccagcccctgatgtacaagcagatcagaaagcagaagcccgtgctgcagaagtacgccgagctgctggtgagccagggcgtggtgaaccagcccgagtacgaggaggagatcagcaagtacgacaagatctgcgaggaggccttcgccagaagcaaggacgagaagatcctgcacatcaagcactggctggacagcccctggcccggcttcttcaccctggacggccagcccagaagcatgagctgccccagcaccggcctgaccgaggacatcctgacccacatcggcaacgtggccagcagcgtgcccgtggagaacttcaccatccacggcggcctgagcagaatcctgaagaccagaggcgagatggtgaagaacagaaccgtggactgggccctggccgagtacatggccttcggcagcctgctgaaggagggcatccacatcagactgagcggccaggacgtggagagaggcaccttcagccacagacaccacgtgctgcacgaccagaacgtggacaagagaacctgcatccccatgaaccacctgtggcccaaccaggccccctacaccgtgtgcaacagcagcctgagcgagtacggcgtgctgggcttcgagctgggcttcgccatggccagccccaacgccctggtgctgtgggaggcccagttcggcgacttccacaacaccgcccagtgcatcatcgaccagttcatctgccccggccaggccaagtgggtgagacagaacggcatcgtgctgctgctgccccacggcatggagggcatgggccccgagcacagcagcgccagacccgagagattcctgcagatgtgcaacgacgaccccgacgtgctgcccgacctgaaggaggccaacttcgacatcaaccagctgtacgactgcaactgggtggtggtgaactgcagcacccccggcaacttcttccacgtgctgagaagacagatcctgctgcccttcagaaagcccctgatcatcttcacccccaagagcctgctgagacaccccgaggccagaagcagcttcgacgagatgctgcccggcacccacttccagagagtgatccccgaggacggccccgccgcccagaaccccgagaacgtgaagagactgctgttctgcaccggcaaggtgtactacgacctgaccagagagagaaaggccagagacatggtgggccaggtggccatcaccagaatcgagcagctgagccccttccccttcgacctgctgctgaaggaggtgcagaagtaccccaacgccgagctggcctggtgccaggaggagcacaagaaccagggctactacgactacgtgaagcccagactgagaaccaccatcagcagagccaagcccgtgtggtacgccggcagagaccccgccgccgcccccgccaccggcaacaagaagacccacctgaccgagctgcagagactgctggacaccgccttcgacctggacgtgttcaagaacttcagctag

SEQ ID NO: 3524 - DNA, 2667 bp, Artificial Sequence
  Description of Artificial Sequence: Synthetic coding sequence
atggagggcgacgactgcgagttcagatacggcgacggcaccaacgaggcccaggacaacgacttccccaccgtggagagaagcagactgcaggagatgctgagcctgctgggcctggagacctaccaggtgcagaagctgagcctgcaggacagcctgcagatcagcttcgacagcatgaagaactgggccccccaggtgcccaaggacctgccctggaacttcctgagaaagctgcaggccctgaacgccgacgccagaaacaccaccatggtgctggacgtgctgcccgacgccagacccgtggagaaggagagccagatggaggaggagatcatctactgggaccccgccgacgacctggccgccgacatctacagcttcagcgagctgcccacccccgacacccccgtgaaccccctggacctgctgtgcgccctgctgctgagcagcgacagcttcctgcagcaggagatcgccctgaagatggccctgtgccagttcgccctgcccctggtgctgcccgacagcgagaaccactaccacaccttcctgctgtgggccatgagaggcatcgtgagaacctggtggagccagccccccagaggcatgggcagcttcagagaggacagcgtggtgctgagcagagcccccgccttcgccttcgtgagaatggacgtgagcagcaacagcaagagccagctgctgaacgccgtgctgagccccggccacagacagtgggactgcttctggcacagagacctgaacctgggcaccaacgccagagagatcagcgacggcctggtggagatcagctggttcttccccagcggcagagaggacctggacatcttccccgagcccgtggccttcctgaacctgagaggcgacatcggcagccactggctgcagttcaagctgctgaccgagatcagcagcgccgtgttcatcctgaccgacaacatcagcaagaaggagtacaagctgctgtacagcatgaaggagagcaccaccaagtactacttcatcctgagcccctacagaggcaagagaaacaccaacctgagattcctgaacaagctgatccccgtgctgaagatcgaccacagccacgtgctggtgaaggtgagcagcaccgacagcgacagcttcgtgaagagaatcagagccatcgtgggcaacgtgctgagagccccctgcagaagagtgagcgtggaggacatggcccacgccgccagaaagctgggcctgaaggtggacgaggactgcgaggagtgccagaaggccaaggacagaatggagagaatcaccagaaagatcaaggacagcgacgcctacagaagagacgagctgagactgcagggcgacccctggagaaaggccgcccaggtggagaaggagttctgccagctgcagtgggccgtggacccccccgagaagcacagagccgagctgagaagaagactgctggagctgagaatgcagcagaacggccacgaccccagcagcggcgtgcaggagttcatcagcggcatcagcagccccagcctgagcgagaagcagtacttcctgagatggatggagtggggcctggccagagtggcccagcccagactgagacagccccccgagaccctgctgaccctgagacccaagcacggcggcaccaccgacgtgggcgagcccctgtggcccgagcccctgggcgtggagcacttcctgagagagatgggccagttctacgaggccgagagctgcctggtggaggccggcagactgcccgccggccagagaagattcgcccacttccccggcctggccagcgagctgctgctgaccggcctgcccctggagctgatcgacggcagcaccctgagcatgcccgtgagatgggtgaccggcctgctgaaggagctgcacgtgagactggagagaagaagcagactggtggtgctgagcaccgtgggcgtgcccggcaccggcaagagcaccctgctgaacaccatgttcggcctgagattcgccaccggcaagagctgcggccccagaggcgccttcatgcagctgatcaccgtggccgagggcttcagccaggacctgggctgcgaccacatcctggtgatcgacagcggcggcctgatcggcggcgccctgaccagcgccggcgacagattcgagctggaggccagcctggccaccctgctgatgggcctgagcaacgtgaccgtgatcagcctggccgagaccaaggacatccccgccgccatcctgcacgccttcctgagactggagaagaccggccacatgcccaactaccagttcgtgtaccagaacctgcacgacgtgagcgtgcccggccccagacccagagacaagagacagctgctggacccccccggcgacctgagcagagccgccgcccagatggagaagcagggcgacggcttcagagccctggccggcctggccttctgcgaccccgagaagcagcacatctggcacatccccggcctgtggcacggcgccccccccatggccgccgtgagcctggcctacagcgaggccatcttcgagctgaagagatgcctgctggagaacatcagaaacggcctgagcaaccagaacaagaacatccagcagctgatcgagctggtgagaagactgtag

SEQ ID NO: 3525 - DNA, 3744 bp, Artificial Sequence
  Description of Artificial Sequence: Synthetic coding sequence
atgatgagagagtgggtgctgctgatgagcgtgctgctgtgcggcctggccggccccacccacctgttccagcccagcctggtgctggacatggccaaggtgctgctggacaactactgcttccccgagaacctgctgggcatgcaggaggccatccagcaggccatcaagagccacgagatcctgagcatcagcgacccccagaccctggccagcgtgctgaccgccggcgtgcagagcagcctgaacgaccccagactggtgatcagctacgagcccagcacccccgagccccccccccaggtgcccgccctgaccagcctgagcgaggaggagctgctggcctggctgcagagaggcctgagacacgaggtgctggagggcaacgtgggctacctgagagtggacagcgtgcccggccaggaggtgctgagcatgatgggcgagttcctggtggcccacgtgtggggcaacctgatgggcaccagcgccctggtgctggacctgagacactgcaccggcggccaggtgagcggcatcccctacatcatcagctacctgcaccccggcaacaccatcctgcacgtggacaccatctacaacagacccagcaacaccaccaccgagatctggaccctgccccaggtgctgggcgagagatacggcgccgacaaggacgtggtggtgctgaccagcagccagaccagaggcgtggccgaggacatcgcccacatcctgaagcagatgagaagagccatcgtggtgggcgagagaaccggcggcggcgccctggacctgagaaagctgagaatcggcgagagcgacttcttcttcaccgtgcccgtgagcagaagcctgggccccctgggcggcggcagccagacctgggagggcagcggcgtgctgccctgcgtgggcacccccgccgagcaggccctggagaaggccctggccatcctgaccctgagaagcgccctgcccggcgtggtgcactgcctgcaggaggtgctgaaggactactacaccctggtggacagagtgcccaccctgctgcagcacctggccagcatggacttcagcaccgtggtgagcgaggaggacctggtgaccaagctgaacgccggcctgcaggccgccagcgaggaccccagactgctggtgagagccatcggccccaccgagacccccagctggcccgcccccgacgccgccgccgaggacagccccggcgtggcccccgagctgcccgaggacgaggccatcagacaggccctggtggacagcgtgttccaggtgagcgtgctgcccggcaacgtgggctacctgagattcgacagcttcgccgacgccagcgtgctgggcgtgctggccccctacgtgctgagacaggtgtgggagcccctgcaggacaccgagcacctgatcatggacctgagacacaaccccggcggccccagcagcgccgtgcccctgctgctgagctacttccagggccccgaggccggccccgtgcacctgttcaccacctacgacagaagaaccaacatcacccaggagcacttcagccacatggagctgcccggccccagatacagcacccagagaggcgtgtacctgctgaccagccacagaaccgccaccgccgccgaggagttcgccttcctgatgcagagcctgggctgggccaccctggtgggcgagatcaccgccggcaacctgctgcacaccagaaccgtgcccctgctggacacccccgagggcagcctggccctgaccgtgcccgtgctgaccttcatcgacaaccacggcgaggcctggctgggcggcggcgtggtgcccgacgccatcgtgctggccgaggaggccctggacaaggcccaggaggtgctggagttccaccagagcctgggcgccctggtggagggcaccggccacctgctggaggcccactacgccagacccgaggtggtgggccagaccagcgccctgctgagagccaagctggcccagggcgcctacagaaccgccgtggacctggagagcctggccagccagctgaccgccgacctgcaggaggtgagcggcgaccacagactgctggtgttccacagccccggcgagctggtggtggaggaggcccccccccccccccccgccgtgcccagccccgaggagctgacctacctgatcgaggccctgttcaagaccgaggtgctgcccggccagctgggctacctgagattcgacgccatggccgagctggagaccgtgaaggccgtgggcccccagctggtgagactggtgtggcagcagctggtggacaccgccgccctggtgatcgacctgagatacaaccccggcagctacagcaccgccatccccctgctgtgcagctacttcttcgaggccgagcccagacagcacctgtacagcgtgttcgacagagccaccagcaaggtgaccgaggtgtggaccctgccccaggtggccggccagagatacggcagccacaaggacctgtacatcctgatgagccacaccagcggcagcgccgccgaggccttcgcccacaccatgcaggacctgcagagagccaccgtgatcggcgagcccaccgccggcggcgccctgagcgtgggcatctaccaggtgggcagcagccccctgtacgccagcatgcccacccagatggccatgagcgccaccaccggcaaggcctgggacctggccggcgtggagcccgacatcaccgtgcccatgagcgaggccctgagcatcgcccaggacatcgtggccctgagagccaaggtgcccaccgtgctgcagaccgccggcaagctggtggccgacaactacgccagcgccgagctgggcgccaagatggccaccaagctgagcggcctgcagagcagatacagcagagtgaccagcgaggtggccctggccgagatcctgggcgccgacctgcagatgctgagcggcgacccccacctgaaggccgcccacatccccgagaacgccaaggacagaatccccggcatcgtgcccatgcagatccccagccccgaggtgttcgaggagctgatcaagttcagcttccacaccaacgtgctggaggacaacatcggctacctgagattcgacatgttcggcgacggcgagctgctgacccaggtgagcagactgctggtggagcacatctggaagaagatcatgcacaccgacgccatgatcatcgacatgagattcaacatcggcggccccaccagcagcatccccatcctgtgcagctacttcttcgacgagggcccccccgtgctgctggacaagatctacagcagacccgacgacagcgtgagcgagctgtggacccacgcccaggtggtgggcgagagatacggcagcaagaagagcatggtgatcctgaccagcagcgtgaccgccggcaccgccgaggagttcacctacatcatgaagagactgggcagagccctggtgatcggcgaggtgaccagcggcggctgccagcccccccagacctaccacgtggacgacaccaacctgtacctgaccatccccaccgccagaagcgtgggcgccagcgacggcagcagctgggagggcgtgggcgtgaccccccacgtggtggtgcccgccgaggaggccctggccagagccaaggagatgctgcagcacaaccagctgagagtgaagagaagccccggcctgcaggaccacctgtag

SEQ ID NO: 3526 - DNA, 885 bp, Artificial Sequence
  Description of Artificial Sequence: Synthetic coding sequence
atgaacagcgagctggactactacgagaagttcgaggaggtgcacggcatcctgatgtacaaggacttcgtgaagtactgggacaacgtggaggccttccaggccagacccgacgacctggtgatcgccacctaccccaagagcggcaccacctgggtgagcgagatcgtgtacatgatctacaaggagggcgacgtggagaagtgcaaggaggacgtgatcttcaacagaatccccttcctggagtgcagaaaggagaacctgatgaacggcgtgaagcagctggacgagatgaacagccccagaatcgtgaagacccacctgccccccgagctgctgcccgccagcttctgggagaaggactgcaagatcatctacctgtgcagaaacgccaaggacgtggccgtgagcttctactacttcttcctgatggtggccggccaccccaaccccggcagcttccccgagttcgtggagaagttcatgcagggccaggtgccctacggcagctggtacaagcacgtgaagagctggtgggagaagggcaagagccccagagtgctgttcctgttctacgaggacctgaaggaggacatcagaaaggaggtgatcaagctgatccacttcctggagagaaagcccagcgaggagctggtggacagaatcatccaccacaccagcttccaggagatgaagaacaaccccagcaccaactacaccaccctgcccgacgagatcatgaaccagaagctgagccccttcatgagaaagggcatcaccggcgactggaagaaccacttcaccgtggccctgaacgagaagttcgacaagcactacgagcagcagatgaaggagagcaccctgaagttcagaaccgagatctag

SEQ ID NO: 3527 - DNA, 1446 bp, Artificial Sequence
  Description of Artificial Sequence: Synthetic coding sequence
atggcctacaacgacaccgacagaaaccagaccgagaagctgctgaagagagtgagagagctggagcaggaggtgcagagactgaagaaggagcaggccaagaacaaggaggacagcaacatcagagagaacagcgccggcgccggcaagaccaagagagccttcgacttcagcgcccacggcagaagacacgtggccctgagaatcgcctacatgggctggggctaccagggcttcgccagccaggagaacaccaacaacaccatcgaggagaagctgttcgaggccctgaccaagaccagactggtggagagcagacagaccagcaactaccacagatgcggcagaaccgacaagggcgtgagcgccttcggccaggtgatcagcctggacctgagaagccagttccccagaggcagagacagcgaggacttcaacgtgaaggaggaggccaacgccgccgccgaggagatcagatacacccacatcctgaacagagtgctgccccccgacatcagaatcctggcctgggcccccgtggagcccagcttcagcgccagattcagctgcctggagagaacctacagatacttcttccccagagccgacctggacatcgtgaccatggactacgccgcccagaagtacgtgggcacccacgacttcagaaacctgtgcaagatggacgtggccaacggcgtgatcaacttccagagaaccatcctgagcgcccaggtgcagctggtgggccagagccccggcgagggcagatggcaggagcccttccagctgtgccagttcgaggtgaccggccaggccttcctgtaccaccaggtgagatgcatgatggccatcctgttcctgatcggccagggcatggagaagcccgagatcatcgacgagctgctgaacatcgagaagaacccccagaagccccagtacagcatggccgtggagttccccctggtgctgtacgactgcaagttcgagaacgtgaagtggatctacgaccaggaggcccaggagttcaacatcacccacctgcagcagctgtgggccaaccacgccgtgaagacccacatgctgtacagcatgctgcagggcctggacaccgtgcccgtgccctgcggcatcggccccaagatggacggcatgaccgagtggggcaacgtgaagcccagcgtgatcaagcagaccagcgccttcgtggagggcgtgaagatgagaacctacaagcccctgatggacagacccaagtgccagggcctggagagcagaatccagcacttcgtgagaagaggcagaatcgagcacccccacctgttccacgaggaggagaccaaggccaagagagactgcaacgacaccctggaggaggagaacaccaacctggagacccccaccaagagagtgtgcgtggacaccgagatcaagagcatcatctag

SEQ ID NO: 3528 - DNA, 618 bp, Artificial Sequence
  Description of Artificial Sequence: Synthetic coding sequence
atgagcaacttcctgcacctgaagtacaacgagaagagcgtgagcgtgaccaaggccctgaccgtgagattcctgaccaagagattcatcggcgagtacgccagcaacttcgagagcatctacaagaagcacctgtgcctggagagaaagcagctgaacctggagatctacgacccctgcagccagacccagaaggccaagttcagcctgaccagcgagctgcactgggccgacggcttcgtgatcgtgtacgacatcagcgacagaagcagcttcgccttcgccaaggccctgatctacagaatcagagagccccagaccagccactgcaagagagccgtggagagcgccgtgttcctggtgggcaacaagagagacctgtgccacgtgagagaggtgggctgggaggagggccagaagctggccctggagaacagatgccagttctgcgagctgagcgccgccgagcagagcctggaggtggagatgatgttcatcagaatcatcaaggacatcctgatcaacttcaagctgaaggagaagagaagacccagcggcagcaagagcatggccaagctgatcaacaacgtgttcggcaagagaagaaagagcgtgtag

SEQ ID NO: 3529 - DNA, 1008 bp, Artificial Sequence
  Description of Artificial Sequence: Synthetic coding sequence
atgggcaaggtgaaggtgggcgtgaacggcttcggcagaatcggcagactggtgaccagagccgccttcaacagcggcaaggtggacatcgtggccatcaacgaccccttcatcgacctgaactacatggtgtacatgttccagtacgacagcacccacggcaagttccacggcaccgtgaaggccgagaacggcaagctggtgatcaacggcaaccccatcaccatcttccaggagagagaccccagcaagatcaagtggggcgacgccggcgccgagtacgtggtggagagcaccggcgtgttcaccaccatggagaaggccggcgcccacctgcagggcggcgccaagagagtgatcatcagcgcccccagcgccgacgcccccatgttcgtgatgggcgtgaaccacgagaagtacgacaacagcctgaagatcatcagcaacgccagctgcaccaccaactgcctggcccccctggccaaggtgatccacgacaacttcggcatcgtggagggcctgatgaccaccgtgcacgccatcaccgccacccagaagaccgtggacggccccagcggcaagctgtggagagacggcagaggcgccctgcagaacatcatccccgccagcaccggcgccgccaaggccgtgggcaaggtgatccccgagctgaacggcaagctgaccggcatggccttcagagtgcccaccgccaacgtgagcgtggtggacctgacctgcagactggagaagcccgccaagtacgacgacatcaagaaggtggtgaagcaggccagcgagggccccctgaagggcatcctgggctacaccgagcaccaggtggtgagcagcgacttcaacagcgacacccacagcagcaccttcgacgccggcgccggcatcgccctgaacgaccacttcgtgaagctgatcagctggtacgacaacgagttcggctacagcaacagagtggtggacctgatggcccacatggccagcaaggagtag

SEQ ID NO: 3530 - DNA, 597 bp, Artificial Sequence
  Description of Artificial Sequence: Synthetic coding sequence
atggacagcctgctgatgaacagaagaaagttcctgtaccagttcaagaacgtgagatgggccaagggcagaagagagacctacctgtgctacgtggtgaagagaagagacagcgccaccagcttcagcctggacttcggctacctgagaaacaagaacggctgccacgtggagctgctgttcctgagatacatcagcgactgggacctggaccccggcagatgctacagagtgacctggttcaccagctggagcccctgctacgactgcgccagacacgtggccgacttcctgagaggcaaccccaacctgagcctgagaatcttcaccgccagactgtacttctgcgaggacagaaaggccgagcccgagggcctgagaagactgcacagagccggcgtgcagatcgccatcatgaccttcaaggactacttctactgctggaacaccttcgtggagaaccacgagagaaccttcaaggcctgggagggcctgcacgagaacagcgtgagactgagcagacagctgagaagaatcctgctgcccctgtacgaggtggacgacctgagagacgccttcagaaccctgggcctgtag

SEQ ID NO: 3531 - DNA, 5472 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggcgagcactgcgagaagtgcctggacggctacatcggcgacagcatcagaggcgccccccagttctgccagccctgcccctgccccctgccccacctggccaacttcgccgagagctgctacagaaagaacggcgccgtgagatgcatctgcaacgagaactacgccggccccaactgcgagagatgcgcccccggctactacggcaaccccctgctgatcggcagcacctgcaagaagtgcgactgcagcggcaacagcgaccccaacctgatcttcgaggactgcgacgaggtgaccggccagtgcagaaactgcctgagaaacaccaccggcttcaagtgcgagagatgcgcccccggctactacggcgacgccagaatcgccaagaactgcgccgtgtgcaactgcggcggcggcccctgcgacagcgtgaccggcgagtgcctggaggagggcttcgagccccccaccggcatggactgccccaccatcagctgcgacaagtgcgtgtgggacctgaccgacgccctgagactggccgccctgagcatcgaggagggcaagagcggcgtgctgagcgtgagcagcggcgccgccgcccacagacacgtgaacgagatcaacgccaccatctacctgctgaagaccaagctgagcgagagagagaaccagtacgccctgagaaagatccagatcaacaacgccgagaacaccatgaagagcctgctgagcgacgtggaggagctggtggagaaggagaaccaggccagcagaaagggccagctggtgcagaaggagagcatggacaccatcaaccacgccagccagctggtggagcaggcccacgacatgagagacaagatccaggagatcaacaacaagatgctgtactacggcgaggagcacgagctgagccccaaggagatcagcgagaagctggtgctggcccagaagatgctggaggagatcagaagcagacagcccttcttcacccagagagagctggtggacgaggaggccgacgaggcctacgagctgctgagccaggccgagagctggcagagactgcacaacgagaccagaaccctgttccccgtggtgctggagcagctggacgactacaacgccaagctgagcgacctgcaggaggccctggaccaggccctgaactacgtgagagacgccgaggacatgaacagagccaccgccgccagacagagagaccacgagaagcagcaggagagagtgagagagcagatggaggtggtgaacatgagcctgagcaccagcgccgacagcctgaccacccccagactgaccctgagcgagctggacgacatcatcaagaacgccagcggcatctacgccgagatcgacggcgccaagagcgagctgcaggtgaagctgagcaacctgagcaacctgagccacgacctggtgcaggaggccatcgaccacgcccaggacctgcagcaggaggccaacgagctgagcagaaagctgcacagcagcgacatgaacggcctggtgcagaaggccctggacgccagcaacgtgtacgagaacatcgtgaactacgtgagcgaggccaacgagaccgccgagttcgccctgaacaccaccgacagaatctacgacgccgtgagcggcatcgacacccagatcatctaccacaaggacgagagcgagaacctgctgaaccaggccagagagctgcaggccaaggccgagagcagcagcgacgaggccgtggccgacaccagcagaagagtgggcggcgccctggccagaaagagcgccctgaagaccagactgagcgacgccgtgaagcagctgcaggccgccgagagaggcgacgcccagcagagactgggccagagcagactgatcaccgaggaggccaacagaaccaccatggaggtgcagcaggccaccgcccccatggccaacaacctgaccaactggagccagaacctgcagcacttcgacagcagcgcctacaacaccgccgtgaacagcgccagagacgccgtgagaaacctgaccgaggtggtgccccagctgctggaccagctgagaaccgtggagcagaagagacccgccagcaacgtgagcgccagcatccagagaatcagagagctgatcgcccagaccagaagcgtggccagcaagatccaggtgagcatgatgttcgacggccagagcgccgtggaggtgcacagcagaaccagcatggacgacctgaaggccttcaccagcctgagcctgtacatgaagccccccgtgaagagacccgagctgaccgagaccgccgaccagttcatcctgtacctgggcagcaagaacgccaagaaggagtacatgggcctggccatcaagaacgacaacctggtgtacgtgtacaacctgggcaccaaggacgtggagatccccctggacagcaagcccgtgagcagctggcccgcctacttcagcatcgtgaagatcgagagagtgggcaagcacggcaaggtgttcctgaccgtgcccagcctgagcagcaccgccgaggagaagttcatcaagaagggcgagttcagcggcgacgacagcctgctggacctggaccccgaggacaccgtgttctacgtgggcggcgtgcccagcaacttcaagctgcccaccagcctgaacctgcccggcttcgtgggctgcctggagctggccaccctgaacaacgacgtgatcagcctgtacaacttcaagcacatctacaacatggaccccagcaccagcgtgccctgcgccagagacaagctggccttcacccagagcagagccgccagctacttcttcgacggcagcggctacgccgtggtgagagacatcaccagaagaggcaagttcggccaggtgaccagattcgacatcgaggtgagaacccccgccgacaacggcctgatcctgctgatggtgaacggcagcatgttcttcagactggagatgagaaacggctacctgcacgtgttctacgacttcggcttcagcggcggccccgtgcacctggaggacaccctgaagaaggcccagatcaacgacgccaagtaccacgagatcagcatcatctaccacaacgacaagaagatgatcctggtggtggacagaagacacgtgaagagcatggacaacgagaagatgaagatccccttcaccgacatctacatcggcggcgccccccccgagatcctgcagagcagagccctgagagcccacctgcccctggacatcaacttcagaggctgcatgaagggcttccagttccagaagaaggacttcaacctgctggagcagaccgagaccctgggcgtgggctacggctgccccgaggacagcctgatcagcagaagagcctacttcaacggccagagcttcatcgccagcatccagaagatcagcttcttcgacggcttcgagggcggcttcaacttcagaaccctgcagcccaacggcctgctgttctactacgccagcggcagcgacgtgttcagcatcagcctggacaacggcaccgtgatcatggacgtgaagggcatcaaggtgcagagcgtggacaagcagtacaacgacggcctgagccacttcgtgatcagcagcgtgagccccaccagatacgagctgatcgtggacaagagcagagtgggcagcaagaaccccaccaagggcaagatcgagcagacccaggccagcgagaagaagttctacttcggcggcagccccatcagcgcccagtacgccaacttcaccggctgcatcagcaacgcctacttcaccagagtggacagagacgtggaggtggaggacttccagagatacaccgagaaggtgcacaccagcctgtacgagtgccccatcgagagcagccccctgttcctgctgcacaagaagggcaagaacctgagcaagcccaaggccagccagaacaagaagggcggcaagagcaaggacgcccccagctgggaccccgtggccctgaagctgcccgagagaaacacccccagaaacagccactgccacctgagcaacagccccagagccatcgagcacgcctaccagtacggcggcaccgccaacagcagacaggagttcgagcacctgaagggcgacttcggcgccaagagccagttcagcatcagactgagaaccagaagcagccacggcatgatcttctacgtgagcgaccaggaggagaacgacttcatgaccctgttcctggcccacggcagactggtgtacatgttcaacgtgggccacaagaagctgaagatcagaagccaggagaagtacaacgacggcctgtggcacgacgtgatcttcatcagagagagaagcagcggcagactggtgatcgacggcctgagagtgctggaggagagcctgccccccaccgaggccacctggaagatcaagggccccatctacctgggcggcgtggcccccggcaaggccgtgaagaacgtgcagatcaacagcatctacagcttcagcggctgcctgagcaacctgcagctgaacggcgccagcatcaccagcgccagccagaccttcagcgtgaccccctgcttcgagggccccatggagaccggcacctacttcagcaccgagggcggctacgtggtgctggacgagagcttcaacatcggcctgaagttcgagatcgccttcgaggtgagacccagaagcagcagcggcaccctggtgcacggccacagcgtgaacggcgagtacctgaacgtgcacatgaagaacggccaggtgatcgtgaaggtgaacaacggcatcagagacttcagcaccagcgtgacccccaagcagagcctgtgcgacggcagatggcacagaatcaccgtgatcagagacagcaacgtggtgcagctggacgtggacagcgaggtgaaccacgtggtgggccccctgaaccccaagcccatcgaccacagagagcccgtgttcgtgggcggcgtgcccgagagcctgctgacccccagactggcccccagcaagcccttcaccggctgcatcagacacttcgtgatcgacggccaccccgtgagcttcagcaaggccgccctggtgagcggcgccgtgagcatcaacagctgccccgccgcctag

SEQ ID NO: 3532 - DNA, 1434 bp, Artificial Sequence
  Description of Artificial Sequence: Synthetic coding sequence
atgaccagcaagttcctgctggtgagcttcatcctggccgccctgagcctgagcaccaccttcagcctgcagcccgaccagcagaaggtgctgctggtgagcttcgacggcttcagatgggactacctgtacaaggtgcccaccccccacttccactacatcatgaagtacggcgtgcacgtgaagcaggtgaccaacgtgttcatcaccaagacctaccccaaccactacaccctggtgaccggcctgttcgccgagaaccacggcatcgtggccaacgacatgttcgaccccatcagaaacaagagcttcagcctggaccacatgaacatctacgacagcaagttctgggaggaggccacccccatctggatcaccaaccagagagccggccacaccagcggcgccgccatgtggcccggcaccgacgtgaagatccacaagagattccccacccactacatgccctacaacgagagcgtgagcttcgaggacagagtggccaagatcatcgagtggttcaccagcaaggagcccatcaacctgggcctgctgtactgggaggaccccgacgacatgggccaccacctgggccccgacagccccctgatgggccccgtgatcagcgacatcgacaagaagctgggctacctgatccagatgctgaagaaggccaagctgtggaacaccctgaacctgatcatcaccagcgaccacggcatgacccagtgcagcgaggagagactgatcgagctggaccagtacctggacaaggaccactacaccctgatcgaccagagccccgtggccgccatcctgcccaaggagggcaagttcgacgaggtgtacgaggccctgacccacgcccaccccaacctgaccgtgtacaagaaggaggacgtgcccgagagatggcactacaagtacaacagcagaatccagcccatcatcgccgtggccgacgagggctggcacatcctgcagaacaagagcgacgacttcctgctgggcaaccacggctacgacaacgccctggccgacatgcaccccatcttcctggcccacggccccgccttcagaaagaacttcagcaaggaggccatgaacagcaccgacctgtaccccctgctgtgccacctgctgaacatcaccgccatgccccacaacggcagcttctggaacgtgcaggacctgctgaacagcgccatgcccagagtggtgccctacacccagagcaccatcctgctgcccggcagcgtgaagcccgccgagtacgaccaggagggcagctacccctacttcatcggcgtgagcctgggcagcatcatcgtgatcgtgttcttcgtgatcttcatcaagcacctgatccacagccagatccccgccctgcaggacatgcacgccgagatcgcccagcccctgctgcaggcctag

SEQ ID NO: 3533 - DNA, 1254 bp, Artificial Sequence
  Description of Artificial Sequence: Synthetic coding sequence
atgagattcgcctggaccgtgctgctgctgggccccctgcagctgtgcgccctggtgcactgcgccccccccgccgccggccagcagcagccccccagagagccccccgccgcccccggcgcctggagacagcagatccagtgggagaacaacggccaggtgttcagcctgctgagcctgggcagccagtaccagccccagagaagaagagaccccggcgccgccgtgcccggcgccgccaacgccagcgcccagcagcccagaacccccatcctgctgatcagagacaacagaaccgccgccgccagaaccagaaccgccggcagcagcggcgtgaccgccggcagacccagacccaccgccagacactggttccaggccggctacagcaccagcagagccagagaggccggcgccagcagagccgagaaccagaccgcccccggcgaggtgcccgccctgagcaacctgagaccccccagcagagtggacggcatggtgggcgacgacccctacaacccctacaagtacagcgacgacaacccctactacaactactacgacacctacgagagacccagacccggcggcagatacagacccggctacggcaccggctacttccagtacggcctgcccgacctggtggccgacccctactacatccaggccagcacctacgtgcagaagatgagcatgtacaacctgagatgcgccgccgaggagaactgcctggccagcaccgcctacagagccgacgtgagagactacgaccacagagtgctgctgagattcccccagagagtgaagaaccagggcaccagcgacttcctgcccagcagacccagatacagctgggagtggcacagctgccaccagcactaccacagcatggacgagttcagccactacgacctgctggacgccaacacccagagaagagtggccgagggccacaaggccagcttctgcctggaggacaccagctgcgactacggctaccacagaagattcgcctgcaccgcccacacccagggcctgagccccggctgctacgacacctacggcgccgacatcgactgccagtggatcgacatcaccgacgtgaagcccggcaactacatcctgaaggtgagcgtgaaccccagctacctggtgcccgagagcgactacaccaacaacgtggtgagatgcgacatcagatacaccggccaccacgcctacgccagcggctgcaccatcagcccctactag

SEQ ID NO: 3534 - DNA, 879 bp, Artificial Sequence
  Description of Artificial Sequence: Synthetic coding sequence
atgggcgagaagagcgagaactgcggcgtgcccgaggacctgctgaacggcctgaaggtgaccgacacccaggaggccgagtgcgccggcccccccgtgcccgaccccaagaaccagcacagccagagcaagctgctgagagacgacgaggcccacctgcaggaggaccagggcgaggaggagtgcttccacgactgcagcgccagcttcgaggaggagcccggcgccgacaaggtggagaacaagagcaacgaggacgtgaacagcagcgagctggacgaggagtacctgatcgagctggagaagaacatgagcgacgaggagaagcagaagagaagagaggagagcaccagactgaaggaggagggcaacgagcagttcaagaagggcgactacatcgaggccgagagcagctacagcagagccctggagatgtgccccagctgcttccagaaggagagaagcatcctgttcagcaacagagccgccgccagaatgaagcaggacaagaaggagatggccatcaacgactgcagcaaggccatccagctgaaccccagctacatcagagccatcctgagaagagccgagctgtacgagaagaccgacaagctggacgaggccctggaggactacaagagcatcctggagaaggaccccagcatccaccaggccagagaggcctgcatgagactgcccaagcagatcgaggagagaaacgagagactgaaggaggagatgctgggcaagctgaaggacctgggcaacctggtgctgagacccttcggcctgagcaccgagaacttccagatcaagcaggacagcagcaccggcagctacagcatcaacttcgtgcagaaccccaacaacaacagatag

SEQ ID NO: 3535 - DNA, 2316 bp, Artificial Sequence
  Description of Artificial Sequence: Synthetic coding sequence
atgagcggcttcttcaccagcctggaccccagaagagtgcagtggggcgccgcctggtacgccatgcacagcagaatcctgagaaccaagcccgtggagagcatgctggagggcaccggcaccaccaccgcccacggcaccaagctggcccaggtgctgaccaccgtggacctgatcagcctgggcgtgggcagctgcgtgggcaccggcatgtacgtggtgagcggcctggtggccaaggagatggccggccccggcgtgatcgtgagcttcatcatcgccgccgtggccagcatcctgagcggcgtgtgctacgccgagttcggcgtgagagtgcccaagaccaccggcagcgcctacacctacagctacgtgaccgtgggcgagttcgtggccttcttcatcggctggaacctgatcctggagtacctgatcggcaccgccgccggcgccagcgccctgagcagcatgttcgacagcctggccaaccacaccatcagcagatggatggccgacagcgtgggcaccctgaacggcctgggcaagggcgaggagagctaccccgacctgctggccctgctgatcgccgtgatcgtgaccatcatcgtggccctgggcgtgaagaacagcatcggcttcaacaacgtgctgaacgtgctgaacctggccgtgtgggtgttcatcatgatcgccggcctgttcttcatcaacggcaagtactgggccgagggccagttcctgccccacggctggagcggcgtgctgcagggcgccgccacctgcttctacgccttcatcggcttcgacatcatcgccaccaccggcgaggaggccaagaaccccaacaccagcatcccctacgccatcaccgccagcctggtgatctgcctgaccgcctacgtgagcgtgagcgtgatcctgaccctgatggtgccctactacaccatcgacaccgagagccccctgatggagatgttcgtggcccacggcttctacgccgccaagttcgtggtggccatcggcagcgtggccggcctgaccgtgagcctgctgggcagcctgttccccatgcccagagtgatctacgccatggccggcgacggcctgctgttcagattcctggcccacgtgagcagctacaccgagacccccgtggtggcctgcatcgtgagcggcttcctggccgccctgctggccctgctggtgagcctgagagacctgatcgagatgatgagcatcggcaccctgctggcctacaccctggtgagcgtgtgcgtgctgctgctgagataccagcccgagagcgacatcgacggcttcgtgaagttcctgagcgaggagcacaccaagaagaaggagggcatcctggccgactgcgagaaggaggcctgcagccccgtgagcgagggcgacgagttcagcggccccgccaccaacacctgcggcgccaagaacctgcccagcctgggcgacaacgagatgctgatcggcaagagcgacaagagcacctacaacgtgaaccaccccaactacggcaccgtggacatgaccaccggcatcgaggccgacgagagcgagaacatctacctgatcaagctgaagaagctgatcggcccccactactacaccatgagaatcagactgggcctgcccggcaagatggacagacccaccgccgccaccggccacaccgtgaccatctgcgtgctgctgctgttcatcctgatgttcatcttctgcagcttcatcatcttcggcagcgactacatcagcgagcagagctggtgggccatcctgctggtggtgctgatggtgctgctgatcagcaccctggtgttcgtgatcctgcagcagcccgagaaccccaagaagctgccctacatggccccctgcctgcccttcgtgcccgccttcgccatgctggtgaacatctacctgatgctgaagctgagcaccatcacctggatcagattcgccgtgtggtgcttcgtgggcctgctgatctacttcggctacggcatctggaacagcaccctggagatcagcgccagagaggaggccctgcaccagagcacctaccagagatacgacgtggacgaccccttcagcgtggaggagggcttcagctacgccaccgagggcgagagccaggaggactggggcggccccaccgaggacaagggcttctactaccagcagatgagcgacgccaaggccaacggcagaaccagcagcaaggccaagagcaagagcaagcacaagcagaacagcgaggccctgatcgccaacgacgagctggactacagccccgagtag

SEQ ID NO: 3536 - DNA, 513 bp, Artificial Sequence
  Description of Artificial Sequence: Synthetic coding sequence
atgggcaacgaggccagctaccccctggagatgtgcagccacttcgacgccgacgagatcaagagactgggcaagagattcaagaagctggacctggacaacagcggcagcctgagcgtggaggagttcatgagcctgcccgagctgcagcagaaccccctggtgcagagagtgatcgacatcttcgacaccgacggcaacggcgaggtggacttcaaggagttcatcgagggcgtgagccagttcagcgtgaagggcgacaaggagcagaagctgagattcgccttcagaatctacgacatggacaaggacggctacatcagcaacggcgagctgttccaggtgctgaagatgatggtgggcaacaacctgaaggacacccagctgcagcagatcgtggacaagaccatcatcaacgccgacaaggacggcgacggcagaatcagcttcgaggagttctgcgccgtggtgggcggcctggacatccacaagaagatggtggtggacgtgtag

SEQ ID NO: 3537 - DNA, 1218 bp, Artificial Sequence
  Description of Artificial Sequence: Synthetic coding sequence
atgagcagcagcgtgaagacccccgccctggaggagctggtgcccggcagcgaggagaagcccaagggcagaagccccctgagctggggcagcctgttcggccacagaagcgagaagatcgtgttcgccaagagcgacggcggcaccgacgagaacgtgctgaccgtgaccatcaccgagaccaccgtgatcgagagcgacctgggcgtgtggagcagcagagccctgctgtacctgaccctgtggttcttcttcagcttctgcaccctgttcctgaacaagtacatcctgagcctgctgggcggcgagcccagcatgctgggcgccgtgcagatgctgagcaccaccgtgatcggctgcgtgaagaccctggtgccctgctgcctgtaccagcacaaggccagactgagctacccccccaacttcctgatgaccatgctgttcgtgggcctgatgagattcgccaccgtggtgctgggcctggtgagcctgaagaacgtggccgtgagcttcgccgagaccgtgaagagcagcgcccccatcttcaccgtgatcatgagcagaatgatcctgggcgagtacaccggcctgctggtgaacctgagcctgatccccgtgatgggcggcctggccctgtgcaccgccaccgagatcagcttcaacgtgctgggcttcagcgccgccctgagcaccaacatcatggactgcctgcagaacgtgttcagcaagaagctgctgagcggcgacaagtacagattcagcgcccccgagctgcagttctacaccagcgccgccgccgtggccatgctggtgcccgccagagtgttcttcaccgacgtgcccgtgatcggcagaagcggcaagagcttcagctacaaccaggacgtggtgctgctgctgctgaccgacggcgtgctgttccacctgcagagcgtgaccgcctacgccctgatgggcaagatcagccccgtgaccttcagcgtggccagcaccgtgaagcacgccctgagcatctggctgagcgtgatcgtgttcggcaacaagatcaccagcctgagcgccgtgggcaccgccctggtgaccgtgggcgtgctgctgtacaacaaggccagacagcaccagcaggaggccctgcagagcctggccgccgccaccggcagagcccccgacgacaccgtggagcccctgctgccccaggaccccagacagcacccctag

SEQ ID NO: 3538 - DNA, 1131 bp, Artificial Sequence
  Description of Artificial Sequence: Synthetic coding sequence
atgctgaagaagatcagcgtgggcgtggccggcgacctgaacaccgtgaccatgaagctgggctgcgtgctgatggcctgggccctgtacctgagcctgggcgtgctgtgggtggcccagatgctgctggccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacgactggctgatcctgcagggccccgccaagcccgtgttcgagggcgacctgctggtgctgagatgccaggcctggcaggactggcccctgacccaggtgaccttctacagagacggcagcgccctgggcccccccggccccaacagagagttcagcatcaccgtggtgcagaaggccgacagcggccactaccactgcagcggcatcttccagagccccggccccggcatccccgagaccgccagcgtggtggccatcaccgtgcaggagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 3539 - DNA, 1572 bp, Artificial Sequence
  Description of Artificial Sequence: Synthetic coding sequence
atggccagaaaggccctgaagctggccagctggaccagcatggccctggccgccagcggcatctacttctacagcaacaagtacctggaccccaacgacttcggcgccgtgagagtgggcagagccgtggccaccaccgccgtgatcagctacgactacctgaccagcctgaagagcgtgccctacggcagcgaggagtacctgcagctgagaagcaaggtgcacctgagaagcgccagaagactgtgcgagctgtgctgcgccaacagaggcaccttcatcaaggtgggccagcacctgggcgccctggactacctgctgcccgaggagtacaccagcaccctgaaggtgctgcacagccaggccccccagagcagcatgcaggagatcagacaggtgatcagagaggacctgggcaaggagatccacgacctgttccagagcttcgacgacacccccctgggcaccgccagcctggcccaggtgcacaaggccgtgctgcacgacggcagaaccgtggccgtgaaggtgcagcaccccaaggtgagagcccagagcagcaaggacatcctgctgatggaggtgctggtgctggccgtgaagcagctgttccccgagttcgagttcatgtggctggtggacgaggccaagaagaacctgcccctggagctggacttcctgaacgagggcagaaacgccgagaaggtgagccagatgctgagacacttcgacttcctgaaggtgcccagaatccactgggacctgagcaccgagagagtgctgctgatggagttcgtggacggcggccaggtgaacgacagagactacatggagagaaacaagatcgacgtgaacgagatcagcagacacctgggcaagatgtacagcgagatgatcttcgtgaacggcttcgtgcactgcgacccccaccccggcaacgtgctggtgagaaagcaccccggcaccggcaaggccgagatcgtgctgctggaccacggcctgtaccagatgctgaccgaggagttcagactgaactactgccacctgtggcagagcctgatctggaccgacatgaagagagtgaaggagtacagccagagactgggcgccggcgacctgtaccccctgttcgcctgcatgctgaccgccagaagctgggacagcgtgaacagaggcatcagccaggcccccgtgaccgccaccgaggacctggagatcagaaacaacgccgccaactacctgccccagatcagccacctgctgaaccacgtgcccagacagatgctgctgatcctgaagaccaacgacctgctgagaggcatcgaggccgccctgggcaccagagccagcgccagcagcttcctgaacatgagcagatgctgcatcagagccctggccgagcacaagaagaagaacacctgcagcttcttcagaagaacccagatcagcttcagcgaggccttcaacctgtggcagatcaacctgcacgagctgatcctgagagtgaagggcctgaagctggccgacagagtgctggccctgatctgctggctgttccccgcccccctgtag

SEQ ID NO: 3540 - DNA, 1197 bp, Artificial Sequence
  Description of Artificial Sequence: Synthetic coding sequence
atgtggctgctgctgaccatggccagcctgatcagcgtgctgggcaccacccacggcctgttcggcaagctgcaccccggcagccccgaggtgaccatgaacatcagccagatgatcacctactggggctaccccaacgaggagtacgaggtggtgaccgaggacggctacatcctggaggtgaacagaatcccctacggcaagaagaacagcggcaacaccggccagagacccgtggtgttcctgcagcacggcctgctggccagcgccaccaactggatcagcaacctgcccaacaacagcctggccttcatcctggccgacgccggctacgacgtgtggctgggcaacagcagaggcaacacctgggccagaagaaacctgtactacagccccgacagcgtggagttctgggccttcagcttcgacgagatggccaagtacgacctgcccgccaccatcgacttcatcgtgaagaagaccggccagaagcagctgcactacgtgggccacagccagggcaccaccatcggcttcatcgccttcagcaccaaccccagcctggccaagagaatcaagaccttctacgccctggcccccgtggccaccgtgaagtacaccaagagcctgatcaacaagctgagattcgtgccccagagcctgttcaagttcatcttcggcgacaagatcttctacccccacaacttcttcgaccagttcctggccaccgaggtgtgcagcagagagatgctgaacctgctgtgcagcaacgccctgttcatcatctgcggcttcgacagcaagaacttcaacaccagcagactggacgtgtacctgagccacaaccccgccggcaccagcgtgcagaacatgttccactggacccaggccgtgaagagcggcaagttccaggcctacgactggggcagccccgtgcagaacagaatgcactacgaccagagccagcccccctactacaacgtgaccgccatgaacgtgcccatcgccgtgtggaacggcggcaaggacctgctggccgacccccaggacgtgggcctgctgctgcccaagctgcccaacctgatctaccacaaggagatccccttctacaaccacctggacttcatctgggccatggacgccccccaggaggtgtacaacgacatcgtgagcatgatcagcgaggacaagaagtag

SEQ ID NO: 3541 - DNA, 555 bp, Artificial Sequence
  Description of Artificial Sequence: Synthetic coding sequence
atgagaggccagggcagaaaggagagcctgagcgacagcagagacctggacggcagctacgaccagctgaccgacagcgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggtgcagctgcccgccctgtacatcaccctgacctggacccaggcctag

SEQ ID NO: 3542 - DNA, 3900 bp, Artificial Sequence
  Description of Artificial Sequence: Synthetic coding sequence
atgagcctgcaggagatgttcagattccccatgggcctgctgctgggcagcgtgctgctggtggccagcgcccccgccaccctggagccccccggctgcagcaacaaggagcagcaggtgaccgtgagccacacctacaagatcgacgtgcccaagagcgccctggtgcaggtggacgccgacccccagcccctgagcgacgacggcgccagcctgctggccctgggcgaggccagagaggagcagaacatcatcttcagacacaacatcagactgcagaccccccagaaggactgcgagctggccggcagcgtgcaggacctgctggccagagtgaagaagctggaggaggagatggtggagatgaaggagcagtgcagcgcccagagatgctgccagggcgtgaccgacctgagcagacactgcagcggccacggcaccttcagcctggagacctgcagctgccactgcgaggagggcagagagggccccgcctgcgagagactggcctgccccggcgcctgcagcggccacggcagatgcgtggacggcagatgcctgtgccacgagccctacgtgggcgccgactgcggctaccccgcctgccccgagaactgcagcggccacggcgagtgcgtgagaggcgtgtgccagtgccacgaggacttcatgagcgaggactgcagcgagaagagatgccccggcgactgcagcggccacggcttctgcgacaccggcgagtgctactgcgaggagggcttcaccggcctggactgcgcccaggtggtgaccccccagggcctgcagctgctgaagaacaccgaggacagcctgctggtgagctgggagcccagcagccaggtggaccactacctgctgagctactaccccctgggcaaggagctgagcggcaagcagatccaggtgcccaaggagcagcacagctacgagatcctgggcctgctgcccggcaccaagtacatcgtgaccctgagaaacgtgaagaacgaggtgagcagcagcccccagcacctgctggccaccaccgacctggccgtgctgggcaccgcctgggtgaccgacgagaccgagaacagcctggacgtggagtgggagaaccccagcaccgaggtggactactacaagctgagatacggccccatgaccggccaggaggtggccgaggtgaccgtgcccaagagcagcgaccccaagagcagatacgacatcaccggcctgcaccccggcaccgagtacaagatcaccgtggtgcccatgagaggcgagctggagggcaagcccatcctgctgaacggcagaaccgagatcgacagccccaccaacgtggtgaccgacagagtgaccgaggacaccgccaccgtgagctgggaccccgtgcaggccgtgatcgacaagtacgtggtgagatacaccagcgccgacggcgacaccaaggagatggccgtgcacaaggacgagagcagcaccgtgctgaccggcctgaagcccggcgaggcctacaaggtgtacgtgtgggccgagagaggcaaccagggcagcaagaaggccgacaccaacgccctgaccgagatcgacagccccgccaacctggtgaccgacagagtgaccgagaacaccgccaccatcagctgggaccccgtgcaggccaccatcgacaagtacgtggtgagatacaccagcgccgacgaccaggagaccagagaggtgctggtgggcaaggagcagagcagcaccgtgctgaccggcctgagacccggcgtggagtacaccgtgcacgtgtgggcccagaagggcgacagagagagcaagaaggccgacaccaacgcccccaccgacatcgacagccccaagaacctggtgaccgacagagtgaccgagaacatggccaccgtgagctgggaccccgtgcaggccgccatcgacaagtacgtggtgagatacaccagcgccggcggcgagaccagagaggtgcccgtgggcaaggagcagagcagcaccgtgctgaccggcctgagacccggcatggagtacatggtgcacgtgtgggcccagaagggcgaccaggagagcaagaaggccgacaccaaggcccagaccgacatcgacagcccccagaacctggtgaccgacagagtgaccgagaacatggccaccgtgagctgggaccccgtgagagccaccatcgacagatacgtggtgagatacaccagcgccaaggacggcgagaccagagaggtgcccgtgggcaaggagcagagcagcaccgtgctgaccggcctgagacccggcgtggagtacaccgtgcacgtgtgggcccagaagggcgcccaggagagcaagaaggccgacaccaaggcccagaccgacatcgacagcccccagaacctggtgaccgactgggtgaccgagaacaccgccaccgtgagctgggaccccgtgcaggccaccatcgacagatacgtggtgcactacaccagcgccaacggcgagaccagagaggtgcccgtgggcaaggagcagagcagcaccgtgctgaccggcctgagacccggcatggagtacaccgtgcacgtgtgggcccagaagggcaaccaggagagcaagaaggccgacaccaaggcccagaccgagatcgacggccccaagaacctggtgaccgactgggtgaccgagaacatggccaccgtgagctgggaccccgtgcaggccaccatcgacaagtacatggtgagatacaccagcgccgacggcgagaccagagaggtgcccgtgggcaaggagcacagcagcaccgtgctgaccggcctgagacccggcatggagtacatggtgcacgtgtgggcccagaagggcgcccaggagagcaagaaggccgacaccaaggcccagaccgagctggacccccccagaaacctgagacccagcgccgtgacccagagcggcggcatcctgacctggaccccccccagcgcccagatccacggctacatcctgacctaccagttccccgacggcaccgtgaaggagatgcagctgggcagagaggaccagagattcgccctgcagggcctggagcagggcgccacctaccccgtgagcctggtggccttcaagggcggcagaagaagcagaaacgtgagcaccaccctgagcaccgtgggcgccagattcccccaccccagcgactgcagccaggtgcagcagaacagcaacgccgccagcggcctgtacaccatctacctgcacggcgacgccagcagacccctgcaggtgtactgcgacatggagaccgacggcggcggctggatcgtgttccagagaagaaacaccggccagctggacttcttcaagagatggagaagctacgtggagggcttcggcgaccccatgaaggagttctggctgggcctggacaagctgcacaacctgaccaccggcacccccgccagatacgaggtgagagtggacctgcagaccgccaacgagagcgcctacgccatctacgacttcttccaggtggccagcagcaaggagagatacaagctgaccgtgggcaagtacagaggcaccgccggcgacgccctgacctaccacaacggctggaagttcaccaccttcgacagagacaacgacatcgccctgagcaactgcgccctgacccaccacggcggctggtggtacaagaactgccacctggccaaccccaacggcagatacggcgagaccaagcacagcgagggcgtgaactgggagccctggaagggccacgagttcagcatcccctacgtggagctgaagatcagaccccacggctacagcagagagcccgtgctgggcagaaagaagagaaccctgagaggcagactgagaaccttctag

SEQ ID NO: 3543 - DNA, 1662 bp, Artificial Sequence
  Description of Artificial Sequence: Synthetic coding sequence
atgaccagaggcggccccggcggcagacccggcctgccccagcccccccccctgctgctgctgctgctgctgctgcccctgctgctggtgaccgccgagccccccaagcccgccggcgtgtactacgccaccgcctactggatgcccgccgagaagaccgtgcaggtgaagaacgtgatggacaagaacggcgacgcctacggcttctacaacaacagcgtgaagaccaccggctggggcatcctggagatcagagccggctacggcagccagaccctgagcaacgagatcatcatgttcgtggccggcttcctggagggctacctgaccgccccccacatgaacgaccactacaccaacctgtacccccagctgatcaccaagcccagcatcatggacaaggtgcaggacttcatggagaagcaggacaagtggaccagaaagaacatcaaggagtacaagaccgacagcttctggagacacaccggctacgtgatggcccagatcgacggcctgtacgtgggcgccaagaagagagccatcctggagggcaccaagcccatgaccctgttccagatccagttcctgaacagcgtgggcgacctgctggacctgatccccagcctgagccccaccaagaacggcagcctgaaggtgttcaagagatgggacatgggccactgcagcgccctgatcaaggtgctgcccggcttcgagaacatcctgttcgcccacagcagctggtacacctacgccgccatgctgagaatctacaagcactgggacttcaacgtgatcgacaaggacaccagcagcagcagactgagcttcagcagctaccccggcttcctggagagcctggacgacttctacatcctgagcagcggcctgatcctgctgcagaccaccaacagcgtgttcaacaagaccctgctgaagcaggtgatccccgagaccctgctgagctggcagagagtgagagtggccaacatgatggccgacagcggcaagagatgggccgacatcttcagcaagtacaacagcggcacctacaacaaccagtacatggtgctggacctgaagaaggtgaagctgaaccacagcctggacaagggcaccctgtacatcgtggagcagatccccacctacgtggagtacagcgagcagaccgacgtgctgagaaagggctactggcccagctacaacgtgcccttccacgagaagatctacaactggagcggctaccccctgctggtgcagaagctgggcctggactacagctacgacctggcccccagagccaagatcttcagaagagaccagggcaaggtgaccgacaccgccagcatgaagtacatcatgagatacaacaactacaagaaggacccctacagcagaggcgacccctgcaacaccatctgctgcagagaggacctgaacagccccaaccccagccccggcggctgctacgacaccaaggtggccgacatctacctggccagccagtacaccagctacgccatcagcggccccaccgtgcagggcggcctgcccgtgttcagatgggacagattcaacaagaccctgcaccagggcatgcccgaggtgtacaacttcgacttcatcaccatgaagcccatcctgaagctggacatcaagtag

SEQ ID NO: 3544 - DNA, 2271 bp, Artificial Sequence
  Description of Artificial Sequence: Synthetic coding sequence
atgagcagacccggcaccgccacccccgccctggccctggtgctgctggccgtgaccctggccggcgtgggcgcccagggcgccgccctggaggaccccgactactacggccaggagatctggagcagagagccctactacgccagacccgagcccgagctggagaccttcagcccccccctgcccgccggccccggcgaggagtgggagagaagaccccaggagcccagaccccccaagagagccaccaagcccaagaaggcccccaagagagagaagagcgcccccgagccccccccccccggcaagcacagcaacaagaaggtgatgagaaccaagagcagcgagaaggccgccaacgacgaccacagcgtgagagtggccagagaggacgtgagagagagctgcccccccctgggcctggagaccctgaagatcaccgacttccagctgcacgccagcaccgtgaagagatacggcctgggcgcccacagaggcagactgaacatccaggccggcatcaacgagaacgacttctacgacggcgcctggtgcgccggcagaaacgacctgcagcagtggatcgaggtggacgccagaagactgaccagattcaccggcgtgatcacccagggcagaaacagcctgtggctgagcgactgggtgaccagctacaaggtgatggtgagcaacgacagccacacctgggtgaccgtgaagaacggcagcggcgacatgatcttcgagggcaacagcgagaaggagatccccgtgctgaacgagctgcccgtgcccatggtggccagatacatcagaatcaacccccagagctggttcgacaacggcagcatctgcatgagaatggagatcctgggctgccccctgcccgaccccaacaactactaccacagaagaaacgagatgaccaccaccgacgacctggacttcaagcaccacaactacaaggagatgagacagctgatgaaggtggtgaacgagatgtgccccaacatcaccagaatctacaacatcggcaagagccaccagggcctgaagctgtacgccgtggagatcagcgaccaccccggcgagcacgaggtgggcgagcccgagttccactacatcgccggcgcccacggcaacgaggtgctgggcagagagctgctgctgctgctggtgcagttcgtgtgccaggagtacctggccagaaacgccagaatcgtgcacctggtggaggagaccagaatccacgtgctgcccagcctgaaccccgacggctacgagaaggcctacgagggcggcagcgagctgggcggctggagcctgggcagatggacccacgacggcatcgacatcaacaacaacttccccgacctgaacaccctgctgtgggaggccgaggacagacagaacgtgcccagaaaggtgcccaaccactacatcgccatccccgagtggttcctgagcgagaacgccaccgtggccgccgagaccagagccgtgatcgcctggatggagaagatccccttcgtgctgggcggcaacctgcagggcggcgagctggtggtggcctacccctacgacctggtgagaagcccctggaagacccaggagcacacccccacccccgacgaccacgtgttcagatggctggcctacagctacgccagcacccacagactgatgaccgacgccagaagaagagtgtgccacaccgaggacttccagaaggaggagggcaccgtgaacggcgccagctggcacaccgtggccggcagcctgaacgacttcagctacctgcacaccaactgcttcgagctgagcatctacgtgggctgcgacaagtacccccacgagagccagctgcccgaggagtgggagaacaacagagagagcctgatcgtgttcatggagcaggtgcacagaggcatcaagggcctggtgagagacagccacggcaagggcatccccaacgccatcatcagcgtggagggcatcaaccacgacatcagaaccgccaacgacggcgactactggagactgctgaaccccggcgagtacgtggtgaccgccaaggccgagggcttcaccgccagcaccaagaactgcatggtgggctacgacatgggcgccaccagatgcgacttcaccctgagcaagaccaacatggccagaatcagagagatcatggagaagttcggcaagcagcccgtgagcctgcccgccagaagactgaagctgagaggccagaagagaagacagagaggctag

SEQ ID NO: 3545 - DNA, 702 bp, Artificial Sequence
  Description of Artificial Sequence: Synthetic coding sequence
atggccaccccccccttcagactgatcagaaagatgttcagcttcaaggtgagcagatggatgggcctggcctgcttcagaagcctggccgccagcagccccagcatcagacagaagaagctgatgcacaagctgcaggaggagaaggccttcagagaggagatgaagatcttcagagagaagatcgaggacttcagagaggagatgtggaccttcagaggcaagatccacgccttcagaggccagatcctgggcttctgggaggaggagagacccttctgggaggaggagaagaccttctggaaggaggagaagagcttctgggagatggagaagagcttcagagaggaggagaagaccttctggaagaagtacagaaccttctggaaggaggacaaggccttctggaaggaggacaacgccctgtgggagagagacagaaacctgctgcaggaggacaaggccctgtgggaggaggagaaggccctgtgggtggaggagagagccctgctggagggcgagaaggccctgtgggaggacaagaccagcctgtgggaggaggagaacgccctgtgggaggaggagagagccttctggatggagaacaacggccacatcgccggcgagcagatgctggaggacggcccccacaacgccaacagaggccagagactgctggccttcagcagaggcagagcctag

SEQ ID NO: 3546 - DNA, 696 bp, Artificial Sequence
  Description of Artificial Sequence: Synthetic coding sequence
atgatgctgagctgcctgttcctgctgaaggccctgctggccctgggcagcctggagagctggatcaccgccggcgagcacgccaaggagggcgagtgccccccccacaagaacccctgcaaggagctgtgccagggcgacgagctgtgccccgccgagcagaagtgctgcaccaccggctgcggcagaatctgcagagacatccccaagggcagaaagagagactgccccagagtgatcagaaagcagagctgcctgaagagatgcatcaccgacgagacctgccccggcgtgaagaagtgctgcaccctgggctgcaacaagagctgcgtggtgcccatcagcaagcagaagctggccgagttcggcggcgagtgccccgccgaccccctgccctgcgaggagctgtgcgacggcgacgccagctgcccccagggccacaagtgctgcagcaccggctgcggcagaacctgcctgggcgacatcgagggcggcagaggcggcgactgccccaaggtgctggtgggcctgtgcatcgtgggctgcgtgatggacgagaactgccaggccggcgagaagtgctgcaagagcggctgcggcagattctgcgtgccccccgtgctgccccccaagctgaccatgaaccccaactggaccgtgagaagcgacagcgagctggagatccccgtgccctag

SEQ ID NO: 3547 - DNA, 1050 bp, Artificial Sequence
  Description of Artificial Sequence: Synthetic coding sequence
atgggccccatcagcgcccccagctgcagatggagaatcccctggcagggcctgctgctgaccgccagcctgttcaccttctggaacccccccaccaccgcccagctgaccatcgaggccgtgcccagcaacgccgccgagggcaaggaggtgctgctgctggtgcacaacctgccccaggaccccagaggctacaactggtacaagggcgagaccgtggacgccaacagaagaatcatcggctacgtgatcagcaaccagcagatcacccccggccccgcctacagcaacagagagaccatctaccccaacgccagcctgctgatgagaaacgtgaccagaaacgacaccggcagctacaccctgcaggtgatcaagctgaacctgatgagcgaggaggtgaccggccagttcagcgtgcaccccgagacccccaagcccagcatcagcagcaacaacagcaaccccgtggaggacaaggacgccgtggccttcacctgcgagcccgagacccagaacaccacctacctgtggtgggtgaacggccagagcctgcccgtgagccccagactgcagctgagcaacggcaacagaaccctgaccctgctgagcgtgaccagaaacgacgtgggcccctacgagtgcgagatccagaaccccgccagcgccaacttcagcgaccccgtgaccctgaacgtgctgtacggccccgacgcccccaccatcagccccagcgacacctactaccacgccggcgtgaacctgaacctgagctgccacgccgccagcaacccccccagccagtacagctggagcgtgaacggcaccttccagcagtacacccagaagctgttcatccccaacatcaccaccaagaacagcggcagctacgcctgccacaccaccaacagcgccaccggcagaaacagaaccaccgtgagaatgatcaccgtgagcgacgccctggtgcagggcagcagccccggcctgagcgccagagccaccgtgagcatcatgatcggcgtgctggccagagtggccctgatctag

SEQ ID NO: 3548 - DNA, 510 bp, Artificial Sequence
  Description of Artificial Sequence: Synthetic coding sequence
atgaccgccggcagaagaatggagatgctgtgcgccggcagagtgcccgccctgctgctgtgcctgggcttccacctgctgcaggccgtgctgagcaccaccgtgatccccagctgcatccccggcgagagcagcgacaactgcaccgccctggtgcagaccgaggacaaccccagagtggcccaggtgagcatcaccaagtgcagcagcgacatgaacggctactgcctgcacggccagtgcatctacctggtggacatgagccagaactactgcagatgcgaggtgggctacaccggcgtgagatgcgagcacttcttcctgaccgtgcaccagcccctgagcaaggagtacgtggccctgaccgtgatcctgatcatcctgttcctgatcaccgtggtgggcagcacctactacttctgcagatggtacagaaacagaaagagcaaggagcccaagaaggagtacgagagagtgaccagcggcgaccccgagctgccccaggtgtag

SEQ ID NO: 3549 - DNA, 273 bp, Artificial Sequence
  Description of Artificial Sequence: Synthetic coding sequence
atgaagctgagcgtgtgcctgctgctggtgaccctggccctgtgctgctaccaggccaacgccgagttctgccccgccctggtgagcgagctgctggacttcttcttcatcagcgagcccctgttcaagctgagcctggccaagttcgacgccccccccgaggccgtggccgccaagctgggcgtgaagagatgcaccgaccagatgagcctgcagaagagaagcctgatcgccgaggtgctggtgaagatcctgaagaagtgcagcgtgtag

SEQ ID NO: 3550 - DNA, 429 bp, Artificial Sequence
  Description of Artificial Sequence: Synthetic coding sequence
atgcccagatgcagatggctgagcctgatcctgctgaccatccccctggccctggtggccagaaaggaccccaagaagaacgagaccggcgtgctgagaaagctgaagcccgtgaacgccagcaacgccaacgtgaagcagtgcctgtggttcgccatgcaggagtacaacaaggagagcgaggacaagtacgtgttcctggtggtgaagaccctgcaggcccagctgcaggtgaccaacctgctggagtacctgatcgacgtggagatcgccagaagcgactgcagaaagcccctgagcaccaacgagatctgcgccatccaggagaacagcaagctgaagagaaagctgagctgcagcttcctggtgggcgccctgccctggaacggcgagttcaccgtgatggagaagaagtgcgaggacgcctag

SEQ ID NO: 3551 - DNA, 438 bp, Artificial Sequence
  Description of Artificial Sequence: Synthetic coding sequence
atgggcatcggctgctggagaaaccccctgctgctgctgatcgccctggtgctgagcgccaagctgggccacttccagagatgggagggcttccagcagaagctgatgagcaagaagaacatgaacagcaccctgaacttcttcatccagagctacaacaacgccagcaacgacacctacctgtacagagtgcagagactgatcagaagccagatgcagctgaccaccggcgtggagtacatcgtgaccgtgaagatcggctggaccaagtgcaagagaaacgacaccagcaacagcagctgccccctgcagagcaagaagctgagaaagagcctgatctgcgagagcctgatctacaccatgccctggatcaactacttccagctgtggaacaacagctgcctggaggccgagcacgtgggcagaaacctgagatag

SEQ ID NO: 3552 - DNA, 552 bp, Artificial Sequence
  Description of Artificial Sequence: Synthetic coding sequence
atgaagctgctgttccccatcttcgccagcctgatgctgcagtaccaggtgaacaccgagttcatcggcctgagaagatgcctgatgggcctgggcagatgcagagaccactgcaacgtggacgagaaggagatccagaagtgcaagatgaagaagtgctgcgtgggccccaaggtggtgaagctgatcaagaactacctgcagtacggcacccccaacgtgctgaacgaggacgtgcaggagatgctgaagcccgccaagaacagcagcgccgtgatccagagaaagcacatcctgagcgtgctgccccagatcaagagcaccagcttcttcgccaacaccaacttcgtgatcatccccaacgccacccccatgaacagcgccaccatcagcaccatgacccccggccagatcacctacaccgccaccagcaccaagagcaacaccaaggagagcagagacagcgccaccgccagccccccccccgccccccccccccccaacatcctgcccacccccagcctggagctggaggaggccgaggagcagtag

SEQ ID NO: 3553 - DNA, 609 bp, Artificial Sequence
  Description of Artificial Sequence: Synthetic coding sequence
atgagaggccaccccagcctgctgctgctgtacatggccctgaccacctgcctggacaccagccccagcgaggagaccgaccaggaggtgttcctgggcccccccgaggcccagagcttcctgagcagccacaccagaatccccagagccaaccactgggacctggagctgctgacccccggcaacctggagagagagtgcctggaggagagatgcagctgggaggaggccagagagtacttcgaggacaacaccctgaccgagagattctgggagagctacatctacaacggcaagggcggcagaggcagagtggacgtggccagcctggccgtgggcctgaccggcggcatcctgctgatcgtgctggccggcctgggcgccttctggtacctgagatggagacagcacagaggccagcagccctgcccccaggaggccggcctgatcagccccctgagccccctgaaccccctgggcccccccacccccctgccccccccccccccccccccccccggcctgcccacctacgagcaggccctggccgccagcggcgtgcacgacgcccccccccccccctacaccagcctgagaagaccccactag

SEQ ID NO: 3554 - DNA, 558 bp, Artificial Sequence
  Description of Artificial Sequence: Synthetic coding sequence
atgagactgctgatcctgacctgcctggtggccgtggccctggccagacccaagctgcccctgagataccccgagagactgcagaaccccagcgagagcagcgagcccatccccctggagagcagagaggagtacatgaacggcatgaacagacagagaaacatcctgagagagaagcagaccgacgagatcaaggacaccagaaacgagagcacccagaactgcgtggtggccgagcccgagaagatggagagcagcatcagcagcagcagcgaggagatgagcctgagcaagtgcgccgagcagttctgcagactgaacgagtacaaccagctgcagctgcaggccgcccacgcccaggagcagatcagaagaatgaacgagaacagccacgtgcaggtgcccttccagcagctgaaccagctggccgcctacccctacgccgtgtggtactacccccagatcatgcagtacgtgcccttcccccccttcagcgacatcagcaaccccaccgcccacgagaactacgagaagaacaacgtgatgctgcagtggtag

SEQ ID NO: 3555 - DNA, 1410 bp, Artificial Sequence
  Description of Artificial Sequence: Synthetic coding sequence
atgatcaccgagggcgcccaggcccccagactgctgctgccccccctgctgctgctgctgaccctgcccgccaccggcagcgaccccgtgctgtgcttcacccagtacgaggagagcagcggcaagtgcaagggcctgctgggcggcggcgtgagcgtggaggactgctgcctgaacaccgccttcgcctaccagaagagaagcggcggcctgtgccagccctgcagaagccccagatggagcctgtggagcacctgggccccctgcagcgtgacctgcagcgagggcagccagctgagatacagaagatgcgtgggctggaacggccagtgcagcggcaaggtggcccccggcaccctggagtggcagctgcaggcctgcgaggaccagcagtgctgccccgagatgggcggctggagcggctggggcccctgggagccctgcagcgtgacctgcagcaagggcaccagaaccagaagaagagcctgcaaccaccccgcccccaagtgcggcggccactgccccggccaggcccaggagagcgaggcctgcgacacccagcaggtgtgccccacccacggcgcctgggccacctggggcccctggaccccctgcagcgccagctgccacggcggcccccacgagcccaaggagaccagaagcagaaagtgcagcgcccccgagcccagccagaagccccccggcaagccctgccccggcctggcctacgagcagagaagatgcaccggcctgcccccctgccccgtggccggcggctggggcccctggggccccgtgagcccctgccccgtgacctgcggcctgggccagaccatggagcagagaacctgcaaccaccccgtgccccagcacggcggccccttctgcgccggcgacgccaccagaacccacatctgcaacaccgccgtgccctgccccgtggacggcgagtgggacagctggggcgagtggagcccctgcatcagaagaaacatgaagagcatcagctgccaggagatccccggccagcagagcagaggcagaacctgcagaggcagaaagttcgacggccacagatgcgccggccagcagcaggacatcagacactgctacagcatccagcactgccccctgaagggcagctggagcgagtggagcacctggggcctgtgcatgcccccctgcggccccaaccccaccagagccagacagagactgtgcacccccctgctgcccaagtacccccccaccgtgagcatggtggagggccagggcgagaagaacgtgaccttctggggcagacccctgcccagatgcgaggagctgcagggccagaagctggtggtggaggagaagagaccctgcctgcacgtgcccgcctgcaaggaccccgaggaggaggagctgtag

SEQ ID NO: 3556 - DNA, 453 bp, Artificial Sequence
  Description of Artificial Sequence: Synthetic coding sequence
atgctgatcgccaccagcttcttcctgttcttcagcagcgtggtggccgcccccacccacagcagcttctggcagttccagagaagagtgaagcacatcaccggcagaagcgccttcttcagctactacggctacggctgctactgcggcctgggcgacaagggcatccccgtggacgacaccgacagccccagcagccccagcccctacgagaagctgaaggagttcagctgccagcccgtgctgaacagctaccagttccacatcgtgaacggcgccgtggtgtgcggctgcaccctgggccccggcgccagctgccactgcagactgaaggcctgcgagtgcgacaagcagagcgtgcactgcttcaaggagagcctgcccacctacgagaagaacttcaagcagttcagcagccagcccagatgcggcagacacaagccctggtgctag

SEQ ID NO: 3557 - DNA, 1347 bp, Artificial Sequence
  Description of Artificial Sequence: Synthetic coding sequence
atgagagagtgcatcagcgtgcacgtgggccaggccggcgtgcagatgggcaacgcctgctgggagctgtactgcctggagcacggcatccagcccgacggccagatgcccagcgacaagaccatcggcggcggcgacgacagcttcaccaccttcttctgcgagaccggcgccggcaagcacgtgcccagagccgtgttcgtggacctggagcccaccgtgatcgacgagatcagaaacggcccctacagacagctgttccaccccgagcagctgatcaccggcaaggaggacgccgccaacaactacgccagaggccactacaccatcggcaaggagatcatcgaccccgtgctggacagaatcagaaagctgagcgaccagtgcaccggcctgcagggcttcctggtgttccacagcttcggcggcggcaccggcagcggcttcaccagcctgctgatggagagactgagcgtggactacggcaagaagagcaagctggagttcagcatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcagccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgagcgtggccgagatcaccaacgcctgcttcgagcccgccaaccagatggtgaagtgcgaccccagacacggcaagtacatggcctgctgcctgctgtacagaggcgacgtggtgcccaaggacgtgaacgccgccatcgccgccatcaagaccaagagaagcatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacatggccgccctggagaaggactacgaggaggtgggcatcgacagctacgaggacgaggacgagggcgaggagtag

SEQ ID NO: 3558 - DNA, 942 bp, Artificial Sequence
  Description of Artificial Sequence: Synthetic coding sequence
atgagagtggtgaccatcgtgatcctgctgtgcttctgcaaggccgccgagctgagaaaggccagccccggcagcgtgagaagcagagtgaaccacggcagagccggcggcggcagaagaggcagcaaccccgtgaagagatacgcccccggcctgccctgcgacgtgtacacctacctgcacgagaagtacctggactgccaggagagaaagctggtgtacgtgctgcccggctggccccaggacctgctgcacatgctgctggccagaaacaagatcagaaccctgaagaacaacatgttcagcaagttcaagaagctgaagagcctggacctgcagcagaacgagatcagcaagatcgagagcgaggccttcttcggcctgaacaagctgaccaccctgctgctgcagcacaaccagatcaaggtgctgaccgaggaggtgttcatctacacccccctgctgagctacctgagactgtacgacaacccctggcactgcacctgcgagatcgagaccctgatcagcatgctgcagatccccagaaacagaaacctgggcaactacgccaagtgcgagagcccccaggagcagaagaacaagaagctgagacagatcaagagcgagcagctgtgcaacgaggaggagaaggagcagctggaccccaagccccaggtgagcggcagaccccccgtgatcaagcccgaggtggacagcaccttctgccacaactacgtgttccccatccagaccctggactgcaagagaaaggagctgaagaaggtgcccaacaacatcccccccgacatcgtgaagctggacctgagctacaacaagatcaaccagctgagacccaaggagttcgaggacgtgcacgagctgaagaagctgaacctgagcagcaacggcatcgagttcatcgaccccggcagcctgagatag

SEQ ID NO: 3559 - DNA, 972 bp, Artificial Sequence
  Description of Artificial Sequence: Synthetic coding sequence
atgcaggccgcctggctgctgggcgccctggtggtgccccagctgctgggcttcggccacggcgccagaggcgccgagagagagtgggagggcggctggggcggcgcccaggaggaggagagagagagagaggccctgatgctgaagcacctgcaggaggccctgggcctgcccgccggcagaggcgacgagaaccccgccggcaccgtggagggcaaggaggactgggagatggaggaggaccagggcgaggaggaggaggaggaggccacccccacccccagcagcggccccagccccagccccacccccgaggacatcgtgacctacatcctgggcagactggccggcctggacgccggcctgcaccagctgcacgtgagactgcacgccctggacaccagagtggtggagctgacccagggcctgagacagctgagaaacgccgccggcgacaccagagacgccgtgcaggccctgcaggaggcccagggcagagccgagagagagcacggcagactggagggctgcctgaagggcctgagactgggccacaagtgcttcctgctgagcagagacttcgaggcccaggccgccgcccaggccagatgcaccgccagaggcggcagcctggcccagcccgccgacagacagcagatggaggccctgaccagatacctgagagccgccctggccccctacaactggcccgtgtggctgggcgtgcacgacagaagagccgagggcctgtacctgttcgagaacggccagagagtgagcttcttcgcctggcacagaagccccagacccgagctgggcgcccagcccagcgccagcccccaccccctgagccccgaccagcccaacggcggcaccctggagaactgcgtggcccaggccagcgacgacggcagctggtgggaccacgactgccagagaagactgtactacgtgtgcgagttccccttctag

SEQ ID NO: 3560 - DNA, 1086 bp, Artificial Sequence
  Description of Artificial Sequence: Synthetic coding sequence
atgaacggcctgagcctgagcgagctgtgctgcctgttctgctgccccccctgccccggcagaatcgccgccaagctggccttcctgccccccgaggccacctacagcctggtgcccgagcccgagcccggccccggcggcgccggcgccgcccccctgggcaccctgagagccagcagcggcgcccccggcagatggaagctgcacctgaccgagagagccgacttccagtacagccagagagagctggacaccatcgaggtgttccccaccaagagcgccagaggcaacagagtgagctgcatgtacgtgagatgcgtgcccggcgccagacagggccaccaggcccagggcggccacccccagctggcctgggtgggcagactgggcgacagcaacaaccccgcccccggcggctgcctgctgggcaagagctggggcaccggcgccgccctggcctgcggctacatccacctgctggccagatacaccgtgctgttcagccacggcaacgccgtggacctgggccagatgagcagcttctacatcggcctgggcagcagactgcactgcaacatcttcagctacgactacagcggctacggcgccagcagcggcagacccagcgagagaaacctgtacgccgacatcgacgccgcctggcaggccctgagaaccagatacggcatcagccccgacagcatcatcctgtacggccagagcatcggcaccgtgcccaccgtggacctggccagcagatacgagtgcgccgccgtggtgctgcacagccccctgaccagcggcatgagagtggccttccccgacaccaagaagacctactgcttcgacgccttccccaacatcgagaaggtgagcaagatcaccagccccgtgctgatcatccacggcaccgaggacgaggtgatcgacttcagccacggcctggccctgtacgagagatgccccaaggccgtggagcccctgtgggtggagggcgccggccacaacgacatcgagctgtacagccagtacctggagagactgagaagattcatcagccaggagctgcccagccagagagcctag

SEQ ID NO: 3561 - DNA, 1404 bp, Artificial Sequence
  Description of Artificial Sequence: Synthetic coding sequence
atgagaaccgcccccagcctgagaagatgcgtgtgcctgctgctggccgccatcctggacctggccagaggctacctgaccgtgaacatcgagcccctgccccccgtggtggccggcgacgccgtgaccctgaagtgcaacttcaagaccgacggcagaatgagagagatcgtgtggtacagagtgaccgacggcggcaccatcaagcagaagatcttcaccttcgacgccatgttcagcaccaactacagccacatggagaactacagaaagagagaggacctggtgtaccagagcaccgtgagactgcccgaggtgagaatcagcgacaacggcccctacgagtgccacgtgggcatctacgacagagccaccagagagaaggtggtgctggccagcggcaacatcttcctgaacgtgatggccccccccaccagcatcgaggtggtggccgccgacacccccgcccccttcagcagataccaggcccagaacttcaccctggtgtgcatcgtgagcggcggcaagcccgcccccatggtgtacttcaagagagacggcgagcccatcgacgccgtgcccctgagcgagccccccgccgccagcagcggccccctgcaggacagcagacccttcagaagcctgctgcacagagacctggacgacaccaagatgcagaagagcctgagcctgctggacgccgagaacagaggcggcagaccctacaccgagagacccagcagaggcctgacccccgaccccaacatcctgctgcagcccaccaccgagaacatccccgagaccgtggtgagcagagagttccccagatgggtgcacagcgccgagcccacctacttcctgagacacagcagaacccccagcagcgacggcaccgtggaggtgagagccctgctgacctggaccctgaacccccagatcgacaacgaggccctgttcagctgcgaggtgaagcaccccgccctgagcatgcccatgcaggccgaggtgaccctggtggcccccaagggccccaagatcgtgatgacccccagcagagccagagtgggcgacaccgtgagaatcctggtgcacggcttccagaacgaggtgttccccgagcccatgttcacctggaccagagtgggcagcagactgctggacggcagcgccgagttcgacggcaaggagctggtgctggagagagtgcccgccgagctgaacggcagcatgtacagatgcaccgcccagaaccccctgggcagcaccgacacccacaccagactgatcgtgttcgagaaccccaacatccccagaggcaccgaggacagcaacggcagcatcggccccaccggcgccagactgaccctggtgctggccctgaccgtgatcctggagctgacctag

SEQ ID NO: 3562 - DNA, 783 bp, Artificial Sequence
  Description of Artificial Sequence: Synthetic coding sequence
atggccagacccggcatggagagatggagagacagactggccctggtgaccggcgccagcggcggcatcggcgccgccgtggccagagccctggtgcagcagggcctgaaggtggtgggctgcgccagaaccgtgggcaacatcgaggagctggccgccgagtgcaagagcgccggctaccccggcaccctgatcccctacagatgcgacctgagcaacgaggaggacatcctgagcatgttcagcgccatcagaagccagcacagcggcgtggacatctgcatcaacaacgccggcctggccagacccgacaccctgctgagcggcagcaccagcggctggaaggacatgttcaacgtgaacgtgctggccctgagcatctgcaccagagaggcctaccagagcatgaaggagagaaacgtggacgacggccacatcatcaacatcaacagcatgagcggccacagagtgctgcccctgagcgtgacccacttctacagcgccaccaagtacgccgtgaccgccctgaccgagggcctgagacaggagctgagagaggcccagacccacatcagagccacctgcatcagccccggcgtggtggagacccagttcgccttcaagctgcacgacaaggaccccgagaaggccgccgccacctacgagcagatgaagtgcctgaagcccgaggacgtggccgaggccgtgatctacgtgctgagcacccccgcccacatccagatcggcgacatccagatgagacccaccgagcaggtgacctag

SEQ ID NO: 3563 - DNA, 1218 bp, Artificial Sequence
  Description of Artificial Sequence: Synthetic coding sequence
atgagcagccccgccctgaccgccggcgccagcggcaaggtgatggacttcaacaacggcacctacctggtgagcttcaccctgttctgggagggccaggtgagcctgagcctgctgctgatccaccccagcgagggcgccagcgccctgtggagagccagaaaccagggctacgacaagatcatcttcaagggcaagttcgtgaacggcaccagccacgtgttcaccgagtgcggcctgaccctgaacagcaacgccgagctgtgcgagtacctggacgacagagaccaggaggccttctactgcatgaagccccagcacatgccctgcgaggccctgacctacatgaccaccagaaacagagaggtgagctacctgaccgacaaggagaacagcctgttccacagaagcaaggtgggcgtggagatgatgaaggacagaaagcacatcgacgtgaccaactgcaacaagagagagaagatcgaggagacctgccaggtgggcatgaagccccccgtgcccggcggctacaccctgcagggcaagtggatcaccaccttctgcaaccaggtgcagctggacaccatcaagatcaacggctgcctgaagggcaagctgatctacctgctgggcgacagcaccctgagacagtggatctactacttccccaaggtggtgaagaccctgaagttcttcgacctgcacgagaccggcatcttcaagaagcacctgctgctggacgccgagagacacacccagatccagtggaagaagcacagctaccccttcgtgaccttccagctgtacagcctgatcgaccacgactacatccccagagagatcgacagactgagcggcgacaagaacaccgccatcgtgatcaccttcggccagcacttcagacccttccccatcgacatcttcatcagaagagccatcggcgtgcagaaggccatcgagagactgttcctgagaagccccgccaccaaggtgatcatcaagaccgagaacatcagagagatgcacatcgagaccgagagattcggcgacttccacggctacatccactacctgatcatgaaggacatcttcaaggacctgaacgtgggcatcatcgacgcctgggacatgaccatcgcctacggcaccgacaccatccacccccccgaccacgtgatcggcaaccagatcaacatgttcctgaactacatctgctag

SEQ ID NO: 3564 - DNA, 597 bp, Artificial Sequence
  Description of Artificial Sequence: Synthetic coding sequence
atgcccgtgcccgccctgtgcctgctgtgggccctggccatggtgaccagacccgccagcgccgcccccatgggcggccccgagctggcccagcacgaggagctgaccctgctgttccacggcaccctgcagctgggccaggccctgaacggcgtgtacagaaccaccgagggcagactgaccaaggccagaaacagcctgggcctgtacggcagaaccatcgagctgctgggccaggaggtgagcagaggcagagacgccgcccaggagctgagagccagcctgctggagacccagatggaggaggacatcctgcagctgcaggccgaggccaccgccgaggtgctgggcgaggtggcccaggcccagaaggtgctgagagacagcgtgcagagactggaggtgcagctgagaagcgcctggctgggccccgcctacagagagttcgaggtgctgaaggcccacgccgacaagcagagccacatcctgtgggccctgaccggccacgtgcagagacagagaagagagatggtggcccagcagcacagactgagacagatccaggagagactgcacaccgccgccctgcccgcctag

SEQ ID NO: 3565 - DNA, 1455 bp, Artificial Sequence
  Description of Artificial Sequence: Synthetic coding sequence
atggccggcccctggaccttcaccctgctgtgcggcctgctggccgccaccctgatccaggccaccctgagccccaccgccgtgctgatcctgggccccaaggtgatcaaggagaagctgacccaggagctgaaggaccacaacgccaccagcatcctgcagcagctgcccctgctgagcgccatgagagagaagcccgccggcggcatccccgtgctgggcagcctggtgaacaccgtgctgaagcacatcatctggctgaaggtgatcaccgccaacatcctgcagctgcaggtgaagcccagcgccaacgaccaggagctgctggtgaagatccccctggacatggtggccggcttcaacacccccctggtgaagaccatcgtggagttccacatgaccaccgaggcccaggccaccatcagaatggacaccagcgccagcggccccaccagactggtgctgagcgactgcgccaccagccacggcagcctgagaatccagctgctgcacaagctgagcttcctggtgaacgccctggccaagcaggtgatgaacctgctggtgcccagcctgcccaacctggtgaagaaccagctgtgccccgtgatcgaggccagcttcaacggcatgtacgccgacctgctgcagctggtgaaggtgcccatcagcctgagcatcgacagactggagttcgacctgctgtaccccgccatcaagggcgacaccatccagctgtacctgggcgccaagctgctggacagccagggcaaggtgaccaagtggttcaacaacagcgccgccagcctgaccatgcccaccctggacaacatccccttcagcctgatcgtgagccaggacgtggtgaaggccgccgtggccgccgtgctgagccccgaggagttcatggtgctgctggacagcgtgctgcccgagagcgcccacagactgaagagcagcatcggcctgatcaacgagaaggccgccgacaagctgggcagcacccagatcgtgaagatcctgacccaggacacccccgagttcttcatcgaccagggccacgccaaggtggcccagctgatcgtgctggaggtgttccccagcagcgaggccctgagacccctgttcaccctgggcatcgaggccagcagcgaggcccagttctacaccaagggcgaccagctgatcctgaacctgaacaacatcagcagcgacagaatccagctgatgaacagcggcatcggctggttccagcccgacgtgctgaagaacatcatcaccgagatcatccacagcatcctgctgcccaaccagaacggcaagctgagaagcggcgtgcccgtgagcctggtgaaggccctgggcttcgaggccgccgagagcagcctgaccaaggacgccctggtgctgacccccgccagcctgtggaagcccagcagccccgtgagccagtag

SEQ ID NO: 3566 - DNA, 750 bp, Artificial Sequence
  Description of Artificial Sequence: Synthetic coding sequence
atgctgcagctgtggaagctggtgctgctgtgcggcgtgctgaccggcaccagcgagagcctgctggacaacctgggcaacgacctgagcaacgtggtggacaagctggagcccgtgctgcacgagggcctggagaccgtggacaacaccctgaagggcatcctggagaagctgaaggtggacctgggcgtgctgcagaagagcagcgcctggcagctggccaagcagaaggcccaggaggccgagaagctgctgaacaacgtgatcagcaagctgctgcccaccaacaccgacatcttcggcctgaagatcagcaacagcctgatcctggacgtgaaggccgagcccatcgacgacggcaagggcctgaacctgagcttccccgtgaccgccaacgtgaccgtggccggccccatcatcggccagatcatcaacctgaaggccagcctggacctgctgaccgccgtgaccatcgagaccgacccccagacccaccagcccgtggccgtgctgggcgagtgcgccagcgaccccaccagcatcagcctgagcctgctggacaagcacagccagatcatcaacaagttcgtgaacagcgtgatcaacaccctgaagagcaccgtgagcagcctgctgcagaaggagatctgccccctgatcagaatcttcatccacagcctggacgtgaacgtgatccagcaggtggtggacaacccccagcacaagacccagctgcagaccctgatctag

SEQ ID NO: 3567 - DNA, 1959 bp, Artificial Sequence
  Description of Artificial Sequence: Synthetic coding sequence
atgcagggccccctgctgctgcccggcctgtgcttcctgctgagcctgttcggcgccgtgacccagaagaccaagaccagctgcgccaagtgcccccccaacgccagctgcgtgaacaacacccactgcacctgcaaccacggctacaccagcggcagcggccagaagctgttcaccttccccctggagacctgcaacgacatcaacgagtgcacccccccctacagcgtgtactgcggcttcaacgccgtgtgctacaacgtggagggcagcttctactgccagtgcgtgcccggctacagactgcacagcggcaacgagcagttcagcaacagcaacgagaacacctgccaggacaccaccagcagcaagaccaccgagggcagaaaggagctgcagaagatcgtggacaagttcgagagcctgctgaccaaccagaccctgtggagaaccgagggcagacaggagatcagcagcaccgccaccaccatcctgagagacgtggagagcaaggtgctggagaccgccctgaaggaccccgagcagaaggtgctgaagatccagaacgacagcgtggccatcgagacccaggccatcaccgacaactgcagcgaggagagaaagaccttcaacctgaacgtgcagatgaacagcatggacatcagatgcagcgacatcatccagggcgacacccagggccccagcgccatcgccttcatcagctacagcagcctgggcaacatcatcaacgccaccttcttcgaggagatggacaagaaggaccaggtgtacctgaacagccaggtggtgagcgccgccatcggccccaagagaaacgtgagcctgagcaagagcgtgaccctgaccttccagcacgtgaagatgacccccagcaccaagaaggtgttctgcgtgtactggaagagcaccggccagggcagccagtggagcagagacggctgcttcctgatccacgtgaacaagagccacaccatgtgcaactgcagccacctgagcagcttcgccgtgctgatggccctgaccagccaggaggaggaccccgtgctgaccgtgatcacctacgtgggcctgagcgtgagcctgctgtgcctgctgctggccgccctgaccttcctgctgtgcaaggccatcagaaacaccagcaccagcctgcacctgcagctgagcctgtgcctgttcctggcccacctgctgttcctggtgggcatcgacagaaccgagcccaaggtgctgtgcagcatcatcgccggcgccctgcactacctgtacctggccgccttcacctggatgctgctggagggcgtgcacctgttcctgaccgccagaaacctgaccgtggtgaactacagcagcatcaacagactgatgaagtggatcatgttccccgtgggctacggcgtgcccgccgtgaccgtggccatcagcgccgccagctggccccacctgtacggcaccgccgacagatgctggctgcacctggaccagggcttcatgtggagcttcctgggccccgtgtgcgccatcttcagcgccaacctggtgctgttcatcctggtgttctggatcctgaagagaaagctgagcagcctgaacagcgaggtgagcaccatccagaacaccagaatgctggccttcaaggccaccgcccagctgttcatcctgggctgcacctggtgcctgggcctgctgcaggtgggccccgccgcccaggtgatggcctacctgttcaccatcatcaacagcctgcagggcttcttcatcttcctggtgtactgcctgctgagccagcaggtgcagaagcagtaccagaagtggttcagagagatcgtgaagagcaagagcgagagcgagacctacaccctgagcagcaagatgggccccgacagcaagcccagcgagggcgacgtgttccccggccaggtgaagagaaagtactag

SEQ ID NO: 3568 - DNA, 1263 bp, Artificial Sequence
  Description of Artificial Sequence: Synthetic coding sequence
atgagccccccccccctgctgcagcccctgctgctgctgctgcccctgctgaacgtggagcccagcggcgccaccctgatcagaatccccctgcacagagtgcagcccggcagaagaatcctgaacctgctgagaggctggagagagcccgccgagctgcccaagctgggcgcccccagccccggcgacaagcccatcttcgtgcccctgagcaactacagagacgtgcagtacttcggcgagatcggcctgggcacccccccccagaacttcaccgtggccttcgacaccggcagcagcaacctgtgggtgcccagcagaagatgccacttcttcagcgtgccctgctggctgcaccacagattcgaccccaaggccagcagcagcttccaggccaacggcaccaagttcgccatccagtacggcaccggcagagtggacggcatcctgagcgaggacaagctgaccatcggcggcatcaagggcgccagcgtgatcttcggcgaggccctgtgggagcccagcctggtgttcgccttcgcccacttcgacggcatcctgggcctgggcttccccatcctgagcgtggagggcgtgagaccccccatggacgtgctggtggagcagggcctgctggacaagcccgtgttcagcttctacctgaacagagaccccgaggagcccgacggcggcgagctggtgctgggcggcagcgaccccgcccactacatcccccccctgaccttcgtgcccgtgaccgtgcccgcctactggcagatccacatggagagagtgaaggtgggccccggcctgaccctgtgcgccaagggctgcgccgccatcctggacaccggcaccagcctgatcaccggccccaccgaggagatcagagccctgcacgccgccatcggcggcatccccctgctggccggcgagtacatcatcctgtgcagcgagatccccaagctgcccgccgtgagcttcctgctgggcggcgtgtggttcaacctgaccgcccacgactacgtgatccagaccaccagaaacggcgtgagactgtgcctgagcggcttccaggccctggacgtgcccccccccgccggccccttctggatcctgggcgacgtgttcctgggcacctacgtggccgtgttcgacagaggcgacatgaagagcagcgccagagtgggcctggccagagccagaaccagaggcgccgacctgggctggggcgagaccgcccaggcccagttccccggctag

SEQ ID NO: 3569 - DNA, 1293 bp, Artificial Sequence
  Description of Artificial Sequence: Synthetic coding sequence
atggcctggaccttcgagtgcagcagaaccaccagccccgagcccctgagcaccagcccctgcagaaccaccagcagcagaaacagccccaccatgagctgccccgccagcgtggcctgcgagcccagcaccagcaccaccaccagcagcccccccaagctgagcgtggccccccagttcctgcccagaagcctgagagtggccgacctggccgccaaccaggtgatggagatcttccccctgaccttcggcgagaagcccgccctgagaagcgtgtacctgcacaacaaccagctgagcaacgccggcctgccccccgacgccttcagaggcagcgaggccatcgccaccctgagcctgagcaacaaccagctgagctacctgccccccagcctgccccccagcctggagagactgcacctgcagaacaacctgatcagcaaggtgcccagaggcgccctgagcagacagacccagctgagagagctgtacctgcagcacaaccagctgaccgacagcggcctggacgccaccaccttcagcaagctgcacagcctggagtacctggacctgagccacaaccagctgaccaccgtgcccgccggcctgcccagaaccctggccatcctgcacctgggcagaaacagaatcagacaggtggaggccgccagactgcacggcgccagaggcctgagatacctgctgctgcagcacaaccagctgggcagcagcggcctgcccgccggcgccctgagacccctgagaggcctgcacaccctgcacctgtacggcaacggcctggacagagtgccccccgccctgcccagaagactgagagccctggtgctgccccacaaccacgtggccgccctgggcgccagagacctggtggccacccccggcctgaccgagctgaacctggcctacaacagactggccagcgccagagtgcaccacagagccttcagaagactgagagccctgagaagcctggacctggccggcaaccagctgaccagactgcccatgggcctgcccaccggcctgagaaccctgcagctgcagagaaaccagctgagaatgctggagcccgagcccctggccggcctggaccagctgagagagctgagcctggcccacaacagactgagagtgggcgacatcggccccggcacctggcacgagctgcaggccctgcaggtgagacacagactggtgagccacaccgtgcccagagccccccccagcccctgcctgccctgccacgtgcccaacatcctggtgagctggtag

SEQ ID NO: 3570 - DNA, 3162 bp, Artificial Sequence
  Description of Artificial Sequence: Synthetic coding sequence
atgtggcagcccagaagaccctggcccagagtgccctggagatgggccctggccctgctggccctggtgggcgccggcctgtgccacgccggcccccagcccggctaccccgccagacccagcgccagaaacaagaactggtgcgcctacatcgtgaacaagaacgtgagctgcagcgtgctggagggcagcgagagcttcatccaggcccagtacaactgcgcctggaaccagatgccctgccccagcgccctggtgtacagagtgaacttcagacccagatacgtgaccagatacaagaccgtgacccagctggagtggagatgctgccccggcttcagaggcggcgactgccaggagggccccaaggaccccgtgaagaccctgagacccacccccgccagacccagaaacagcctgaagaaggccaccgacaacgagcccagccagttcagcgagcccagaaagaccctgagccccaccggcaccgcccagcccagctggggcgtggaccccaaggagggcccccaggagctgcaggagaagaagatccaggtgctggaggagaaggtgctgagactgaccagaaccgtgctggacctgcagagcagcctggccggcgtgagcgagaacctgaagcacgccacccaggacgacgccagcagaaccagagcccccggcctgagcagccagcaccccaagcccgacaccaccgtgagcggcgacaccgagaccggccagagccccggcgtgttcaacaccaaggagagcggcatgaaggacatcaagagcgagctggccgaggtgaaggacaccctgaagaacaagagcgacaagctggaggagctggacggcaaggtgaagggctacgagggccagctgagacagctgcaggaggccgcccagggccccaccgtgaccatgaccaccaacgagctgtaccaggcctacgtggacagcaagatcgacgccctgagagaggagctgatggagggcatggacagaaagctggccgacctgaagaacagctgcgagtacaagctgaccggcctgcagcagcagtgcgacgactacggcagcagctacctgggcgtgatcgagctgatcggcgagaaggagaccagcctgagaaaggagatcaacaacctgagagccagactgcaggagcccagcgcccaggccaactgctgcgacagcgagaagaacggcgacatcggccagcagatcaagaccctggaccagaagatcgagagagtggccgaggccaccagaatgctgaacggcagactggacaacgagttcgacagactgatcgtgcccgagcccgacgtggacttcgacgccaagtggaacgagctggacgccagaatcaacgtgaccgagaagaacgccgaggagcactgcttctacatcgaggagaccctgagaggcgccatcaacggcgaggtgggcgacctgaagcagctggtggaccagaagatccagagcctggaggacagactgggcagcgtgctgctgcagatgaccaacaacaccggcgccgagctgagcccccccggcgccgccgccctgcccggcgtgagcggcagcggcgacgagagagtgatgatggagctgaaccacctgaaggacaaggtgcaggtggtggaggacatctgcctgctgaacatccagggcaagccccacggcatggagggcgccctgcccaacagagaggacagagccgtgagagacagcctgcacctgctgaagagcctgaacgacaccatgcacagaaagttccaggagaccgagcagaccatccagaagctgcagcaggacttcagcttcctgtacagccagctgaaccacaccgagaacgacgtgacccacctgcagaaggagatgagcaactgcagagccggcgagaacgccggcatgggcagattcaccaaggtgggcgagcaggagagaaccgtggacaccctgcccagcccccagcaccccgtggcccactgctgcagccagctggaggagagatggcagagactgcagagccaggtgatcagcgagctggacgcctgcaaggagtgcacccagggcgtgcagagagaggtgagcatggtggagggcagagtgagccacatggagaagacctgcagcaagctggacagcatcagcggcaacctgcagagaatcaaggagggcctgaacaagcacgtgagcagcctgtggaactgcgtgagacagatgaacggcaccctgagaagccacagcagagacatcagcggcctgaagaacagcgtgcagcagttctacagccacgtgttccagatcagcaccgacctgcaggacctggtgaagttccagcccagcgccaaggcccccagcccccccccccccgccgaggcccccaaggagcccctgcagcccgagcccgccccccccagacccagcggccccgccaccgccgaggaccccggcagaagacccgtgctgccccagagaccccccgaggagagacccccccagccccccggcagcaccggcgtgatcgccgagaccggccaggccggcccccccgccggcgccggcgtgagcggcagaggcctgcccagaggcgtggacggccagaccggcagcggcaccgtgcccggcgccgagggcttcgccggcgcccccggctaccccaagagcccccccgtggccagccccggcgcccccgtgcccagcctggtgagcttcagcgccggcctgacccagaagcccttccccagcgacggcggcgtggtgctgttcaacaaggtgctggtgaacgacggcgacgtgtacaaccccagcaccggcgtgttcaccgccccctacgacggcagatacctgatcaccgccaccctgacccccgagagagacgcctacgtggaggccgtgctgagcgtgagcaacgccagcgtggcccagctgcacaccgccggctacagaagagagttcctggagtaccacagaccccccggcgccctgcacacctgcggcggccccggcgccttccacctgatcgtgcacctgaaggccggcgacgccgtgaacgtggtggtgaccggcggcaagctggcccacaccgacttcgacgagatgtacagcaccttcagcggcgtgttcctgtaccccttcctgagccacctgtag

SEQ ID NO: 3571 - DNA, 1548 bp, Artificial Sequence
  Description of Artificial Sequence: Synthetic coding sequence
atggcccagctgttcctgcccctgctggccgccctggtgctggcccaggcccccgccgccctggccgacgtgctggagggcgacagcagcgaggacagagccttcagagtgagaatcgccggcgacgcccccctgcagggcgtgctgggcggcgccctgaccatcccctgccacgtgcactacctgagacccccccccagcagaagagccgtgctgggcagccccagagtgaagtggaccttcctgagcagaggcagagaggccgaggtgctggtggccagaggcgtgagagtgaaggtgaacgaggcctacagattcagagtggccctgcccgcctaccccgccagcctgaccgacgtgagcctggccctgagcgagctgagacccaacgacagcggcatctacagatgcgaggtgcagcacggcatcgacgacagcagcgacgccgtggaggacagccagctgtaccccatccagacccccagagaggcctgctacggcgacatggacggcttccccggcgtgagaaactacggcgtggtggaccccgacgacctgtacgacgtgtactgctacgccgaggacctgaacggcgagctgttcctgggcgacccccccgagaagctgaccctggaggaggccagagcctactgccaggagagaggcgccgagatcgccaccaccggccagctgtacgccgcctgggacggcggcctggaccactgcagccccggctggctggccgacggcagcgtgagataccccatcgtgacccccagccagagatgcggcggcggcctgcccggcgtgaagaccctgttcctgttccccaaccagaccggcttccccaacaagcacagcagattcaacgtgtactgcttcagaggcagcacctgcctgctgcccagcctgagaccccccacccagccccccacccaggacggcctggaggccatcgtgaccgtgaccgagaccctggaggagctgcagctgccccaggaggccaccgagagcgagagcagaggcgccatctacagcatccccatcatggaggacggcggcggcggcagcagcacccccgaggaccccgccgaggcccccagaaccctgctggagttcgagacccagagcatggtgccccccaccggcttcagcgaggaggagggcaaggccctggaggaggaggagaagtacgaggacgaggaggagaaggaggaggaggaggaggaggaggaggtggaggacgaggccctgtgggcctggcccagcgagctgagcagccccggccccgaggccagcctgcccaccgagcccgccgcccaggaggagagcctgagccaggcccccgccagagccgtgctgcagcccggcgccagccccctgcccgacggcgagagcgaggccagcagaccccccagagtgcacggcccccccaccgagaccctgcccacccccagagagagaaacctggccagccccagccccagcaccctggtggaggccagagaggtgggcgaggccaccggcggccccgagctgagcggctag

SEQ ID NO: 3572 - DNA, 1023 bp, Artificial Sequence
  Description of Artificial Sequence: Synthetic coding sequence
atgcccggctggctgaccctgcccaccctgtgcagattcctgctgtgggccttcaccatcttccacaaggcccagggcgaccccgccagccaccccggcccccactacctgctgccccccatccacgaggtgatccacagccacagaggcgccaccgccaccctgccctgcgtgctgggcaccaccccccccagctacaaggtgagatggagcaaggtggagcccggcgagctgagagagaccctgatcctgatcaccaacggcctgcacgccagaggctacggccccctgggcggcagagccagaatgagaagaggccacagactggacgccagcctggtgatcgccggcgtgagactggaggacgagggcagatacagatgcgagctgatcaacggcatcgaggacgagagcgtggccctgaccctgagcctggagggcgtggtgttcccctaccagcccagcagaggcagataccagttcaactactacgaggccaagcaggcctgcgaggagcaggacggcagactggccacctacagccagctgtaccaggcctggaccgagggcctggactggtgcaacgccggctggctgctggagggcagcgtgagataccccgtgctgaccgccagagccccctgcggcggcagaggcagacccggcatcagaagctacggccccagagacagaatgagagacagatacgacgccttctgcttcaccagcgccctggccggccaggtgttcttcgtgcccggcagactgaccctgagcgaggcccacgccgcctgcagaagaagaggcgccgtggtggccaaggtgggccacctgtacgccgcctggaagttcagcggcctggaccagtgcgacggcggctggctggccgacggcagcgtgagattccccatcaccacccccagacccagatgcggcggcctgcccgaccccggcgtgagaagcttcggcttccccagaccccagcaggccgcctacggcacctactgctacgccgagaactag

SEQ ID NO: 3573 - DNA, 690 bp, Artificial Sequence
  Description of Artificial Sequence: Synthetic coding sequence
atggacctgctgcagttcctggccttcctgttcgtgctgctgctgagcggcatgggcgccaccggcaccctgagaaccagcctggaccccagcctggagatctacaagaagatgttcgaggtgaagagaagagagcagctgctggccctgaagaacctggcccagctgaacgacatccaccagcagtacaagatcctggacgtgatgctgaagggcctgttcaaggtgctggaggacagcagaaccgtgctgaccgccgccgacgtgctgcccgacggccccttcccccaggacgagaagctgaaggacgccttcagccacgtggtggagaacaccgccttcttcggcgacgtggtgctgagattccccagaatcgtgcactactacttcgaccacaacagcaactggaacctgctgatcagatggggcatcagcttctgcaaccagaccggcgtgttcaaccagggcccccacagccccatcctgagcctgatggcccaggagctgggcatcagcgagaaggacagcaacttccagaaccccttcaagatcgacagaaccgagttcatccccagcaccgaccccttccagaaggccctgagagaggaggagaagagaagaaagaaggaggagaagagaaaggagatcagaaagggccccagaatcagcagaagccagagcgagctgtag

SEQ ID NO: 3574 - DNA, 465 bp, Artificial Sequence
  Description of Artificial Sequence: Synthetic coding sequence
atgagcgtgggcaccagcctggagcaggcccagatgagcaccctgacctgccccctgttcatccccaccgtgggcagaaagaccgccctgcacagcggcgaggacttccagaccctgctgttcgagagagtgttcgtgaacctggacggctgcttcgacatggccaccggccagttcgccgcccccctgagaggcatctacttcttcagcctgaacgtgcacagctggaactacaaggagacctacgtgcacatcatgcacaaccagaaggaggccgtgatcctgtacgcccagcccagcgagagaagcatcatgcagagccagagcgtgatgctggacctggcctacggcgacagagtgtgggtgagactgttcaagagacagagagagaacgccatctacagcaacgacttcgacacctacatcaccttcagcggccacctgatcaaggccgaggacgactag

SEQ ID NO: 3575 - DNA, 900 bp, Artificial Sequence
  Description of Artificial Sequence: Synthetic coding sequence
atgagaagcgtgggcgagggcgccagagagtggatcagagagtgccagcaccagttcagacaccacagatggaactgcaccaccctggacagagaccacaccgtgttcggcagagtgatgctgagaagcagcagagaggccgccttcgtgtacgccatcagcagcgccggcgtggtgcacgccatcaccagagcctgcagccagggcgagctgagcgtgtgcagctgcgacccctacaccagaggcagacaccacgaccagagaggcgacttcgactggggcggctgcagcgacaacatccactacggcgtgagattcgccaaggccttcgtggacgccaaggagaagagactgaaggacgccagagccctgatgaacctgcacaacaacagatgcggcagaaccgccgtgagaagattcctgaagctggagtgcaagtgccacggcgtgagcggcagctgcaccctgagaacctgctggagagccctgagcgacttcagaagaaccggcgactacctgagaagaagatacgacggcgccgtgcaggtgatggccacccaggacggcgccaacttcaccgccgccagacagggctacagaagagccaccagaaccgacctggtgtacttcgacaacagccccgactactgcgtgctggacaaggccgccggcagcctgggcaccgccggcagagtgtgcagcaagaccagcaagggcaccgacggctgcgagatcatgtgctgcggcagaggctacgacaccaccagagtgaccagagtgacccagtgcgagtgcaagttccactggtgctgcgccgtgagatgcaaggagtgcagaaacaccgtggacgtgcacacctgcaaggcccccaagaaggccgagtggctggaccagacctag

SEQ ID NO: 3576 - DNA, 1710 bp, Artificial Sequence
  Description of Artificial Sequence: Synthetic coding sequence
atgctgctgctgttcagcgtgatcctgatcagctgggtgagcaccgtgggcggcgagggcaccctgtgcgacttccccaagatccaccacggcttcctgtacgacgaggaggactacaaccccttcagccaggtgcccaccggcgaggtgttctactacagctgcgagtacaacttcgtgagccccagcaagagcttctggaccagaatcacctgcaccgaggagggctggagccccacccccaagtgcctgagaatgtgcagcttccccttcgtgaagaacggccacagcgagagcagcggcctgatccacctggagggcgacaccgtgcagatcatctgcaacaccggctacagcctgcagaacaacgagaagaacatcagctgcgtggagagaggctggagcaccccccccatctgcagcttcaccaagggcgagtgccacgtgcccatcctggaggccaacgtggacgcccagcccaagaaggagagctacaaggtgggcgacgtgctgaagttcagctgcagaaagaacctgatcagagtgggcagcgacagcgtgcagtgctaccagttcggctggagccccaacttccccacctgcaagggccaggtgagaagctgcggcccccccccccagctgagcaacggcgaggtgaaggagatcagaaaggaggagtacggccacaacgaggtggtggagtacgactgcaaccccaacttcatcatcaacggccccaagaagatccagtgcgtggacggcgagtggaccaccctgcccacctgcgtggagcaggtgaagacctgcggctacatccccgagctggagtacggctacgtgcagcccagcgtgcccccctaccagcacggcgtgagcgtggaggtgaactgcagaaacgagtacgccatgatcggcaacaacatgatcacctgcatcaacggcatctggaccgagctgcccatgtgcgtggccacccaccagctgaagagatgcaagatcgccggcgtgaacatcaagaccctgctgaagctgagcggcaaggagttcaaccacaacagcagaatcagatacagatgcagcgacatcttcagatacagacacagcgtgtgcatcaacggcaagtggaaccccgaggtggactgcaccgagaagagagagcagttctgccccccccccccccagatccccaacgcccagaacatgaccaccaccgtgaactaccaggacggcgagaaggtggccgtgctgtgcaaggagaactacctgctgcccgaggccaaggagatcgtgtgcaaggacggcagatggcagagcctgcccagatgcgtggagagcaccgcctactgcggccccccccccagcatcaacaacggcgacaccaccagcttccccctgagcgtgtacccccccggcagcaccgtgacctacagatgccagagcttctacaagctgcagggcagcgtgaccgtgacctgcagaaacaagcagtggagcgagccccccagatgcctggacccctgcgtggtgagcgaggagaacatgaacaagaacaacatccagctgaagtggagaaacgacggcaagctgtacgccaagaccggcgacgccgtggagttccagtgcaagttcccccacaaggccatgatcagcagcccccccttcagagccatctgccaggagggcaagttcgagtaccccatctgcgagtag

SEQ ID NO: 3577 - DNA, 351 bp, Artificial Sequence
  Description of Artificial Sequence: Synthetic coding sequence
atgaagggcctgagaagcctggccgccaccaccctggccctgttcctggtgttcgtgttcctgggcaacagcagctgcgccccccagagactgctggagagaagaaactggaccccccaggccatgctgtacctgaagggcgcccagggcagaagattcatcagcgaccagagcagaagaaaggacctgagcgacagacccctgcccgagagaagaagccccaacccccagctgctgaccatccccgaggccgccaccatcctgctggccagcctgcagaagagccccgaggacgaggagaagaacttcgaccagaccagattcctggaggacagcctgctgaactggtag

SEQ ID NO: 3578 - DNA, 192 bp, Artificial Sequence
  Description of Artificial Sequence: Synthetic coding sequence
atgaagcacgtgctgaacctgtacctgctgggcgtggtgctgaccctgctgagcatcttcgtgagagtgatggagagcctggagggcctgctggagagccccagccccggcaccagctggaccaccagaagccagctggccaacaccgagcccaccaagggcctgcccgaccaccccagcagaagcatgtag

SEQ ID NO: 3579 - DNA, 567 bp, Artificial Sequence
  Description of Artificial Sequence: Synthetic coding sequence
atggtgcccggcgccgccggctggtgctgcctggtgctgtggctgcccgcctgcgtggccgcccacggcttcagaatccacgactacctgtacttccaggtgctgagccccggcgacatcagatacatcttcaccgccacccccgccaaggacttcggcggcatcttccacaccagatacgagcagatccacctggtgcccgccgagccccccgaggcctgcggcgagctgagcaacggcttcttcatccaggaccagatcgccctggtggagagaggcggctgcagcttcctgagcaagaccagagtggtgcaggagcacggcggcagagccgtgatcatcagcgacaacgccgtggacaacgacagcttctacgtggagatgatccaggacagcacccagagaaccgccgacatccccgccctgttcctgctgggcagagacggctacatgatcagaagaagcctggagcagcacggcctgccctgggccatcatcagcatccccgtgaacgtgaccagcatccccaccttcgagctgctgcagcccccctggaccttctggtag

SEQ ID NO: 3580 - DNA, 2559 bp, Artificial Sequence
  Description of Artificial Sequence: Synthetic coding sequence
atgaagcccatgctgaaggacttcagcaacctgctgctggtggtgctgtgcgactacgtgctgggcgaggccgagtacctgctgctgagagagcccggccacgtggccctgagcaacgacaccgtgtacgtggacttccagtacttcgacggcgccaacggcaccctgagaaacgtgagcgtgctgctgctggaggccaacaccaaccagaccgtgaccaccaagtacctgctgaccaaccagagccagggcaccctgaagttcgagtgcttctacttcaaggaggccggcgactactggttcaccatgacccccgaggccaccgacaacagcacccccttcccctggtgggagaagagcgccttcctgaaggtggagtggcccgtgttccacgtggacctgaacagaagcgccaaggccgccgagggcaccttccaggtgggcctgttcaccagccagcccctgtgccccttccccgtggacaagcccaacatcgtggtggacgtgatcttcaccaacagcctgcccgaggccagaagaaacagcagacagcccctggagatcagaaccagcaagagaaccgagctggcccagggccagtgggtggagttcggctgcgcccccctgggccccgaggcctacgtgaccgtggtgctgaagctgctgggcagagacagcgtgatcaccagcaccggccccatcgacctggcccagaagttcggctacaagctggtgatggtgcccgagctgacctgcgagagcggcgtggaggtgaccgtgctgccccccccctgcaccttcgtgcagggcgtggtgaccgtgttcaaggaggcccccagataccccggcaagagaaccatccacctggccgagaacagcctgcccctgggcgagagaagaaccatcttcaactgcaccctgttcgacatgggcaagaacaagtactgcttcgacttcggcatcagcagcagaagccacttcagcgccaaggaggagtgcatgctgatccagagaaacaccgagacctggggcctgtggcagccctggagccagtgcagcgccacctgcggcgacggcgtgagagagagaagaagagtgtgcctgaccagcttccccagcagccccgtgtgccccggcatgagcctggaggccagcctgtgcagcctggaggagtgcgccgccttccagcccagcagccccagccccctgcagccccagggccccgtgaagagcaacaacatcgtgaccgtgaccggcatcagcctgtgcctgttcatcatcatcgccaccgtgctgatcaccctgtggagaagattcggcagacccgccaagtgcagcacccccgccagacacaacagcatccacagccccagcttcagaaagaacagcgacgaggagaacatctgcgagctgagcgagcagagaggcagcttcagcgacggcggcgacggccccaccggcagccccggcgacaccggcatccccctgacctacagaagaagcggccccgtgccccccgaggacgacgccagcggcagcgagagcttccagagcaacgcccagaagatcatcccccccctgttcagctacagactggcccagcagcagctgaaggagatgaagaagaagggcctgaccgagaccaccaaggtgtaccacgtgagccagagccccctgaccgacaccgccatcgacgccgcccccagcgcccccctggacctggagagccccgaggaggccgccgccaacaagttcagaatcaagagccccttccccgagcagcccgccgtgagcgccggcgagagaccccccagcagactggacctgaacgtgacccaggccagctgcgccatcagccccagccagaccctgatcagaaagagccaggccagacacgtgggcagcagaggcggccccagcgagagaagccacgccagaaacgcccacttcagaagaaccgccagcttccacgaggccagacaggccagacccttcagagagagaagcatgagcaccctgacccccagacaggcccccgcctacagcagcagaaccagaacctgcgagcaggccgaggacagattcagaccccagagcagaggcgcccacctgttccccgagaagctggagcacttccaggaggccagcggcaccagaggccccctgaaccccctgcccaagagctacaccctgggccagcccctgagaaagcccgacctgggcgaccaccaggccggcctggtggccggcatcgagagaaccgagccccacagagccagaagaggccccagccccagccacaagagcgtgagcagaaagcagagcagccccatcagccccaaggacaactaccagagagtgagcagcctgagccccagccagtgcagaaaggacaagtgccagagcttccccacccaccccgagttcgccttctacgacaacaccagcttcggcctgaccgaggccgagcagagaatgctggacctgcccggctacttcggcagcaacgaggaggacgagaccaccagcaccctgagcgtggagaagctggtgatctag

SEQ ID NO: 3581 - DNA, 369 bp, Artificial Sequence
  Description of Artificial Sequence: Synthetic coding sequence
atgggcttccacttctgcatctggatcatcttcctgctgccccccccctgcaagaagtgcctgagcccccccaccatgaacctgagaccccccaagagctgcggcaacgtgttctactgggtgctggtgctgaacagcggcctgctgtacaagttctgccagaccatcaagtgcagagccaactggagacccgccagagcccccagaggctggaacgaggccaccgagagacaccaggagagaagaacccagatggagaccgagatgggcggcatcagcaccacctactggcacagactgtgcacctgcaccgacagaagagccgagaagctggtgatggacggcaacaactgctggttccacaagtag

SEQ ID NO: 3582 - DNA, 978 bp, Artificial Sequence
  Description of Artificial Sequence: Synthetic coding sequence
atgcagggcagagtggccggcagctgcgcccccctgggcctgctgctggtgtgcctgcacctgcccggcctgttcgccagaagcatcggcgtggtggaggagaaggtgagccagaacctgggcaccaacctgccccagctgggccagcccagcagcaccggccccagcaacagcgagcacccccagcccgccctggaccccagaagcaacgacctggccagagtgcccctgaagctgagcgtgcccgccagcgacggcttcccccccgccggcggcagcgccgtgcagagatggccccccagctggggcctgcccgccatggacagctggccccccgaggacccctggcagatgatggccgccgccgccgaggacagactgggcgaggccctgcccgaggagctgagctacctgagcagcgccgccgccctggcccccggcagcggccccctgcccggcgagagcagccccgacgccaccggcctgagccccaaggccagcctgctgcaccaggacagcgagagcagaagactgcccagaagcaacagcctgggcgccggcggcaagatcctgagccagagacccccctggagcctgatccacagagtgctgcccgaccacccctggggcaccctgaaccccagcgtgagctggggcggcggcggccccggcaccggctggggcaccagacccatgccccaccccgagggcatctggggcatcaacaaccagccccccggcaccagctggggcaacatcaacagataccccggcggcagctggggcaacatcaacagataccccggcggcagctggggcaacatcaacagataccccggcggcagctggggcaacatccacctgtaccccggcatcaacaaccccttcccccccggcgtgctgagaccccccggcagcagctggaacatccccgccggcttccccaacccccccagccccagactgcagtggggctag

SEQ ID NO: 3583 - DNA, 2631 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctacgtggagatggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggccgagagaagagtgctggaggaggagctgaccgtgcacctgagcgtgcccggcgacaccatcctgatcaacaacagacccggccccagagagccccccccctaccaggagcccagacccagaggcaaccccccccacagcgccccctgcgtgcccaacggcagcgcctacagcggcgactacatggagcccgagaagcccggcgcccccctgctgcccccccccccccagaacagcgtgccccactacgccgaggccgacatcgtgaccctgcagggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaacttcgtgcacagagacctggccaccagaaactgcctggtgggcgagaacttcaccatcaagatcgccgacttcggcatgagcagaaacctgtacgccggcgactactacagagtgcagggcagagccgtgctgcccatcagatggatggcctgggagtgcatcctgatgggcaagttcaccaccgccagcgacgtgtgggccttcggcgtgaccctgtgggaggtgctgatgctgtgcagagcccagcccttcggccagctgaccgacgagcaggtgatcgagaacgccggcgagttcttcagagaccagggcagacaggtgtacctgagcagaccccccgcctgcccccagggcctgtacgagctgatgctgagatgctggagcagagagagcgagcagagaccccccttcagccagctgcacagattcctggccgaggacgccctgaacaccgtgtag

SEQ ID NO: 3584 - DNA, 672 bp, Artificial Sequence
  Description of Artificial Sequence: Synthetic coding sequence
atgaagttcgtgccctgcctgctgctggtgaccctgagctgcctgggcaccctgggccaggcccccagacagaagcagggcagcaccggcgaggagttccacttccagaccggcggcagagacagctgcaccatgagacccagcagcctgggccagggcgccggcgaggtgtggctgagagtggactgcagaaacaccgaccagacctactggtgcgagtacagaggccagcccagcatgtgccaggccttcgccgccgaccccaagccctactggaaccaggccctgcaggagctgagaagactgcaccacgcctgccagggcgcccccgtgctgagacccagcgtgtgcagagaggccggcccccaggcccacatgcagcaggtgaccagcagcctgaagggcagccccgagcccaaccagcagcccgaggccggcacccccagcctgagacccaaggccaccgtgaagctgaccgaggccacccagctgggcaaggacagcatggaggagctgggcaaggccaagcccaccaccagacccaccgccaagcccacccagcccggccccagacccggcggcaacgaggaggccaagaagaaggcctgggagcactgctggaagcccttccaggccctgtgcgccttcctgatcagcttcttcagaggctag

SEQ ID NO: 3585 - DNA, 585 bp, Artificial Sequence
  Description of Artificial Sequence: Synthetic coding sequence
atgaccatgagacacaactggacccccgacctgagccccctgtgggtgctgctgctgtgcgcccacgtggtgaccctgctggtgagagccacccccgtgagccagaccaccaccgccgccaccgccagcgtgagaagcaccaaggacccctgccccagccagccccccgtgttccccgccgccaagcagtgccccgccctggaggtgacctggcccgaggtggaggtgcccctgaacggcaccctgagcctgagctgcgtggcctgcagcagattccccaacttcagcatcctgtactggctgggcaacggcagcttcatcgagcacctgcccggcagactgtgggagggcagcaccagcagagagagaggcagcaccggcacccagctgtgcaaggccctggtgctggagcagctgacccccgccctgcacagcaccaacttcagctgcgtgctggtggaccccgagcaggtggtgcagagacacgtggtgctggcccagctgtgggccggcctgagagccaccctgccccccacccaggaggccctgcccagcagccacagcagcccccagcagcagggctag

SEQ ID NO: 3586 - DNA, 777 bp, Artificial Sequence
  Description of Artificial Sequence: Synthetic coding sequence
atgatcgccatcagcgccgtgagcagcgccctgctgttcagcctgctgtgcgaggccagcaccgtggtgctgctgaacagcaccgacagcagcccccccaccaacaacttcaccgacatcgaggccgccctgaaggcccagctggacagcgccgacatccccaaggccagaagaaagagatacatcagccagaacgacatgatcgccatcctggactaccacaaccaggtgagaggcaaggtgttcccccccgccgccaacatggagtacatggtgtgggacgagaacctggccaagagcgccgaggcctgggccgccacctgcatctgggaccacggccccagctacctgctgagattcctgggccagaacctgagcgtgagaaccggcagatacagaagcatcctgcagctggtgaagccctggtacgacgaggtgaaggactacgccttcccctacccccaggactgcaaccccagatgccccatgagatgcttcggccccatgtgcacccactacacccagatggtgtgggccaccagcaacagaatcggctgcgccatccacacctgccagaacatgaacgtgtggggcagcgtgtggagaagagccgtgtacctggtgtgcaactacgcccccaagggcaactggatcggcgaggccccctacaaggtgggcgtgccctgcagcagctgcccccccagctacggcggcagctgcaccgacaacctgtgcttccccggcgtgaccagcaactacctgtactggttcaagtag

SEQ ID NO: 3587 - DNA, 906 bp, Artificial Sequence
  Description of Artificial Sequence: Synthetic coding sequence
atgctgcccctgaccatgaccgtgctgatcctgctgctgctgcccaccggccaggccgcccccaaggacggcgtgaccagacccgacagcgaggtgcagcaccagctgctgcccaaccccttccagcccggccaggagcagctgggcctgctgcagagctacctgaagggcctgggcagaaccgaggtgcagctggagcacctgagcagagagcaggtgctgctgtacctgttcgccctgcacgactacgaccagagcggccagctggacggcctggagctgctgagcatgctgaccgccgccctggcccccggcgccgccaacagccccaccaccaaccccgtgatcctgatcgtggacaaggtgctggagacccaggacctgaacggcgacggcctgatgacccccgccgagctgatcaacttccccggcgtggccctgagacacgtggagcccggcgagcccctggcccccagcccccaggagccccaggccgtgggcagacagagcctgctggccaagagccccctgagacaggagacccaggaggcccccggccccagagaggaggccaagggccaggtggaggccagaagagagagcctggaccccgtgcaggagcccggcggccaggccgaggccgacggcgacgtgcccggccccagaggcgaggccgagggccaggccgaggccaagggcgacgcccccggccccagaggcgaggccggcggccaggccgaggccgagggcgacgcccccggccccagaggcgaggccggcggccaggccgaggccagagagaacggcgaggaggccaaggagctgcccggcgagaccctggagagcaagaacacccagaacgacttcgaggtgcacatcgtgcaggtggagaacgacgagatctag

SEQ ID NO: 3588 - DNA, 969 bp, Artificial Sequence
  Description of Artificial Sequence: Synthetic coding sequence
atgaagaccctggccggcctggtgctgggcctggtgatcttcgacgccgccgtgaccgcccccaccctggagagcatcaactacgacagcgagacctacgacgccaccctggaggacctggacaacctgtacaactacgagaacatccccgtggacaaggtggagatcgagatcgccaccgtgatgcccagcggcaacagagagctgctgaccccccccccccagcccgagaaggcccaggaggaggaggaggaggaggagagcacccccagactgatcgacggcagcagcccccaggagcccgagttcaccggcgtgctgggcccccacaccaacgaggacttccccacctgcctgctgtgcacctgcatcagcaccaccgtgtactgcgacgaccacgagctggacgccatcccccccctgcccaagaacaccgcctacttctacagcagattcaacagaatcaagaagatcaacaagaacgacttcgccagcctgagcgacctgaagagaatcgacctgaccagcaacctgatcagcgagatcgacgaggacgccttcagaaagctgccccagctgagagagctggtgctgagagacaacaagatcagacagctgcccgagctgcccaccaccctgaccttcatcgacatcagcaacaacagactgggcagaaagggcatcaagcaggaggccttcaaggacatgtacgacctgcaccacctgtacctgaccgacaacaacctggaccacatccccctgcccctgcccgagaacctgagagccctgcacctgcagaacaacaacatcctggagatgcacgaggacaccttctgcaacgtgaagaacctgacctacatcagaaaggccctggaggacatcagactggacggcaaccccatcaacctgagcaagaccccccaggcctacatgtgcctgcccagactgcccgtgggcagcctggtgtag

SEQ ID NO: 3589 - DNA, 618 bp, Artificial Sequence
  Description of Artificial Sequence: Synthetic coding sequence
atggtgaacctggccgccatggtgtggagaagactgctgagaaagagatgggtgctggccctggtgttcggcctgagcctggtgtacttcctgagcagcaccttcaagcaggaggagagagccgtgagagacagaaacctgctgcaggtgcacgaccacaaccagcccatcccctggaaggtgcagttcaacctgggcaacagcagcagacccagcaaccagtgcagaaacagcatccagggcaagcacctgatcaccgacgagctgggctacgtgtgcgagagaaaggacctgctggtgaacggctgctgcaacgtgaacgtgcccagcaccaagcagtactgctgcgacggctgctggcccaacggctgctgcagcgcctacgagtactgcgtgagctgctgcctgcagcccaacaagcagctgctgctggagagattcctgaacagagccgccgtggccttccagaacctgttcatggccgtggaggaccacttcgagctgtgcctggccaagtgcagaaccagcagccagagcgtgcagcacgagaacacctacagagaccccatcgccaagtactgctacggcgagagcccccccgagctgttccccgcctag

SEQ ID NO: 3590 - DNA, 3057 bp, Artificial Sequence
  Description of Artificial Sequence: Synthetic coding sequence
atggtgagccacttcatgggcagcctgagcgtgctgtgcttcctgctgctgctgggcttccagttcgtgtgcccccagcccagcacccagcacagaaaggtgccccagagaatggccgccgagggcgcccccgaggacgacggcggcggcggcgcccccggcgtgtggggcgcctggggcccctggagcgcctgcagcagaagctgcagcggcggcgtgatggagcagaccagaccctgcctgcccagaagctacagactgagaggcggccagagacccggcgcccccgccagagccttcgccgaccacgtggtgagcgccgtgagaaccagcgtgcccctgcacagaagcagagacgagacccccgccctggccggcaccgacgccagcagacagggccccaccgtgctgagaggcagcagacacccccagccccagggcctggaggtgaccggcgacagaagaagcagaaccagaggcaccatcggccccggcaagtacggctacggcaaggccccctacatcctgcccctgcagaccgacaccgcccacaccccccagagactgagaagacagaagctgagcagcagacacagcagaagccagggcgccagcagcgccagacacggctacagcagccccgcccaccaggtgccccagcacggccccctgtaccagagcgacagcggccccagaagcggcctgcaggccgccgaggcccccatctaccagctgcccctgacccacgaccagggctaccccgccgccagcagcctgttccacagccccgagaccagcaacaaccacggcgtgggcacccacggcgccacccagagcttcagccagcccgccagaagcaccgccatcagctgcatcggcgcctacagacagtacaagctgtgcaacaccaacgtgtgccccgagagcagcagaagcatcagagaggtgcagtgcgccagctacaacaacaagcccttcatgggcagattctacgagtgggagcccttcgccgaggtgaagggcaacagaaagtgcgagctgaactgccaggccatgggctacagattctacgtgagacaggccgagaaggtgatcgacggcaccccctgcgaccagaacggcaccgccatctgcgtgagcggccagtgcaagagcatcggctgcgacgactacctgggcagcgacaaggtggtggacaagtgcggcgtgtgcggcggcgacaacaccggctgccaggtggtgagcggcgtgttcaagcacgccctgaccagcctgggctaccacagagtggtggagatccccgagggcgccaccaagatcaacatcaccgagatgtacaagagcaacaactacctggccctgagaagcagaagcggcagaagcatcatcaacggcaactgggccatcgacagacccggcaagtacgagggcggcggcaccatgttcacctacaagagacccaacgagatcagcagcaccgccggcgagagcttcctggccgagggccccaccaacgagatcctggacgtgtacatgatccaccagcagcccaaccccggcgtgcactacgagtacgtgatcatgggcaccaacgccatcagcccccaggtgcccccccacagaagacccggcgagcccttcaacggccagatggtgaccgagggcagaagccaggaggagggcgagcagaagggcagaaacgaggagaaggaggacctgagaggcgaggcccccgagatgttcaccagcgagagcgcccagaccttccccgtgagacaccccgacagattcagcccccacagacccgacaacctggtgccccccgccccccagccccccagaagaagcagagaccacaactggaagcagctgggcaccaccgagtgcagcaccacctgcggcaagggcagccagtaccccatcttcagatgcgtgcacagaagcacccacgaggaggcccccgagagctactgcgacagcagcatgaagcccacccccgaggaggagccctgcaacatcttcccctgccccgccttctgggacatcggcgagtggagcgagtgcagcaagacctgcggcctgggcatgcagcacagacaggtgctgtgcagacaggtgtacgccaacagaagcctgaccgtgcagccctacagatgccagcacctggagaagcccgagaccaccagcacctgccagctgaagatctgcagcgagtggcagatcagaaccgactggaccagctgcagcgtgccctgcggcgtgggccagagaaccagagacgtgaagtgcgtgagcaacatcggcgacgtggtggacgacgaggagtgcaacatgaagctgagacccaacgacatcgagaactgcgacatgggcccctgcgccaagagctggttcctgaccgagtggagcgagagatgcagcgccgagtgcggcgccggcgtgagaaccagaagcgtggtgtgcatgaccaaccacgtgagcagcctgcccctggagggctgcggcaacaacagacccgccgaggccaccccctgcgacaacggcccctgcaccggcaaggtggagtggttcgccggcagctggagccagtgcagcatcgagtgcggcagcggcacccagcagagagaggtgatctgcgtgagaaagaacgccgacaccttcgaggtgctggaccccagcgagtgcagcttcctggagaagccccccagccagcagagctgccacctgaagccctgcggcgccaagtggttcagcaccgagtggagcatgtgcagcaagagctgccagggcggcttcagagtgagagaggtgagatgcctgagcgacgacatgaccctgagcaacctgtgcgacccccagctgaagcccgaggagagagagagctgcaacccccaggactgcgtgcccgaggtggacgagaactgcaaggacaagtactacaactgcaacgtggtggtgcaggccagactgtgcgtgtacaactactacaagaccgcctgctgcgccagctgcaccagagtggccaacagacagaccggcttcctgggcagcagatag

SEQ ID NO: 3591 - DNA, 1503 bp, Artificial Sequence
  Description of Artificial Sequence: Synthetic coding sequence
atgaagtgcaccgccagagagtggctgagagtgaccaccgtgctgttcatggccagagccatccccgccatggtggtgcccaacgccaccctgctggagaagctgctggagaagtacatggacgaggacggcgagtggtggatcgccaagcagagaggcaagagagccatcaccgacaacgacatgcagagcatcctggacctgcacaacaagctgagaagccaggtgtaccccaccgccagcaacatggagtacatgacctgggacgtggagctggagagaagcgccgagagctgggccgagagctgcctgtgggagcacggccccgccagcctgctgcccagcatcggccagaacctgggcgcccactggggcagatacagaccccccaccttccacgtgcagagctggtacgacgaggtgaaggacttcagctacccctacgagcacgagtgcaacccctactgccccttcagatgcagcggccccgtgtgcacccactacacccaggtggtgtgggccaccagcaacagaatcggctgcgccatcaacctgtgccacaacatgaacatctggggccagatctggcccaaggccgtgtacctggtgtgcaactacagccccaagggcaactggtggggccacgccccctacaagcacggcagaccctgcagcgcctgcccccccagcttcggcggcggctgcagagagaacctgtgctacaaggagggcagcgacagatactacccccccagagaggaggagaccaacgagatcgagagacagcagagccaggtgcacgacacccacgtgagaaccagaagcgacgacagcagcagaaacgaggtgatcagcgcccagcagatgagccagatcgtgagctgcgaggtgagactgagagaccagtgcaagggcaccacctgcaacagatacgagtgccccgccggctgcctggacagcaaggccaaggtgatcggcagcgtgcactacgagatgcagagcagcatctgcagagccgccatccactacggcatcatcgacaacgacggcggctgggtggacatcaccagacagggcagaaagcactacttcatcaagagcaacagaaacggcatccagaccatcggcaagtaccagagcgccaacagcttcaccgtgagcaaggtgaccgtgcaggccgtgacctgcgagaccaccgtggagcagctgtgccccttccacaagcccgccagccactgccccagagtgtactgccccagaaactgcatgcaggccaacccccactacgccagagtgatcggcaccagagtgtacagcgacctgagcagcatctgcagagccgccgtgcacgccggcgtggtgagaaaccacggcggctacgtggacgtgatgcccgtggacaagagaaagacctacatcgccagcttccagaacggcatcttcagcgagagcctgcagaacccccccggcggcaaggccttcagagtgttcgccgtggtgtag

SEQ ID NO: 3592 - DNA, 2070 bp, Artificial Sequence
  Description of Artificial Sequence: Synthetic coding sequence
atgaagttcggcgccgtgaccagaatcggcggcccccccctgggcaaccagagccccagcagctgcagcctgctgcacgagaaggacccccccaccaccagcggcccccagaccgaccagcccaagaagcacctgaccaacttcaagagcgccaccagaagagtggccagaacccagtggctgaccgccgacagacagacctgggccagcatcagcagcgtgccctgggcccagaccatcagcgagaagaagcccggcggcagcctgtgggagaccagaagcagcccccccaccaccgccggcaccgaggaggccatgaacaccaccagcctgctggcccccgccgccgagatcatggccacccccggcagccccagccaggccagccccaccctgggcgccttcacccacggcacccagacccccagccccaccaaggccaccgcccccagatacccccagaccggcgacctgagcgccgagtggcccttcaccgccggcgaggagcccgtgctggtgcccagaccccaccaggtgagcagagtgagaagcagctgctgcctgagccccatcctgtgcagccccgccatgatcgccttcctgctgaccagcgtgctgatgatcccccacgccggcggccaccccctggacaccccccacctgccccaggagctgccccccggcctgcccaacaacatcaacatcaccttcttcagcggcatgttcaagaacgtggagagcgtggccgagatcttcgactgcctgggcccccacttcacctggctgcaggccgtgttcaccaacttccccgtgctgatccagttcgtgaacggcatgaagtgcgtggccggcctgtgccccagagacttcgaggactacggctgcacctgcagattcgagatggagggcctgcccgtggacgagagcgacagctgctgcttccagcacagaagatgctacgaggaggccgccgagatggactgcctgcaggaccccgccaagctgagcaccgaggtgaactgcgtgagcaagaagatcatctgcgagagcaaggacaactgcgagcacctgctgtgcacctgcgacaaggccgccatcgagtgcctggccagaagcagcctgaacagcagcctgaacctgctggacaccagcttctgcctggcccagacccccgagaccaccatcaaggaggacctgaccaccctgctgcccagagtggtgcccgtggagcccaccgacaccagcctgaccgccctgagcggcgaggtggccgccgagaccgaggccgacagactgatcaccctgagcaagaagaaggccggccacgaccaggagggcgtgggcgccgccagagccaccagcccccccggcagcgccgagatcgtggccaccagagtgaccgccaagatcgtgaccctggtgcccgccggcatcaagagcctgggcctggccgtgagcagcgtggagaacgaccccgaggagaccaccgagaaggcctgcgacagattcaccttcctgcacctgggcagcggcgacaacatgcaggtgatgccccagctgggcgagatgctgttctgcctgaccagcagatgccccgaggagttcgagagctacggctgctactgcggccaggagggcagaggcgagcccagagacgacctggacagatgctgcctgagccaccactgctgcctggagcaggtgagaagactgggctgcctgctggagagactgccctggagccccgtggtgtgcgtggaccacacccccaagtgcggcggccagagcctgtgcgagaagctgctgtgcgcctgcgaccagaccgccgccgagtgcatgaccagcgccagcttcaaccagagcctgaagagccccagcagactgggctgccccggccagcccgccgcctgcgaggacagcctgcaccccgtgcccgccgcccccaccctgggcagcagcagcgaggaggacagcgaggaggaccccccccaggaggacctgggcagagccaagagattcctgagaaagagcctgggccccctgggcatcggccccctgcacggcagatag

SEQ ID NO: 3593 - DNA, 1359 bp, Artificial Sequence
  Description of Artificial Sequence: Synthetic coding sequence
atggagctggccctgagaagaagccccgtgcccagatggctgctgctgctgcccctgctgctgggcctgaacgccggcgccgtgatcgactggcccaccgaggagggcaaggaggtgtgggactacgtgaccgtgagaaaggacgcctacatgttctggtggctgtactacgccaccaacagctgcaagaacttcagcgagctgcccctggtgatgtggctgcagggcggccccggcggcagcagcaccggcttcggcaacttcgaggagatcggccccctggacagcgacctgaagcccagaaagaccacctggctgcaggccgccagcctgctgttcgtggacaaccccgtgggcaccggcttcagctacgtgaacggcagcggcgcctacgccaaggacctggccatggtggccagcgacatgatggtgctgctgaagaccttcttcagctgccacaaggagttccagaccgtgcccttctacatcttcagcgagagctacggcggcaagatggccgccggcatcggcctggagctgtacaaggccatccagagaggcaccatcaagtgcaacttcgccggcgtggccctgggcgacagctggatcagccccgtggacagcgtgctgagctggggcccctacctgtacagcatgagcctgctggaggacaagggcctggccgaggtgagcaaggtggccgagcaggtgctgaacgccgtgaacaagggcctgtacagagaggccaccgagctgtggggcaaggccgagatgatcatcgagcagaacaccgacggcgtgaacttctacaacatcctgaccaagagcacccccaccagcaccatggagagcagcctggagttcacccagagccacctggtgtgcctgtgccagagacacgtgagacacctgcagagagacgccctgagccagctgatgaacggccccatcagaaagaagctgaagatcatccccgaggaccagagctggggcggccaggccaccaacgtgttcgtgaacatggaggaggacttcatgaagcccgtgatcagcatcgtggacgagctgctggaggccggcatcaacgtgaccgtgtacaacggccagctggacctgatcgtggacaccatgggccaggaggcctgggtgagaaagctgaagtggcccgagctgcccaagttcagccagctgaagtggaaggccctgtacagcgaccccaagagcctggagaccagcgccttcgtgaagagctacaagaacctggccttctactggatcctgaaggccggccacatggtgcccagcgaccagggcgacatggccctgaagatgatgagactggtgacccagcaggagtag

SEQ ID NO: 3594 - DNA, 1395 bp, Artificial Sequence
  Description of Artificial Sequence: Synthetic coding sequence
atggtgagactggccgccgagctgctgctgctgctgggcctgctgctgctgaccctgcacatcaccgtgctgagaggcagcggcgccgccgacggccccgacgccgccgccggcaacgccagccaggcccagctgcagaacaacctgaacgtgggcagcgacaccaccagcgagaccagcttcagcctgagcaaggaggcccccagagagcacctggaccaccaggccgcccaccagcccttccccagacccagattcagacaggagaccggccaccccagcctgcagagagacttccccagaagcttcctgctggacctgcccaacttccccgacctgagcaaggccgacatcaacggccagaaccccaacatccaggtgaccatcgaggtggtggacggccccgacagcgaggccgacaaggaccagcaccccgagaacaagcccagctggagcgtgcccagccccgactggagagcctggtggcagagaagcctgagcctggccagagccaacagcggcgaccaggactacaagtacgacagcaccagcgacgacagcaacttcctgaacccccccagaggctgggaccacaccgcccccggccacagaaccttcgagaccaaggaccagcccgagtacgacagcaccgacggcgagggcgactggagcctgtggagcgtgtgcagcgtgacctgcggcaacggcaaccagaagagaaccagaagctgcggctacgcctgcaccgccaccgagagcagaacctgcgacagacccaactgccccggcatcgaggacaccttcagaaccgccgccaccgaggtgagcctgctggccggcagcgaggagttcaacgccaccaagctgttcgaggtggacaccgacagctgcgagagatggatgagctgcaagagcgagttcctgaagaagtacatgcacaaggtgatgaacgacctgcccagctgcccctgcagctaccccaccgaggtggcctacagcaccgccgacatcttcgacagaatcaagagaaaggacttcagatggaaggacgccagcggccccaaggagaagctggagatctacaagcccaccgccagatactgcatcagaagcatgctgagcctggagagcaccaccctggccgcccagcactgctgctacggcgacaacatgcagctgatcaccagaggcaagggcgccggcacccccaacctgatcagcaccgagttcagcgccgagctgcactacaaggtggacgtgctgccctggatcatctgcaagggcgactggagcagatacaacgaggccagaccccccaacaacggccagaagtgcaccgagagccccagcgacgaggactacatcaagcagttccaggaggccagagagtactag

SEQ ID NO: 3595 - DNA, 1536 bp, Artificial Sequence
  Description of Artificial Sequence: Synthetic coding sequence
atgctggtggacggccccagcgagagacccgccctgtgcttcctgctgctggccgtggccatgagcttcttcggcagcgccctgagcatcgacgagaccagagcccacctgctgctgaaggagaagatgatgagactgggcggcagactggtgctgaacaccaaggaggagctggccaacgagagactgatgaccctgaagatcgccgagatgaaggaggccatgagaaccctgatcttcccccccagcatgcacttcttccaggccaagcacctgatcgagagaagccaggtgttcaacatcctgagaatgatgcccaagggcgccgccctgcacctgcacgacatcggcatcgtgaccatggactggctggtgagaaacgtgacctacagaccccactgccacatctgcttcacccccagaggcatcatgcagttcagattcgcccaccccacccccagacccagcgagaagtgcagcaagtggatcctgctggaggactacagaaagagagtgcagaacgtgaccgagttcgacgacagcctgctgagaaacttcaccctggtgacccagcaccccgaggtgatctacaccaaccagaacgtggtgtggagcaagttcgagaccatcttcttcaccatcagcggcctgatccactacgcccccgtgttcagagactacgtgttcagaagcatgcaggagttctacgaggacaacgtgctgtacatggagatcagagccagactgctgcccgtgtacgagctgagcggcgagcaccacgacgaggagtggagcgtgaagacctaccaggaggtggcccagaagttcgtggagacccaccccgagttcatcggcatcaagatcatctacagcgaccacagaagcaaggacgtggccgtgatcgccgagagcatcagaatggccatgggcctgagaatcaagttccccaccgtggtggccggcttcgacctggtgggccacgaggacaccggccacagcctgcacgactacaaggaggccctgatgatccccgccaaggacggcgtgaagctgccctacttcttccacgccggcgagaccgactggcagggcaccagcatcgacagaaacatcctggacgccctgatgctgaacaccaccagaatcggccacggcttcgccctgagcaagcaccccgccgtgagaacctacagctggaagaaggacatccccatcgaggtgtgccccatcagcaaccaggtgctgaagctggtgagcgacctgagaaaccaccccgtggccaccctgatggccaccggccaccccatggtgatcagcagcgacgaccccgccatgttcggcgccaagggcctgagctacgacttctacgaggtgttcatgggcatcggcggcatgaaggccgacctgagaaccctgaagcagctggccatgaacagcatcaagtacagcaccctgctggagagcgagaagaacaccttcatggagatctggaagaagagatgggacaagttcatcgccgacgtggccaccaagtag

SEQ ID NO: 3596 - DNA, 777 bp, Artificial Sequence
  Description of Artificial Sequence: Synthetic coding sequence
atgaagcagatcctgcaccccgccctggagaccaccgccatgaccctgttccccgtgctgctgttcctggtggccggcctgctgcccagcttccccgccaacgaggacaaggaccccgccttcaccgccctgctgaccacccagacccaggtgcagagagagatcgtgaacaagcacaacgagctgagaagagccgtgagcccccccgccagaaacatgctgaagatggagtggaacaaggaggccgccgccaacgcccagaagtgggccaaccagtgcaactacagacacagcaaccccaaggacagaatgaccagcctgaagtgcggcgagaacctgtacatgagcagcgccagcagcagctggagccaggccatccagagctggttcgacgagtacaacgacttcgacttcggcgtgggccccaagacccccaacgccgtggtgggccactacacccaggtggtgtggtacagcagctacctggtgggctgcggcaacgcctactgccccaaccagaaggtgctgaagtactactacgtgtgccagtactgccccgccggcaactgggccaacagactgtacgtgccctacgagcagggcgccccctgcgccagctgccccgacaactgcgacgacggcctgtgcaccaacggctgcaagtacgaggacctgtacagcaactgcaagagcctgaagctgaccctgacctgcaagcaccagctggtgagagacagctgcaaggccagctgcaactgcagcaacagcatctactag

SEQ ID NO: 3597 - DNA, 714 bp, Artificial Sequence
  Description of Artificial Sequence: Synthetic coding sequence
atggtgacccccccccccccccccgtgttcagcctgctgaagatcagccagagaatcgtgtgcctggtgctggacaagagcggcagcatgggcggcaaggacagactgaacagaatgaaccaggccgccaagcacttcctgctgcagaccgtggagaacggcagctgggtgggcatggtgcacttcgacagcaccgccaccatcgtgaacaagctgatccagatcaagagcagcgacgagagaaacaccctgatggccggcctgcccacctaccccctgggcggcaccagcatctgcagcggcatcaagtacgccttccaggtgatcggcgagctgcacagccagctggacggcagcgaggtgctgctgctgaccgacggcgaggacaacaccgccagcagctgcatcgacgaggtgaagcagagcggcgccatcgtgcacttcatcgccctgggcagagccgccgacgaggccgtgatcgagatgagcaagatcaccggcggcagccacttctacgtgagcgacgaggcccagaacaacggcctgatcgacgccttcggcgccctgaccagcggcaacaccgacctgagccagaagagcctgcaggtgagagtgctgatcccctgggtgttcatgttcaccttcgccaccagaaagaaccacctggtggtgatcagcttcgagttccacatcttcctgaaggtgaacttctag

SEQ ID NO: 3598 - DNA, 459 bp, Artificial Sequence
  Description of Artificial Sequence: Synthetic coding sequence
atggacaacgtgcagcccaagatcaagcacagacccttctgcttcagcgtgaagggccacgtgaagatgctgagactggccctgaccgtgaccagcatgaccttcttcatcatcgcccaggcccccgagccctacatcgtgatcaccggcttcgaggtgaccgtgatcctgttcttcatcctgctgtacgtgctgagactggacagactgatgaagtggctgttctggcccctgctggacatcatcaacagcctggtgaccaccgtgttcatgctgatcgtgagcgtgctggccctgatccccgagaccaccaccctgaccgtgggcggcggcgtgttcgccctggtgaccgccgtgtgctgcctggccgacggcgccctgatctacagaaagctgctgttcaaccccagcggcccctaccagaagaagcccgtgcacgagaagaaggaggtgctgtag

SEQ ID NO: 3599 - DNA, 3744 bp, Artificial Sequence
  Description of Artificial Sequence: Synthetic coding sequence
atgctggccagcagcagcagaatcagagccgcctggaccagagccctgctgctgcccctgctgctggccggccccgtgggctgcctgagcagacaggagctgttccccttcggccccggccagggcgacctggagctggaggacggcgacgacttcgtgagccccgccctggagctgagcggcgccctgagattctacgacagaagcgacatcgacgccgtgtacgtgaccaccaacggcatcatcgccaccagcgagccccccgccaaggagagccaccccggcctgttcccccccaccttcggcgccgtggcccccttcctggccgacctggacaccaccgacggcctgggcaaggtgtactacagagaggacctgagccccagcatcacccagagagccgccgagtgcgtgcacagaggcttccccgagatcagcttccagcccagcagcgccgtggtggtgacctgggagagcgtggccccctaccagggccccagcagagaccccgaccagaagggcaagagaaacaccttccaggccgtgctggccagcagcgacagcagcagctacgccatcttcctgtaccccgaggacggcctgcagttccacaccaccttcagcaagaaggagaacaaccaggtgcccgccgtggtggccttcagccagggcagcgtgggcttcctgtggaagagcaacggcgcctacaacatcttcgccaacgacagagagagcgtggagaacctggccaagagcagcaacagcggccagcagggcgtgtgggtgttcgagatcggcagccccgccaccaccaacggcgtggtgcccgccgacgtgatcctgggcaccgaggacggcgccgagtacgacgacgaggacgaggactacgacctggccaccaccagactgggcctggaggacgtgggcaccacccccttcagctacaaggccctgagaagaggcggcgccgacacctacagcgtgcccagcgtgctgagccccagaagagccgccaccgagagacccctgggcccccccaccgagagaaccagaagcttccagctggccgtggagaccttccaccagcagcacccccaggtgatcgacgtggacgaggtggaggagaccggcgtggtgttcagctacaacaccgacagcagacagacctgcgccaacaacagacaccagtgcagcgtgcacgccgagtgcagagactacgccaccggcttctgctgcagctgcgtggccggctacaccggcaacggcagacagtgcgtggccgagggcagcccccagagagtgaacggcaaggtgaagggcagaatcttcgtgggcagcagccaggtgcccatcgtgttcgagaacaccgacctgcacagctacgtggtgatgaaccacggcagaagctacaccgccatcagcaccatccccgagaccgtgggctacagcctgctgcccctggcccccgtgggcggcatcatcggctggatgttcgccgtggagcaggacggcttcaagaacggcttcagcatcaccggcggcgagttcaccagacaggccgaggtgaccttcgtgggccaccccggcaacctggtgatcaagcagagattcagcggcatcgacgagcacggccacctgaccatcgacaccgagctggagggcagagtgccccagatccccttcggcagcagcgtgcacatcgagccctacaccgagctgtaccactacagcaccagcgtgatcaccagcagcagcaccagagagtacaccgtgaccgagcccgagagagacggcgccagccccagcagaatctacacctaccagtggagacagaccatcaccttccaggagtgcgtgcacgacgacagcagacccgccctgcccagcacccagcagctgagcgtggacagcgtgttcgtgctgtacaaccaggaggagaagatcctgagatacgccctgagcaacagcatcggccccgtgagagagggcagccccgacgccctgcagaacccctgctacatcggcacccacggctgcgacaccaacgccgcctgcagacccggccccagaacccagttcacctgcgagtgcagcatcggcttcagaggcgacggcagaacctgctacgacatcgacgagtgcagcgagcagcccagcgtgtgcggcagccacaccatctgcaacaaccaccccggcaccttcagatgcgagtgcgtggagggctaccagttcagcgacgagggcacctgcgtggccgtggtggaccagagacccatcaactactgcgagaccggcctgcacaactgcgacatcccccagagagcccagtgcatctacaccggcggcagcagctacacctgcagctgcctgcccggcttcagcggcgacggccaggcctgccaggacgtggacgagtgccagcccagcagatgccaccccgacgccttctgctacaacacccccggcagcttcacctgccagtgcaagcccggctaccagggcgacggcttcagatgcgtgcccggcgaggtggagaagaccagatgccagcacgagagagagcacatcctgggcgccgccggcgccaccgacccccagagacccatcccccccggcctgttcgtgcccgagtgcgacgcccacggccactacgcccccacccagtgccacggcagcaccggctactgctggtgcgtggacagagacggcagagaggtggagggcaccagaaccagacccggcatgacccccccctgcctgagcaccgtggccccccccatccaccagggccccgccgtgcccaccgccgtgatccccctgccccccggcacccacctgctgttcgcccagaccggcaagatcgagagactgcccctggagggcaacaccatgagaaagaccgaggccaaggccttcctgcacgtgcccgccaaggtgatcatcggcctggccttcgactgcgtggacaagatggtgtactggaccgacatcaccgagcccagcatcggcagagccagcctgcacggcggcgagcccaccaccatcatcagacaggacctgggcagccccgagggcatcgccgtggaccacctgggcagaaacatcttctggaccgacagcaacctggacagaatcgaggtggccaagctggacggcacccagagaagagtgctgttcgagaccgacctggtgaaccccagaggcatcgtgaccgacagcgtgagaggcaacctgtactggaccgactggaacagagacaaccccaagatcgagaccagctacatggacggcaccaacagaagaatcctggtgcaggacgacctgggcctgcccaacggcctgaccttcgacgccttcagcagccagctgtgctgggtggacgccggcaccaacagagccgagtgcctgaaccccagccagcccagcagaagaaaggccctggagggcctgcagtaccccttcgccgtgaccagctacggcaagaacctgtacttcaccgactggaagatgaacagcgtggtggccctggacctggccatcagcaaggagaccgacgccttccagccccacaagcagaccagactgtacggcatcaccaccgccctgagccagtgcccccagggccacaactactgcagcgtgaacaacggcggctgcacccacctgtgcctggccacccccggcagcagaacctgcagatgccccgacaacaccctgggcgtggactgcatcgagcagaagtag

SEQ ID NO: 3600 - DNA, 525 bp, Artificial Sequence
  Description of Artificial Sequence: Synthetic coding sequence
atgctgagaaccgagagctgcagacccagaagccccgccggccaggtggccgccgccagccccctgctgctgctgctgctgctgctggcctggtgcgccggcgcctgcagaggcgcccccatcctgccccagggcctgcagcccgagcagcagctgcagctgtggaacgagatcgacgacacctgcagcagcttcctgagcatcgacagccagccccaggccagcaacgccctggaggagctgtgcttcatgatcatgggcatgctgcccaagccccaggagcaggacgagaaggacaacaccaagagattcctgttccactacagcaagacccagaagctgggcaagagcaacgtggtgagcagcgtggtgcaccccctgctgcagctggtgccccacctgcacgagagaagaatgaagagattcagagtggacgaggagttccagagccccttcgccagccagagcagaggctacttcctgttcagacccagaaacggcagaagaagcgccggcttcatctag

SEQ ID NO: 3601 - DNA, 1218 bp, Artificial Sequence
  Description of Artificial Sequence: Synthetic coding sequence
atggacaccatcttcctgtggagcctgctgctgctgttcttcggcagccaggccagcagatgcagcgcccagaagaacaccgagttcgccgtggacctgtaccaggaggtgagcctgagccacaaggacaacatcatcttcagccccctgggcatcaccctggtgctggagatggtgcagctgggcgccaagggcaaggcccagcagcagatcagacagaccctgaagcagcaggagaccagcgccggcgaggagttcttcgtgctgaagagcttcttcagcgccatcagcgagaagaagcaggagttcaccttcaacctggccaacgccctgtacctgcaggagggcttcaccgtgaaggagcagtacctgcacggcaacaaggagttcttccagagcgccatcaagctggtggacttccaggacgccaaggcctgcgccgagatgatcagcacctgggtggagagaaagaccgacggcaagatcaaggacatgttcagcggcgaggagttcggccccctgaccagactggtgctggtgaacgccatctacttcaagggcgactggaagcagaagttcagaaaggaggacacccagctgatcaacttcaccaagaagaacggcagcaccgtgaagatccccatgatgaaggccctgctgagaaccaagtacggctacttcagcgagagcagcctgaactaccaggtgctggagctgagctacaagggcgacgagttcagcctgatcatcatcctgcccgccgagggcatggacatcgaggaggtggagaagctgatcaccgcccagcagatcctgaagtggctgagcgagatgcaggaggaggaggtggagatcagcctgcccagattcaaggtggagcagaaggtggacttcaaggacgtgctgtacagcctgaacatcaccgagatcttcagcggcggctgcgacctgagcggcatcaccgacagcagcgaggtgtacgtgagccaggtgacccagaaggtgttcttcgagatcaacgaggacggcagcgaggccgccaccagcaccggcatccacatccccgtgatcatgagcctggcccagagccagttcatcgccaaccaccccttcctgttcatcatgaagcacaaccccaccgagagcatcctgttcatgggcagagtgaccaaccccgacacccaggagatcaagggcagagacctggacagcctgtag

SEQ ID NO: 3602 - DNA, 3687 bp, Artificial Sequence
  Description of Artificial Sequence: Synthetic coding sequence
atgaagggcgccagactgttcgtgctgctgagcagcctgtggagcggcggcatcggcctgaacaacagcaagcacagctggaccatccccgaggacggcaacagccagaagaccatgcccagcgccagcgtgccccccaacaagatccagagcctgcagatcctgcccaccaccagagtgatgagcgccgagatcgccaccacccccgaggccagaaccagcgaggacagcctgctgaagagcaccctgccccccagcgagaccagcgcccccgccgagggcgtgagaaaccagaccctgaccagcaccgagaaggccgagggcgtggtgaagctgcagaacctgaccctgcccaccaacgccagcatcaagttcaaccccggcgccgagagcgtggtgctgagcaacagcaccctgaagttcctgcagagcttcgccagaaagagcaacgagcaggccaccagcctgaacaccgtgggcggcaccggcggcatcggcggcgtgggcggcaccggcggcgtgggcaacagagcccccagagagacctacctgagcagaggcgacagcagcagcagccagagaaccgactaccagaagagcaacttcgagaccaccagaggcaagaactggtgcgcctacgtgcacaccagactgagccccaccgtgatcctggacaaccaggtgacctacgtgcccggcggcaagggcccctgcggctggaccggcggcagctgcccccagagaagccagaagatcagcaaccccgtgtacagaatgcagcacaagatcgtgaccagcctggactggagatgctgccccggctacagcggccccaagtgccagctgagagcccaggagcagcagagcctgatccacaccaaccaggccgagagccacaccgccgtgggcagaggcgtggccgagcagcagcagcagcagggctgcggcgaccccgaggtgatgcagaagatgaccgaccaggtgaactaccaggccatgaagctgaccctgctgcagaagaagatcgacaacatcagcctgaccgtgaacgacgtgagaaacacctacagcagcctggagggcaaggtgagcgaggacaagagcagagagttccagagcctgctgaagggcctgaagagcaagagcatcaacgtgctgatcagagacatcgtgagagagcagttcaagatcttccagaacgacatgcaggagaccgtggcccagctgttcaagaccgtgagcagcctgagcgaggacctggagagcaccagacagatcatccagaaggtgaacgagagcgtggtgagcatcgccgcccagcagaagttcgtgctggtgcaggagaacagacccaccctgaccgacatcgtggagctgagaaaccacatcgtgaacgtgagacaggagatgaccctgacctgcgagaagcccatcaaggagctggaggtgaagcagacccacctggagggcgccctggagcaggagcacagcagaagcatcctgtactacgagagcctgaacaagaccctgagcaagctgaaggaggtgcacgagcagctgctgagcaccgagcaggtgagcgaccagaagaacgcccccgccgccgagagcgtgagcaacaacgtgaccgagtacatgagcaccctgcacgagaacatcaagaagcagagcctgatgatgctgcagatgttcgaggacctgcacatccaggagagcaagatcaacaacctgaccgtgagcctggagatggagaaggagagcctgagaggcgagtgcgaggacatgctgagcaagtgcagaaacgacttcaagttccagctgaaggacaccgaggagaacctgcacgtgctgaaccagaccctggccgaggtgctgttccccatggacaacaagatggacaagatgagcgagcagctgaacgacctgacctacgacatggagatcctgcagcccctgctggagcagggcgccagcctgagacagaccatgacctacgagcagcccaaggaggccatcgtgatcagaaagaagatcgagaacctgaccagcgccgtgaacagcctgaacttcatcatcaaggagctgaccaagagacacaacctgctgagaaacgaggtgcagggcagagacgacgccctggagagaagaatcaacgagtacgccctggagatggaggacggcctgaacaagaccatgaccatcatcaacaacgccatcgacttcatccaggacaactacgccctgaaggagaccctgagcaccatcaaggacaacagcgagatccaccacaagtgcaccagcgacatggagaccatcctgaccttcatcccccagttccacagactgaacgacagcatccagaccctggtgaacgacaaccagagatacaacttcgtgctgcaggtggccaagaccctggccggcatccccagagacgagaagctgaaccagagcaacttccagaagatgtaccagatgttcaacgagaccaccagccaggtgagaaagtaccagcagaacatgagccacctggaggagaagctgctgctgaccaccaagatcagcaagaacttcgagaccagactgcaggacatcgagagcaaggtgacccagaccctgatcccctactacatcagcgtgaagaagggcagcgtggtgaccaacgagagagaccaggccctgcagctgcaggtgctgaacagcagattcaaggccctggaggccaagagcatccacctgagcatcaacttcttcagcctgaacaagaccctgcacgaggtgctgaccatgtgccacaacgccagcaccagcgtgagcgagctgaacgccaccatccccaagtggatcaagcacagcctgcccgacatccagctgctgcagaagggcctgaccgagttcgtggagcccatcatccagatcaagacccaggccgccctgagcaacctgacctgctgcatcgacagaagcctgcccggcagcctggccaacgtggtgaagagccagaagcaggtgaagagcctgcccaagaagatcaacgccctgaagaagcccaccgtgaacctgaccaccgtgctgatcggcagaacccagagaaacaccgacaacatcatctaccccgaggagtacagcagctgcagcagacacccctgccagaacggcggcacctgcatcaacggcagaaccagcttcacctgcgcctgcagacaccccttcaccggcgacaactgcaccatcaagctggtggaggagaacgccctggcccccgacttcagcaagggcagctacagatacgcccccatggtggccttcttcgccagccacacctacggcatgaccatccccggccccatcctgttcaacaacctggacgtgaactacggcgccagctacacccccagaaccggcaagttcagaatcccctacctgggcgtgtacgtgttcaagtacaccatcgagagcttcagcgcccacatcagcggcttcctggtggtggacggcatcgacaagctggccttcgagagcgagaacatcaacagcgagatccactgcgacagagtgctgaccggcgacgccctgctggagctgaactacggccaggaggtgtggctgagactggccaagggcaccatccccgccaagttcccccccgtgaccaccttcagcggctacctgctgtacagaacctag

SEQ ID NO: 3603 - DNA, 1365 bp, Artificial Sequence
  Description of Artificial Sequence: Synthetic coding sequence
atgtggcccctgaccgtgcccccccccctgctgctgctgctgtgcagcggcctggccggccagaccctgttccagaaccccgaggagggctggcagctgtacaccagcgcccaggcccccgacggcaagtgcatctgcaccgccgtgatccccgcccagagcacctgcagcagagacggcagaagcagagagctgagacagctgatggagaaggtgcagaacgtgagccagagcatggaggtgctggagctgagaacctacagagacctgcagtacgtgagaggcatggagaccctgatgagaagcctggacgccagactgagagccgccgacggcagcctgagcgccaagagcttccaggagctgaaggacagaatgaccgagctgctgcccctgagcagcgtgctggagcagtacaaggccgacaccagaaccatcgtgagactgagagaggaggtgagaaacctgagcggcagcctggccgccatccaggaggagatgggcgcctacggctacgaggacctgcagcagagagtgatggccctggaggccagactgcacgcctgcgcccagaagctgggctgcggcaagctgaccggcgtgagcaaccccatcaccgtgagagccatgggcagcagattcggcagctggatgaccgacaccatggcccccagcgccgacagcagagtgtggtacatggacggctactacaagggcagaagagtgctggagttcagaaccctgggcgacttcatcaagggccagaacttcatccagcacctgctgccccagccctgggccggcaccggccacgtggtgtacaacggcagcctgttctacaacaagtaccagagcaacgtggtggtgaagtaccacttcagaagcagaagcgtgctggtgcagagaagcctgcccggcgccggctacaacaacaccttcccctacagctggggcggcttcagcgacatggacttcatggtggacgagagcggcctgtgggccgtgtacaccaccaaccagaacgccggcaacatcgtggtgagcagactggacccccacaccctggaggtgatgagaagctgggacaccggctaccccaagagaagcgccggcgaggccttcatgatctgcggcgtgctgtacgtgaccaacagccacctggccggcgccaaggtgtacttcgcctacttcaccaacaccagcagctacgagtacaccgacgtgcccttccacaaccagtacagccacatcagcatgctggactacaaccccagagagagagccctgtacacctggaacaacggccaccaggtgctgtacaacgtgaccctgttccacgtgatcagcaccagcggcgacccctag

SEQ ID NO: 3604 - DNA, 909 bp, Artificial Sequence
  Description of Artificial Sequence: Synthetic coding sequence
atgtgcgccgagagactgggccagttcatgaccctggccctggtgctggccaccttcgaccccgccagaggcaccgacgccaccaacccccccgagggcccccaggacagaagcagccagcagaagggcagactgagcctgcagaacaccgccgagatccagcactgcctggtgaacgccggcgacgtgggctgcggcgtgttcgagtgcttcgagaacaacagctgcgagatcagaggcctgcacggcatctgcatgaccttcctgcacaacgccggcaagttcgacgcccagggcaagagcttcatcaaggacgccctgaagtgcaaggcccacgccctgagacacagattcggctgcatcagcagaaagtgccccgccatcagagagatggtgagccagctgcagagagagtgctacctgaagcacgacctgtgcgccgccgcccaggagaacaccagagtgatcgtggagatgatccacttcaaggacctgctgctgcacgagccctacgtggacctggtgaacctgctgctgacctgcggcgaggaggtgaaggaggccatcacccacagcgtgcaggtgcagtgcgagcagaactggggcagcctgtgcagcatcctgagcttctgcaccagcgccatccagaagccccccaccgccccccccgagagacagccccaggtggacagaaccaagctgagcagagcccaccacggcgaggccggccaccacctgcccgagcccagcagcagagagaccggcagaggcgccaagggcgagagaggcagcaagagccaccccaacgcccacgccagaggcagagtgggcggcctgggcgcccagggccccagcggcagcagcgagtgggaggacgagcagagcgagtacagcgacatcagaagatag

SEQ ID NO: 3605 - DNA, 2529 bp, Artificial Sequence
  Description of Artificial Sequence: Synthetic coding sequence
atgaagcccggcggcttctggctgcacctgaccctgctgggcgccagcctgcccgccgccctgggctggatggaccccggcaccagcagaggccccgacgtgggcgtgggcgagagccaggccgaggagcccagaagcttcgaggtgaccagaagagagggcctgagcagccacaacgagctgctggccagctgcggcaagaagttctgcagcagaggcagcagatgcgtgctgagcagaaagaccggcgagcccgagtgccagtgcctggaggcctgcagacccagctacgtgcccgtgtgcggcagcgacggcagattctacgagaaccactgcaagctgcacagagccgcctgcctgctgggcaagagaatcaccgtgatccacagcaaggactgcttcctgaagggcgacacctgcaccatggccggctacgccagactgaagaacgtgctgctggccctgcagaccagactgcagcccctgcaggagggcgacagcagacaggaccccgccagccagaagagactgctggtggagagcctgttcagagacctggacgccgacggcaacggccacctgagcagcagcgagctggcccagcacgtgctgaagaagcaggacctggacgaggacctgctgggctgcagccccggcgacctgctgagattcgacgactacaacagcgacagcagcctgaccctgagagagttctacatggccttccaggtggtgcagctgagcctggcccccgaggacagagtgagcgtgaccaccgtgaccgtgggcctgagcaccgtgctgacctgcgccgtgcacggcgacctgagaccccccatcatctggaagagaaacggcctgaccctgaacttcctggacctggaggacatcaacgacttcggcgaggacgacagcctgtacatcaccaaggtgaccaccatccacatgggcaactacacctgccacgccagcggccacgagcagctgttccagacccacgtgctgcaggtgaacgtgccccccgtgatcagagtgtaccccgagagccaggcccaggagcccggcgtggccgccagcctgagatgccacgccgagggcatccccatgcccagaatcacctggctgaagaacggcgtggacgtgagcacccagatgagcaagcagctgagcctgctggccaacggcagcgagctgcacatcagcagcgtgagatacgaggacaccggcgcctacacctgcatcgccaagaacgaggtgggcgtggacgaggacatcagcagcctgttcatcgaggacagcgccagaaagaccctggccaacatcctgtggagagaggagggcctgagcgtgggcaacatgttctacgtgttcagcgacgacggcatcatcgtgatccaccccgtggactgcgagatccagagacacctgaagcccaccgagaagatcttcatgagctacgaggagatctgcccccagagagagaagaacgccacccagccctgccagtgggtgagcgccgtgaacgtgagaaacagatacatctacgtggcccagcccgccctgagcagagtgctggtggtggacatccaggcccagaaggtgctgcagagcatcggcgtggaccccctgcccgccaagctgagctacgacaagagccacgaccaggtgtgggtgctgagctggggcgacgtgcacaagagcagacccagcctgcaggtgatcaccgaggccagcaccggccagagccagcacctgatcagaacccccttcgccggcgtggacgacttcttcatcccccccaccaacctgatcatcaaccacatcagattcggcttcatcttcaacaagagcgaccccgccgtgcacaaggtggacctggagaccatgatgcccctgaagaccatcggcctgcaccaccacggctgcgtgccccaggccatggcccacacccacctgggcggctacttcttcatccagtgcagacaggacagccccgccagcgccgccagacagctgctggtggacagcgtgaccgacagcgtgctgggccccaacggcgacgtgaccggcaccccccacaccagccccgacggcagattcatcgtgagcgccgccgccgacagcccctggctgcacgtgcaggagatcaccgtgagaggcgagatccagaccctgtacgacctgcagatcaacagcggcatcagcgacctggccttccagagaagcttcaccgagagcaaccagtacaacatctacgccgccctgcacaccgagcccgacctgctgttcctggagctgagcaccggcaaggtgggcatgctgaagaacctgaaggagccccccgccggccccgcccagccctggggcggcacccacagaatcatgagagacagcggcctgttcggccagtacctgctgacccccgccagagagagcctgttcctgatcaacggcagacagaacaccctgagatgcgaggtgagcggcatcaagggcggcaccaccgtggtgtgggtgggcgaggtgtag

SEQ ID NO: 3606 - DNA, 2256 bp, Artificial Sequence
  Description of Artificial Sequence: Synthetic coding sequence
atggccttcagaaccatctgcgtgctggtgggcgtgttcatctgcagcatctgcgtgaagggcagcagccagccccaggccagagtgtacctgaccttcgacgagctgagagagaccaagaccagcgagtacttcagcctgagccaccaccccctggactacagaatcctgctgatggacgaggaccaggacagaatctacgtgggcagcaaggaccacatcctgagcctgaacatcaacaacatcagccaggaggccctgagcgtgttctggcccgccagcaccatcaaggtggaggagtgcaagatggccggcaaggaccccacccacggctgcggcaacttcgtgagagtgatccagaccttcaacagaacccacctgtacgtgtgcggcagcggcgccttcagccccgtgtgcacctacctgaacagaggcagaagaagcgaggaccaggtgttcatgatcgacagcaagtgcgagagcggcaagggcagatgcagcttcaaccccaacgtgaacaccgtgagcgtgatgatcaacgaggagctgttcagcggcatgtacatcgacttcatgggcaccgacgccgccatcttcagaagcctgaccaagagaaacgccgtgagaaccgaccagcacaacagcaagtggctgagcgagcccatgttcgtggacgcccacgtgatccccgacggcaccgaccccaacgacgccaaggtgtacttcttcttcaaggagaagctgaccgacaacaacagaagcaccaagcagatccacagcatgatcgccagaatctgccccaacgacaccggcggcctgagaagcctggtgaacaagtggaccaccttcctgaaggccagactggtgtgcagcgtgaccgacgaggacggccccgagacccacttcgacgagctggaggacgtgttcctgctggagaccgacaaccccagaaccaccctggtgtacggcatcttcaccaccagcagcagcgtgttcaagggcagcgccgtgtgcgtgtaccacctgagcgacatccagaccgtgttcaacggccccttcgcccacaaggagggccccaaccaccagctgatcagctaccagggcagaatcccctaccccagacccggcacctgccccggcggcgccttcacccccaacatgagaaccaccaaggagttccccgacgacgtggtgaccttcatcagaaaccaccccctgatgtacaacagcatctaccccatccacaagagacccctgatcgtgagaatcggcaccgactacaagtacaccaagatcgccgtggacagagtgaacgccgccgacggcagataccacgtgctgttcctgggcaccgacagaggcaccgtgcagaaggtggtggtgctgcccaccaacaacagcgtgagcggcgagctgatcctggaggagctggaggtgttcaagaaccacgcccccatcaccaccatgaagatcagcagcaagaagcagcagctgtacgtgagcagcaacgagggcgtgagccaggtgagcctgcacagatgccacatctacggcaccgcctgcgccgactgctgcctggccagagacccctactgcgcctgggacggccacagctgcagcagattctaccccaccggcaagagaagaagcagaagacaggacgtgagacacggcaaccccctgacccagtgcagaggcttcaacctgaaggcctacagaaacgccgccgagatcgtgcagtacggcgtgaagaacaacaccaccttcctggagtgcgcccccaagagcccccaggccagcatcaagtggctgctgcagaaggacaaggacagaagaaaggaggtgaagctgaacgagagaatcatcgccaccagccagggcctgctgatcagaagcgtgcagggcagcgaccagggcctgtaccactgcatcgccaccgagaacagcttcaagcagaccatcgccaagatcaacttcaaggtgctggacagcgagatggtggccgtggtgaccgacaagtggagcccctggacctgggccagcagcgtgagagccctgcccttccaccccaaggacatcatgggcgccttcagccacagcgagatgcagatgatcaaccagtactgcaaggacaccagacagcagcaccagcagggcgacgagagccagaagatgagaggcgactacggcaagctgaaggccctgatcaacagcagaaagagcagaaacagaagaaaccagctgcccgagagctag

SEQ ID NO: 3607 - DNA, 2316 bp, Artificial Sequence
  Description of Artificial Sequence: Synthetic coding sequence
atgggctggctgaccagaatcgtgtgcctgttctggggcgtgctgctgaccgccagagccaactaccagaacggcaagaacaacgtgcccagactgaagctgagctacaaggagatgctggagagcaacaacgtgatcaccttcaacggcctggccaacagcagcagctaccacaccttcctgctggacgaggagagaagcagactgtacgtgggcgccaaggaccacatcttcagcttcgacctggtgaacatcaaggacttccagaagatcgtgtggcccgtgagctacaccagaagagacgagtgcaagtgggccggcaaggacatcctgaaggagtgcgccaacttcatcaaggtgctgaaggcctacaaccagacccacctgtacgcctgcggcaccggcgccttccaccccatctgcacctacatcgagatcggccaccaccccgaggacaacatcttcaagctggagaacagccacttcgagaacggcagaggcaagagcccctacgaccccaagctgctgaccgccagcctgctgatcgacggcgagctgtacagcggcaccgccgccgacttcatgggcagagacttcgccatcttcagaaccctgggccaccaccaccccatcagaaccgagcagcacgacagcagatggctgaacgaccccaagttcatcagcgcccacctgatcagcgagagcgacaaccccgaggacgacaaggtgtacttcttcttcagagagaacgccatcgacggcgagcacagcggcaaggccacccacgccagaatcggccagatctgcaagaacgacttcggcggccacagaagcctggtgaacaagtggaccaccttcctgaaggccagactgatctgcagcgtgcccggccccaacggcatcgacacccacttcgacgagctgcaggacgtgttcctgatgaacttcaaggaccccaagaaccccgtggtgtacggcgtgttcaccaccagcagcaacatcttcaagggcagcgccgtgtgcatgtacagcatgagcgacgtgagaagagtgttcctgggcccctacgcccacagagacggccccaactaccagtgggtgccctaccagggcagagtgccctaccccagacccggcacctgccccagcaagaccttcggcggcttcgacagcaccaaggacctgcccgacgacgtgatcaccttcgccagaagccaccccgccatgtacaaccccgtgttccccatgaacaacagacccatcgtgatcaagaccgacgtgaactaccagttcacccagatcgtggtggacagagtggacgccgaggacggccagtacgacgtgatgttcatcggcaccgacgtgggcaccgtgctgaaggtggtgagcatccccaaggagacctggtacgacctggaggaggtgctgctggaggagatgaccgtgttcagagagcccaccgccatcagcgccatggagctgagcaccaagcagcagcagctgtacatcggcagcaccgccggcgtggcccagctgcccctgcacagatgcgacatctacggcaaggcctgcgccgagtgctgcctggccagagacccctactgcgcctgggacggcagcgcctgcagcagatacttccccaccgccaagagaagaaccagaagacaggacatcagaaacggcgaccccctgacccactgcagcgacctgcaccacgacaaccaccacggccacagccccgaggagagaatcatctacggcgtggagaacagcagcaccttcctggagtgcagccccaagagccagagagccctggtgtactggcagttccagagaagaaacgaggagagaaaggaggagatcagagtggacgaccacatcatcagaaccgaccagggcctgctgctgagaagcctgcagcagaaggacagcggcaactacctgtgccacgccgtggagcacggcttcatccagaccctgctgaaggtgaccctggaggtgatcgacaccgagcacctggaggagctgctgcacaaggacgacgacggcgacggcagcaagaccaaggagatgagcaacagcatgacccccagccagaaggtgtggtacagagacttcatgcagctgatcaaccaccccaacctgaacaccatggacgagttctgcgagcaggtgtggaagagagacagaaagcagagaagacagagacccggccacacccccggcaacagcaacaagtggaagcacctgcaggagaacaagaagggcagaaacagaagaacccacgagttcgagagagcccccagaagcgtgtag

SEQ ID NO: 3608 - DNA, 4605 bp, Artificial Sequence
  Description of Artificial Sequence: Synthetic coding sequence
atggccctgacccccggctggggcagcagcgccggccccgtgagacccgagctgtggctgctgctgtgggccgccgcctggagactgggcgccagcgcctgccccgccctgtgcacctgcaccggcaccaccgtggactgccacggcaccggcctgcaggccatccccaagaacatccccagaaacaccgagagactggagctgaacggcaacaacatcaccagaatccacaagaacgacttcgccggcctgaagcagctgagagtgctgcagctgatggagaaccagatcggcgccgtggagagaggcgccttcgacgacatgaaggagctggagagactgagactgaacagaaaccagctgcacatgctgcccgagctgctgttccagaacaaccaggccctgagcagactggacctgagcgagaacgccatccaggccatccccagaaaggccttcagaggcgccaccgacctgaagaacctgcagctggacaagaaccagatcagctgcatcgaggagggcgccttcagagccctgagaggcctggaggtgctgaccctgaacaacaacaacatcaccaccatccccgtgagcagcttcaaccacatgcccaagctgagaaccttcagactgcacagcaaccacctgttctgcgactgccacctggcctggctgagccagtggctgagacagagacccaccatcggcctgttcacccagtgcagcggccccgccagcctgagaggcctgaacgtggccgaggtgcagaagagcgagttcagctgcagcggccagggcgaggccggcagagtgcccacctgcaccctgagcagcggcagctgccccgccatgtgcacctgcagcaacggcatcgtggactgcagaggcaagggcctgaccgccatccccgccaacctgcccgagaccatgaccgagatcagactggagctgaacggcatcaagagcatcccccccggcgccttcagcccctacagaaagctgagaagaatcgacctgagcaacaaccagatcgccgagatcgcccccgacgccttccagggcctgagaagcctgaacagcctggtgctgtacggcaacaagatcaccgacctgcccagaggcgtgttcggcggcctgtacaccctgcagctgctgctgctgaacgccaacaagatcaactgcatcagacccgacgccttccaggacctgcagaacctgagcctgctgagcctgtacgacaacaagatccagagcctggccaagggcaccttcaccagcctgagagccatccagaccctgcacctggcccagaaccccttcatctgcgactgcaacctgaagtggctggccgacttcctgagaaccaaccccatcgagaccagcggcgccagatgcgccagccccagaagactggccaacaagagaatcggccagatcaagagcaagaagttcagatgcagcgccaaggagcagtacttcatccccggcaccgaggactaccagctgaacagcgagtgcaacagcgacgtggtgtgcccccacaagtgcagatgcgaggccaacgtggtggagtgcagcagcctgaagctgaccaagatccccgagagaatcccccagagcaccgccgagctgagactgaacaacaacgagatcagcatcctggaggccaccggcatgttcaagaagctgacccacctgaagaagatcaacctgagcaacaacaaggtgagcgagatcgaggacggcgccttcgagggcgccgccagcgtgagcgagctgcacctgaccgccaaccagctggagagcatcagaagcggcatgttcagaggcctggacggcctgagaaccctgatgctgagaaacaacagaatcagctgcatccacaacgacagcttcaccggcctgagaaacgtgagactgctgagcctgtacgacaaccagatcaccaccgtgagccccggcgccttcgacaccctgcagagcctgagcaccctgaacctgctggccaaccccttcaactgcaactgccagctggcctggctgggcggctggctgagaaagagaaagatcgtgaccggcaaccccagatgccagaaccccgacttcctgagacagatccccctgcaggacgtggccttccccgacttcagatgcgaggagggccaggaggagggcggctgcctgcccagaccccagtgcccccaggagtgcgcctgcctggacaccgtggtgagatgcagcaacaagcacctgagagccctgcccaagggcatccccaagaacgtgaccgagctgtacctggacggcaaccagttcaccctggtgcccggccagctgagcaccttcaagtacctgcagctggtggacctgagcaacaacaagatcagcagcctgagcaacagcagcttcaccaacatgagccagctgaccaccctgatcctgagctacaacgccctgcagtgcatcccccccctggccttccagggcctgagaagcctgagactgctgagcctgcacggcaacgacatcagcaccctgcaggagggcatcttcgccgacgtgaccagcctgagccacctggccatcggcgccaaccccctgtactgcgactgccacctgagatggctgagcagctgggtgaagaccggctacaaggagcccggcatcgccagatgcgccggcccccaggacatggagggcaagctgctgctgaccacccccgccaagaagttcgagtgccagggcccccccaccctggccgtgcaggccaagtgcgacctgtgcctgagcagcccctgccagaaccagggcacctgccacaacgaccccctggaggtgtacagatgcgcctgccccagcggctacaagggcagagactgcgaggtgagcctggacagctgcagcagcggcccctgcgagaacggcggcacctgccacgcccaggagggcgaggacgcccccttcacctgcagctgccccaccggcttcgagggccccacctgcggcgtgaacaccgacgactgcgtggaccacgcctgcgccaacggcggcgtgtgcgtggacggcgtgggcaactacacctgccagtgccccctgcagtacgagggcaaggcctgcgagcagctggtggacctgtgcagccccgacctgaacccctgccagcacgaggcccagtgcgtgggcacccccgacggccccagatgcgagtgcatgcccggctacgccggcgacaactgcagcgagaaccaggacgactgcagagaccacagatgccagaacggcgcccagtgcatggacgaggtgaacagctacagctgcctgtgcgccgagggctacagcggccagctgtgcgagatccccccccacctgcccgcccccaagagcccctgcgagggcaccgagtgccagaacggcgccaactgcgtggaccagggcaacagacccgtgtgccagtgcctgcccggcttcggcggccccgagtgcgagaagctgctgagcgtgaacttcgtggacagagacacctacctgcagttcaccgacctgcagaactggcccagagccaacatcaccctgcaggtgagcaccgccgaggacaacggcatcctgctgtacaacggcgacaacgaccacatcgccgtggagctgtaccagggccacgtgagagtgagctacgaccccggcagctaccccagcagcgccatctacagcgccgagaccatcaacgacggccagttccacaccgtggagctggtggccttcgaccagatggtgaacctgagcatcgacggcggcagccccatgaccatggacaacttcggcaagcactacaccctgaacagcgaggcccccctgtacgtgggcggcatgcccgtggacgtgaacagcgccgccttcagactgtggcagatcctgaacggcaccggcttccacggctgcatcagaaacctgtacatcaacaacgagctgcaggacttcaccaagacccagatgaagcccggcgtggtgcccggctgcgagccctgcagaaagctgtactgcctgcacggcatctgccagcccaacgccacccccggccccatgtgccactgcgaggccggctgggtgggcctgcactgcgaccagcccgccgacggcccctgccacggccacaagtgcgtgcacggccagtgcgtgcccctggacgccctgagctacagctgccagtgccaggacggctacagcggcgccctgtgcaaccaggccggcgccctggccgagccctgcagaggcctgcagtgcctgcacggccactgccaggccagcggcaccaagggcgcccactgcgtgtgcgaccccggcttcagcggcgagctgtgcgagcaggagagcgagtgcagaggcgaccccgtgagagacttccaccaggtgcagagaggctacgccatctgccagaccaccagacccctgagctgggtggagtgcagaggcagctgccccggccagggctgctgccagggcctgagactgaagagaagaaagttcaccttcgagtgcagcgacggcaccagcttcgccgaggaggtggagaagcccaccaagtgcggctgcgccctgtgcgcctag

SEQ ID NO: 3609 - DNA, 342 bp, Artificial Sequence
  Description of Artificial Sequence: Synthetic coding sequence
atggacagcagacaggccgccgccctgctggtgctgctgctgctgatcgacggcggctgcgccgagggccccggcggccagcaggaggaccagctgagcgccgaggaggacagcgagcccctgcccccccaggacgcccagaccagcggcagcctgctgcactacctgctgcaggccatggagagacccggcagaagccaggccttcctgttccagccccagagattcggcagaaacacccagggcagctggagaaacgagtggctgagccccagagccggcgagggcctgaacagccagttctggagcctggccgccccccagagattcggcaagaagtag

SEQ ID NO: 3610 - DNA, 2568 bp, Artificial Sequence
  Description of Artificial Sequence: Synthetic coding sequence
atggccagacacctgctgctgcccctggtgatgctggtgatcagccccatccccggcgccttccaggacagcgccctgagccccacccaggaggagcccgaggacctggactgcggcagacccgagcccagcgccagaatcgtgggcggcagcaacgcccagcccggcacctggccctggcaggtgagcctgcaccacggcggcggccacatctgcggcggcagcctgatcgcccccagctgggtgctgagcgccgcccactgcttcatgaccaacggcaccctggagcccgccgccgagtggagcgtgctgctgggcgtgcacagccaggacggccccctggacggcgcccacaccagagccgtggccgccatcgtggtgcccgccaactacagccaggtggagctgggcgccgacctggccctgctgagactggccagccccgccagcctgggccccgccgtgtggcccgtgtgcctgcccagagccagccacagattcgtgcacggcaccgcctgctgggccaccggctggggcgacgtgcaggaggccgaccccctgcccctgccctgggtgctgcaggaggtggagctgagactgctgggcgaggccacctgccagtgcctgtacagccagcccggccccttcaacctgaccctgcagatcctgcccggcatgctgtgcgccggctaccccgagggcagaagagacacctgccagggcgacagcggcggccccctggtgtgcgaggagggcggcagatggttccaggccggcatcaccagcttcggcttcggctgcggcagaagaaacagacccggcgtgttcaccgccgtggccacctacgaggcctggatcagagagcaggtgatgggcagcgagcccggccccgccttccccacccagccccagaagacccagagcgacccccaggagcccagagaggagaactgcaccatcgccctgcccgagtgcggcaaggcccccagacccggcgcctggccctgggaggcccaggtgatggtgcccggcagcagaccctgccacggcgccctggtgagcgagagctgggtgctggcccccgccagctgcttcctggaccccaacagcagcgacagcccccccagagacctggacgcctggagagtgctgctgcccagcagacccagagccgagagagtggccagactggtgcagcacgagaacgccagctgggacaacgccagcgacctggccctgctgcagctgagaacccccgtgaacctgagcgccgccagcagacccgtgtgcctgccccaccccgagcactacttcctgcccggcagcagatgcagactggccagatggggcagaggcgagcccgccctgggccccggcgccctgctggaggccgagctgctgggcggctggtggtgccactgcctgtacggcagacagggcgccgccgtgcccctgcccggcgaccccccccacgccctgtgccccgcctaccaggagaaggaggaggtgggcagctgctggaacgacagcagatggagcctgctgtgccaggaggagggcacctggttcctggccggcatcagagacttccccagcggctgcctgagacccagagccttcttccccctgcagacccacggcccctggatcagccacgtgaccagaggcgcctacctggaggaccagctggcctgggactggggccccgacggcgaggagaccgagacccagacctgccccccccacaccgagcacggcgcctgcggcctgagactggaggccgcccccgtgggcgtgctgtggccctggctggccgaggtgcacgtggccggcgacagagtgtgcaccggcatcctgctggcccccggctgggtgctggccgccacccactgcgtgctgagacccggcagcaccaccgtgccctacatcgaggtgtacctgggcagagccggcgccagcagcctgccccagggccaccaggtgagcagactggtgatcagcatcagactgccccagcacctgggcctgagaccccccctggccctgctggagctgagcagcagagtggagcccagccccagcgccctgcccatctgcctgcaccccgccggcatcccccccggcgccagctgctgggtgctgggctggaaggagccccaggacagagtgcccgtggccgccgccgtgagcatcctgacccagagaatctgcgactgcctgtaccagggcatcctgccccccggcaccctgtgcgtgctgtacgccgagggccaggagaacagatgcgagatgaccagcgccccccccctgctgtgccagatgaccgagggcagctggatcctggtgggcatggccgtgcagggcagcagagagctgttcgccgccatcggccccgaggaggcctggatcagccagaccgtgggcgaggccaacttcctgccccccagcggcagcccccactggcccaccggcggcagcaacctgtgcccccccgagctggccaaggccagcggcagcccccacgccgtgtacttcctgctgctgctgaccctgctgatccagagctag

SEQ ID NO: 3611 - DNA, 912 bp, Artificial Sequence
  Description of Artificial Sequence: Synthetic coding sequence
atgctgcaccccgagaccagccccggcagaggccacctgctggccgtgctgctggccctgctgggcaccacctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcatccccacccccagcctggccagcggcctgtggagaaccctgcaggtgggctggaacatgcagctgctgcccgccggcctggccagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccagaccgccatcgaggccttcgtgtgcgcctacagccccagaggcaactgggaggtgaacggcaagaccatcatcccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcgagcccagcgtgccccccagatgcatcttccccagcacccccgtgacctag

SEQ ID NO: 3612 - DNA, 1158 bp, Artificial Sequence
  Description of Artificial Sequence: Synthetic coding sequence
atgaagatgctgcccggcgtgggcgtgttcggcaccggcagcagcgccagagtgctggtgcccctgctgagagccgagggcttcaccgtggaggccctgtggggcaagaccgaggaggaggccaagcagctggccgaggagatgaacatcgccttctacaccagcagaaccgacgacatcctgctgcaccaggacgtggacctggtgtgcatcagcatccccccccccctgaccagacagatcagcgtgaaggccctgggcatcggcaagaacgtggtgtgcgagaaggccgccaccagcgtggacgccttcagaatggtgaccgccagcagatactacccccagctgatgagcctggtgggcaacgtgctgagattcctgcccgccttcgtgagaatgaagcagctgatcagcgagcactacgtgggcgccgtgatgatctgcgacgccagaatctacagcggcagcctgctgagccccagctacggctggatctgcgacgagctgatgggcggcggcggcctgcacaccatgggcacctacatcgtggacctgctgacccacctgaccggcagaagagccgagaaggtgcacggcctgctgaagaccttcgtgagacagaacgccgccatcagaggcatcagacacgtgaccagcgacgacttctgcttcttccagatgctgatgggcggcggcgtgtgcagcaccgtgaccctgaacttcaacatgcccggcgccttcgtgcacgaggtgatggtggtgggcagcgccggcagactggtggccagaggcgccgacctgtacggccagaagaacagcgccacccaggaggagctgctgctgagagacagcctggccgtgggcgccggcctgcccgagcagggcccccaggacgtgcccctgctgtacctgaagggcatggtgtacatggtgcaggccctgagacagagcttccagggccagggcgacagaagaacctgggacagaacccccgtgagcatggccgccagcttcgaggacggcctgtacatgcagagcgtggtggacgccatcaagagaagcagcagaagcggcgagtgggaggccgtggaggtgctgaccgaggagcccgacaccaaccagaacctgtgcgaggccctgcagagaaacaacctgtag

SEQ ID NO: 3613 - DNA, 1470 bp, Artificial Sequence
  Description of Artificial Sequence: Synthetic coding sequence
atgcccgtgaccttcgccctgctgctgctgctgggccaggccaccgccgacccctgctacgacccccagggcagaccccagttctgcctgccccccgtgacccagctggccgccgtggccgccagctgcccccaggcctgcgccctgagccccggcaaccacctgggcgccagagagacctgcaacggcagcctgaccctggccctgggcggccccttcctgctgaccagcgtgagcctgagattctgcacccccggcccccccgccctgatcctgagcgccgcctgggccagcggcggcccctggagactgctgtggcacagacccgcctggcccggcgccctgggcggccccgagagagtgaccttccacagcacccccggccccaaggccaccgtggccgccagccacctgagagtggagttcggcggccaggccggcctggccgccgccggcctgagaggcagatgccagtgccacggccacgccgccagatgcgccgccagagccagaccccccagatgccactgcagacaccacaccaccggccccggctgcgagagctgcagacccagccacagagactggccctggagacccgccacccccagacacccccacccctgcctgccctgcagctgcaaccagcacgccagaagatgcagattcaacagcgagctgttcagactgagcggcggcagaagcggcggcgtgtgcgagagatgcagacaccacaccgccggcagacactgccactactgccagcccggcttctggagagaccccagccagcccatcttcagcagaagagcctgcagagcctgccagtgccaccccatcggcgccaccggcggcacctgcaaccagaccagcggccagtgcacctgcaagctgggcgtgaccggcctgacctgcaacagatgcggccccggctaccagcagagcagaagccccagaatgccctgccagagaatccccgaggccaccaccaccctggccaccacccccggcgcctacagcagcgacccccagtgccagaactactgcaacatgagcgacaccagagtgcacatgagcctgagaagatactgccagcaggaccacgtgctgagagcccaggtgctggccagcgaggccgccggccccgcctggcagagactggccgtgagagtgctggccgtgtacaagcagagagcccagcccgtgagaagaggcgaccaggacgcctgggtgcccagagccgacctgacctgcggctgcctgagactgcagcccggcaccgactacctgctgctgggcagcgccgtgggcgaccccgaccccaccagactgatcctggacagacacggcctggccctgccctggagacccagatgggccagacccctgaagagactgcagcaggaggagagagccggcggctgcagaggcgtgagagcccccacccccagccccagacccgagcactag

SEQ ID NO: 3614 - DNA, 8430 bp, Artificial Sequence
  Description of Artificial Sequence: Synthetic coding sequence
atgaccctggagggcctgtacctggccagaggccccctggccagactgctgctggcctggagcgccctgctgtgcatggccggcggccagggcagatgggacggcgccctggaggccgccggccccggcagagtgagaagaagaggcagccccggcatcctgcagggccccaacgtgtgcggcagcagattccacgcctactgctgccccggctggagaaccttccccggcagaagccagtgcgtggtgcccatctgcagaagagcctgcggcgagggcttctgcagccagcccaacctgtgcacctgcgccgacggcaccctggcccccagctgcggcgtgagcagaggcagcggctgcagcgtgagctgcatgaacggcggcacctgcagaggcgccagctgcctgtgccagaagggctacaccggcaccgtgtgcggccagcccatctgcgacagaggctgccacaacggcggcagatgcatcggccccaacagatgcgcctgcgtgtacggcttcatgggcccccagtgcgagagagactacagaaccggcccctgcttcggccaggtgggccccgagggctgccagcaccagctgaccggcctggtgtgcaccaaggccctgtgctgcgccaccgtgggcagagcctggggcctgccctgcgagctgtgccccgcccagccccacccctgcagaagaggcttcatccccaacatccacaccggcgcctgccaggacgtggacgagtgccaggccgtgcccggcctgtgccagggcggcagctgcgtgaacatggtgggcagcttccactgcagatgccccgtgggccacagactgagcgacagcagcgccgcctgcgaggactacagagccggcgcctgcttcagcgtgctgttcggcggcagatgcgccggcgacctggccggccactacaccagaagacagtgctgctgcgacagaggcagatgctgggccgccggccccgtgcccgagctgtgcccccccagaggcagcaacgagttccagcagctgtgcgcccagagactgcccctgctgcccggccaccccggcctgttccccggcctgctgggcttcggcagcaacggcatgggcccccccctgggccccgccagactgaacccccacggcagcgacgccagaggcatccccagcctgggccccggcaacagcaacatcggcaccgccaccctgaaccagaccatcgacatctgcagacacttcaccaacctgtgcctgaacggcagatgcctgcccacccccagcagctacagatgcgagtgcaacgtgggctacacccaggacgtgagaggcgagtgcatcgacgtggacgagtgcaccagcagcccctgccaccacggcgactgcgtgaacatccccggcacctaccactgcagatgctaccccggcttccaggccacccccaccagacaggcctgcgtggacgtggacgagtgcatcgtgagcggcggcctgtgccacctgggcagatgcgtgaacaccgagggcagcttccagtgcgtgtgcaacgccggcttcgagctgagccccgacggcaagaactgcgtggaccacaacgagtgcgccaccagcaccatgtgcgtgaacggcgtgtgcctgaacgaggacggcagcttcagctgcctgtgcaagcccggcttcctgctggcccccggcggccactactgcatggacatcgacgagtgccagacccccggcatctgcgtgaacggccactgcaccaacaccgagggcagcttcagatgccagtgcctgggcggcctggccgtgggcaccgacggcagagtgtgcgtggacacccacgtgagaagcacctgctacggcgccatcgagaagggcagctgcgccagacccttccccggcaccgtgaccaagagcgagtgctgctgcgccaaccccgaccacggcttcggcgagccctgccagctgtgccccgccaaggacagcgccgagttccaggccctgtgcagcagcggcctgggcatcaccaccgacggcagagacatcaacgagtgcgccctggaccccgaggtgtgcgccaacggcgtgtgcgagaacctgagaggcagctacagatgcgtgtgcaacctgggctacgaggccggcgccagcggcaaggactgcaccgacgtggacgagtgcgccctgaacagcctgctgtgcgacaacggctggtgccagaacagccccggcagctacagctgcagctgcccccccggcttccacttctggcaggacaccgagatctgcaaggacgtggacgagtgcctgagcagcccctgcgtgagcggcgtgtgcagaaacctggccggcagctacacctgcaagtgcggccccggcagcagactggaccccagcggcaccttctgcctggacagcaccaagggcacctgctggctgaagatccaggagagcagatgcgaggtgaacctgcagggcgccagcctgagaagcgagtgctgcgccaccctgggcgccgcctggggcagcccctgcgagagatgcgagatcgaccccgcctgcgccagaggcttcgccagaatgaccggcgtgacctgcgacgacgtgaacgagtgcgagagcttccccggcgtgtgccccaacggcagatgcgtgaacaccgccggcagcttcagatgcgagtgccccgagggcctgatgctggacgccagcggcagactgtgcgtggacgtgagactggagccctgcttcctgagatgggacgaggacgagtgcggcgtgaccctgcccggcaagtacagaatggacgtgtgctgctgcagcatcggcgccgtgtggggcgtggagtgcgaggcctgccccgaccccgagagcctggagttcgccagcctgtgccccagaggcctgggcttcgccagcagagacttcctgagcggcagacccttctacaaggacgtgaacgagtgcaaggtgttccccggcctgtgcacccacggcacctgcagaaacaccgtgggcagcttccactgcgcctgcgccggcggcttcgccctggacgcccaggagagaaactgcaccgacatcgacgagtgcagaatcagccccgacctgtgcggccagggcacctgcgtgaacacccccggcagcttcgagtgcgagtgcttccccggctacgagagcggcttcatgctgatgaagaactgcatggacgtggacgagtgcgccagagaccccctgctgtgcagaggcggcacctgcaccaacaccgacggcagctacaagtgccagtgcccccccggccacgagctgaccgccaagggcaccgcctgcgaggacatcgacgagtgcagcctgagcgacggcctgtgcccccacggccagtgcgtgaacgtgatcggcgccttccagtgcagctgccacgccggcttccagagcacccccgacagacagggctgcgtggacatcaacgagtgcagagtgcagaacggcggctgcgacgtgcactgcatcaacaccgagggcagctacagatgcagctgcggccagggctacagcctgatgcccgacggcagagcctgcgccgacgtggacgagtgcgaggagaaccccagagtgtgcgaccagggccactgcaccaacatgcccggcggccacagatgcctgtgctacgacggcttcatggccacccccgacatgagaacctgcgtggacgtggacgagtgcgacctgaacccccacatctgcctgcacggcgactgcgagaacaccaagggcagcttcgtgtgccactgccagctgggctacatggtgagaaagggcgccaccggctgcagcgacgtggacgagtgcgaggtgggcggccacaactgcgacagccacgccagctgcctgaacatccccggcagcttcagctgcagatgcctgcccggctgggtgggcgacggcttcgagtgccacgacctggacgagtgcgtgagccaggagcacagatgcagccccagaggcgactgcctgaacgtgcccggcagctacagatgcacctgcagacagggcttcgccggcgacggcttcttctgcgaggacagagacgagtgcgccgagaacgtggacctgtgcgacaacggccagtgcctgaacgcccccggcggctacagatgcgagtgcgagatgggcttcgaccccaccgaggaccacagagcctgccaggacgtggacgagtgcgcccagggcaacctgtgcgccttcggcagctgcgagaacctgcccggcatgttcagatgcatctgcaacggcggctacgagctggacagaggcggcggcaactgcaccgacatcaacgagtgcgccgaccccgtgaactgcatcaacggcgtgtgcatcaacacccccggcagctacctgtgcagctgcccccaggacttcgagctgaaccccagcggcgtgggctgcgtggacaccagagccggcaactgcttcctggagacccacgacagaggcgacagcggcatcagctgcagcgccgagatcggcgtgggcgtgaccagagccagctgctgctgcagcctgggcagagcctggggcaacccctgcgagctgtgccccatggccaacaccaccgagtacagaaccctgtgccccggcggcgagggcttccagcccaacagaatcaccgtgatcctggaggacatcgacgagtgccaggagctgcccggcctgtgccagggcggcgactgcgtgaacaccttcggcagcttccagtgcgagtgcccccccggctaccacctgagcgagcacaccagaatctgcgaggacatcgacgagtgcagcacccacagcggcatctgcggccccggcacctgctacaacaccctgggcaactacacctgcgtgtgccccgccgagtacctgcaggtgaacggcggcaacaactgcatggacatgagaaagagcgtgtgcttcagacactacaacggcacctgccagaacgagctggccttcaacgtgaccagaaagatgtgctgctgcagctacaacatcggccaggcctggaacagaccctgcgaggcctgccccacccccatcagccccgactaccagatcctgtgcggcaaccaggcccccggcttcctgaccgacatccacaccggcaagcccctggacatcgacgagtgcggcgagatccccgccatctgcgccaacggcatctgcatcaaccagatcggcagcttcagatgcgagtgccccgccggcttcaactacaacagcatcctgctggcctgcgaggacgtggacgagtgcggcagcagagagagcccctgccagcagaacgccgactgcatcaacatccccggcagctacagatgcaagtgcaccagaggctacaagctgagccccggcggcgcctgcgtgggcagaaacgagtgcagagagatccccaacgtgtgcagccacggcgactgcatggacaccgagggcagctacatgtgcctgtgccacagaggcttccaggccagcgccgaccagaccctgtgcatggacatcgacgagtgcgacagacagccctgcggcaacggcacctgcaagaacatcatcggcagctacaactgcctgtgcttccccggcttcgtggtgacccacaacggcgactgcgtggacttcgacgagtgcaccaccctggtgggccaggtgtgcagattcggccactgcctgaacaccgccggcagcttccactgcctgtgccaggacggcttcgagctgaccgccgacggcaagaactgcgtggacaccaacgagtgcctgagcctggccggcacctgcctgcccggcacctgccagaacctggagggcagcttcagatgcatctgcccccccggcttccaggtgcagagcgaccactgcatcgacatcgacgagtgcagcgaggagcccaacctgtgcctgttcggcacctgcaccaacagccccggcagcttccagtgcctgtgcccccccggcttcgtgctgagcgacaacggccacagatgcttcgacaccagacagagcttctgcttcaccagattcgaggccggcaagtgcagcgtgcccaaggccttcaacaccaccaagaccagatgctgctgcagcaagagacccggcgagggctggggcgacccctgcgagctgtgcccccaggagggcagcgccgccttccaggagctgtgccccttcggccacggcgccgtgcccggccccgacgacagcagagaggacgtgaacgagtgcgccgagaaccccggcgtgtgcaccaacggcgtgtgcgtgaacaccgacggcagcttcagatgcgagtgccccttcggctacagcctggacttcaccggcatcaactgcgtggacaccgacgagtgcagcgtgggccacccctgcggccagggcacctgcaccaacgtgatcggcggcttcgagtgcgcctgcgccgacggcttcgagcccggcctgatgatgacctgcgaggacatcgacgagtgcagcctgaaccccctgctgtgcgccttcagatgccacaacaccgagggcagctacctgtgcacctgccccgccggctacaccctgagagaggacggcgccatgtgcagagacgtggacgagtgcgccgacggccagcaggactgccacgccagaggcatggagtgcaagaacctgatcggcaccttcgcctgcgtgtgcccccccggcatgagacccctgcccggcagcggcgagggctgcaccgacgacaacgagtgccacgcccagcccgacctgtgcgtgaacggcagatgcgtgaacaccgccggcagcttcagatgcgactgcgacgagggcttccagcccagccccaccctgaccgagtgccacgacatcagacagggcccctgcttcgccgaggtgctgcagaccatgtgcagaagcctgagcagcagcagcgaggccgtgaccagagccgagtgctgctgcggcggcggcagaggctggggccccagatgcgagctgtgccccctgcccggcaccagcgcctacagaaagctgtgcccccacggcagcggctacaccgccgagggcagagacgtggacgagtgcagaatgctggcccacctgtgcgcccacggcgagtgcatcaacagcctgggcagcttcagatgccactgccaggccggctacacccccgacgccaccgccaccacctgcctggacatggacgagtgcagccaggtgcccaagccctgcaccttcctgtgcaagaacaccaagggcagcttcctgtgcagctgccccagaggctacctgctggaggaggacggcagaacctgcaaggacctggacgagtgcaccagcagacagcacaactgccagttcctgtgcgtgaacaccgtgggcgccttcacctgcagatgcccccccggcttcacccagcaccaccaggcctgcttcgacaacgacgagtgcagcgcccagcccggcccctgcggcgcccacggccactgccacaacacccccggcagcttcagatgcgagtgccaccagggcttcaccctggtgagcagcggccacggctgcgaggacgtgaacgagtgcgacggcccccacagatgccagcacggctgccagaaccagctgggcggctacagatgcagctgcccccagggcttcacccagcacagccagtgggcccagtgcgtggacgagaacgagtgcgccctgagcccccccacctgcggcagcgccagctgcagaaacaccctgggcggcttcagatgcgtgtgccccagcggcttcgacttcgaccaggccctgggcggctgccaggaggtggacgagtgcgccggcagaagaggcccctgcagctacagctgcgccaacacccccggcggcttcctgtgcggctgcccccagggctacttcagagccggccagggccactgcgtgagcggcctgggcttcagccccggcccccaggacacccccgacaaggaggagctgctgagcagcgaggcctgctacgagtgcaagatcaacggcctgagccccagagacagacccagaagaagcgcccacagagaccaccaggtgaacctggccaccctggacagcgaggccctgctgaccctgggcctgaacctgagccacctgggcagagccgagagaatcctggagctgagacccgccctggagggcctggagggcagaatcagatacgtgatcgtgagaggcaacgagcagggcttcttcagaatgcaccacctgagaggcgtgagcagcctgcagctgggcagaagaagacccggccccggcacctacagactggaggtggtgagccacatggccggcccctggggcgtgcagcccgagggccagcccggcccctggggccaggccctgagactgaaggtgcagctgcagctgctgtag

SEQ ID NO: 3615 - DNA, 303 bp, Artificial Sequence
  Description of Artificial Sequence: Synthetic coding sequence
atggagaccagacaggtgagcagaagccccagagtgagactgctgctgctgctgctgctgctgctggtggtgccctggggcgtgagaaccgccagcggcgtggccctgccccccgtgggcgtgctgagcctgagaccccccggcagagcctgggccgaccccgccacccccagacccagaagaagcctggccctggccgacgacgccgccttcagagagagagccagactgctggccgccctggagagaagacactggctgaacagctacatgcacaagctgctggtgctggacgccccctag

SEQ ID NO: 3616 - DNA, 1404 bp, Artificial Sequence
  Description of Artificial Sequence: Synthetic coding sequence
atgtggagatgccccctgggcctgctgctgctgctgcccctggccggccacctggccctgggcgcccagcagggcagaggcagaagagagctggcccccggcctgcacctgagaggcatcagagacgccggcggcagatactgccaggagcaggacctgtgctgcagaggcagagccgacgactgcgccctgccctacctgggcgccatctgctactgcgacctgttctgcaacagaaccgtgagcgactgctgccccgacttctgggacttctgcctgggcgtgcccccccccttcccccccatccagggctgcatgcacggcggcagaatctaccccgtgctgggcacctactgggacaactgcaacagatgcacctgccaggagaacagacagtggcagtgcgaccaggagccctgcctggtggaccccgacatgatcaaggccatcaaccagggcaactacggctggcaggccggcaaccacagcgccttctggggcatgaccctggacgagggcatcagatacagactgggcaccatcagacccagcagcagcgtgatgaacatgcacgagatctacaccgtgctgaaccccggcgaggtgctgcccaccgccttcgaggccagcgagaagtggcccaacctgatccacgagcccctggaccagggcaactgcgccggcagctgggccttcagcaccgccgccgtggccagcgacagagtgagcatccacagcctgggccacatgacccccgtgctgagcccccagaacctgctgagctgcgacacccaccagcagcagggctgcagaggcggcagactggacggcgcctggtggttcctgagaagaagaggcgtggtgagcgaccactgctaccccttcagcggcagagagagagacgaggccggccccgcccccccctgcatgatgcacagcagagccatgggcagaggcaagagacaggccaccgcccactgccccaacagctacgtgaacaacaacgacatctaccaggtgacccccgtgtacagactgggcagcaacgacaaggagatcatgaaggagctgatggagaacggccccgtgcaggccctgatggaggtgcacgaggacttcttcctgtacaagggcggcatctacagccacacccccgtgagcctgggcagacccgagagatacagaagacacggcacccacagcgtgaagatcaccggctggggcgaggagaccctgcccgacggcagaaccctgaagtactggaccgccgccaacagctggggccccgcctggggcgagagaggccacttcagaatcgtgagaggcgtgaacgagtgcgacatcgagagcttcgtgctgggcgtgtggggcagagtgggcatggaggacatgggccaccactag

SEQ ID NO: 3617 - DNA, 2205 bp, Artificial Sequence
  Description of Artificial Sequence: Synthetic coding sequence
atgttctacgtgtgcagcagctgcgtgttcctgtgcggcagcaacttccccaacttccccttccaggtggccagcgccaagagcgcccccgagatccccaccatcgaccaggcctacagcaagctgagcaacagcatcaccgtggagtgggccaccgtgcccggcgccaccagctacctgctgaccgccgaggacggcgacaccgtgatcgagaccaccgtggccaacagccccggcaccgtgaccggcctgaaggccgccacctggtacgagatcaccatcagaagcatcagcgccgccggcagaagccaggccagcccccccaagcaggccaagaccgtgctggccgcccccatcctggaggtgagcagccccagcagcgacagcatcctggtgcagtgggaggccgtgtacatggccatcgccttcagcgtgagcatcatgagagccaacggcctgggcagcatctggaaggagaacaccaccaacaccagcctgaccttcaccagcctggaggccggcaccctgtacaccatcaaggcctacgcctggaacgccaacagaatccccggcgacgacagcacctgcaaccagagaaccagccccagagcccccgccaacatccaggtgagcttcgacagcggcgccctgaaggccagcttcagctgggccagagccgagggcgccttcaactacaccgtgatggccctgagcgacagcagcgagctgacctgcagcaccaccttcagcagctgcaccatcagcagcctgcagtgcggcaccgagtacctgatcagcgtgctggccagcaacgacgccggcagcagcaagagcagcagcgccatgaccctgaagaccgtggcctgcgcccccggcagagtgaccatccaggaggacccccccggccacctgagcgtggcctggagcagcgtggacctgggcgactactacgtggtgttcgtgaagagcgacgacggcctggaggtgcactgcaacaccagcctgacccagtgcaacttcctgagcgagtgcggcttcacctacttcatcagcgtgttcgtgtacaacaaggccggccagagccccctgggcgacatcttcaactacaccaccgccccctgctgccccagcgacatcaaccccgtgctggtgagcagcgacagagtggagatcgtgtggagccccgtgagaggcgccgagctgtacgagaccaaggccgtggacggctacaacatggtggagtgcaacgacaccacccccgcctgcaccctgagcgccctggagtgcgacaccaagtacaacatcaccgtgtacagcttcaacgaggtgagaggcagcaacatgagctgcaccccccagttcatcaccaccgccccctgcagccccgagatcaagaacgtgagcagagacgccttcagcatgatcaacgtgcactggagaagcaccaacgacgacgccacctacaccgtgaccgcccagggcgagaagggcctgtaccagtgcagcagcaccggcgagagctgcaccatgagaggcctgccctgcggcagcgtgttcagcgtgaccgccgtggccgagacccaggccggcagaagcctgcccagctacagcgtgcccctggagaccgtgccctgctgccccaccggcctgaccgtgacccagatcacccagagcgtgatcaacgtgagctggaccatcggcagagtggcccagacccacgtggccgtgctggagagccacaccggccagagcaagtgccacacccaccagaaccactgcctgctgggctgcatcacctgcggcatcaactacaccgtgaccctgaaggccatcagcgccaccggcctgaccgccgactgcagctaccagagctacttcagcggcgcctgctgccccctgggcgtgaagctgtacagactgggccccaacggcatcagaatctactggcaggccagcagaggcagcgccaactacagcaccgacctgtacggcagcaagggcatcttcacctgcacccccagcgccggcctgagcttctgcgacgtgaccgagatcccctgcggcgacgtgtacaccgtgatggtgagccccgtggccaagaccggcctgaagctgaccttctgccccaagaagatctacagcgtgacctgcagcggcagcaccctgggcatggtgatctacagaggcaagagaaacgaggagtag

SEQ ID NO: 3618 - DNA, 1098 bp, Artificial Sequence
  Description of Artificial Sequence: Synthetic coding sequence
atgctggacggcagccccctggccagatggctggccgccgccttcggcctgaccctgctgctggccgccctgagacccagcgccgcctacttcggcctgaccggcagcgagcccctgaccatcctgcccctgaccctggagcccgaggccgccgcccaggcccactacaaggcctgcgacagactgaagctggagagaaagcagagaagaatgtgcagaagagaccccggcgtggccgagaccctggtggaggccgtgagcatgagcgccctggagtgccagttccagttcagattcgagagatggaactgcaccctggagggcagatacagagccagcctgctgaagagaggcttcaaggagaccgccttcctgtacgccatcagcagcgccggcctgacccacgccctggccaaggcctgcagcgccggcagaatggagagatgcacctgcgacgaggcccccgacctggagaacagagaggcctggcagtggggcggctgcggcgacaacctgaagtacagcagcaagttcgtgaaggagttcctgggcagaagaagcagcaaggacctgagagccagagtggacttccacaacaacctggtgggcgtgaaggtgatcaaggccggcgtggagaccacctgcaagtgccacggcgtgagcggcagctgcaccgtgagaacctgctggagacagctggcccccttccacgaggtgggcaagcacctgaagcacaagtacgagaccgccctgaaggtgggcagcaccaccaacgaggccgccggcgaggccggcgccatcagcccccccagaggcagagccagcggcgccggcggcagcgaccccctgcccagaacccccgagctggtgcacctggacgacagccccagcttctgcctggccggcagattcagccccggcaccgccggcagaagatgccacagagagaagaactgcgagagcatctgctgcggcagaggccacaacacccagagcagagtggtgaccagaccctgccagtgccaggtgagatggtgctgctacgtggagtgcagacagtgcacccagagagaggaggtgtacacctgcaagggctag

SEQ ID NO: 3619 - DNA, 795 bp, Artificial Sequence
  Description of Artificial Sequence: Synthetic coding sequence
atgagactgagacccctgcccctggtggtggtgcccggcctgctgcagctgctgttctgcgacagcaaggaggtggtgcacgccaccgagggcctggactgggaggacaaggacgcccccggcaccctggtgggcaacgtggtgcacagcagaatcatcagccccctgagactgttcgtgaagcagagccccgtgcccaagcccggccccatggcctacgccgacagcatggagaacttctgggactggctggccaacatcaccgagatccaggagcccctggccagaaccaagagaagacccatcgtgaagaccggcaagttcaagaagatgttcggctggggcgacttccacagcaacatcaagaccgtgaagctgaacctgctgatcaccggcaagatcgtggaccacggcaacggcaccttcagcgtgtacttcagacacaacagcaccggcctgggcaacgtgagcgtgagcctggtgccccccagcaaggtggtggagttcgaggtgagcccccagagcaccctggagaccaaggagagcaagagcttcaactgcagaatcgagtacgagaagaccgacagagccaagaagaccgccctgtgcaacttcgaccccagcaagatctgctaccaggagcagacccagagccacgtgagctggctgtgcagcaagcccttcaaggtgatctgcatctacatcgccttctacagcgtggactacaagctggtgcagaaggtgtgccccgactacaactaccacagcgagaccccctacctgagcagcggctag

SEQ ID NO: 3620 - DNA, 1125 bp, Artificial Sequence
  Description of Artificial Sequence: Synthetic coding sequence
atgaagcccctgctggagaccctgtacctgctgggcatgctggtgcccggcggcctgggctacgacagaagcctggcccagcacagacaggagatcgtggacaagagcgtgagcccctggagcctggagacctacagctacaacatctaccaccccatgggcgagatctacgagtggatgagagagatcagcgagaagtacaaggaggtggtgacccagcacttcctgggcgtgacctacgagacccaccccatgtactacctgaagatcagccagcccagcggcaaccccaagaagatcatctggatggactgcggcatccacgccagagagtggatcgcccccgccttctgccagtggttcgtgaaggagatcctgcagaaccacaaggacaacagcagcatcagaaagctgctgagaaacctggacttctacgtgctgcccgtgctgaacatcgacggctacatctacacctggaccaccgacagactgtggagaaagagcagaagcccccacaacaacggcacctgcttcggcaccgacctgaacagaaacttcaacgccagctggtgcagcatcggcgccagcagaaactgccaggaccagaccttctgcggcaccggccccgtgagcgagcccgagaccaaggccgtggccagcttcatcgagagcaagaaggacgacatcctgtgcttcctgaccatgcacagctacggccagctgatcctgaccccctacggctacaccaagaacaagagcagcaaccaccccgagatgatccaggtgggccagaaggccgccaacgccctgaaggccaagtacggcaccaactacagagtgggcagcagcgccgacatcctgtacgccagcagcggcagcagcagagactgggccagagacatcggcatccccttcagctacaccttcgagctgagagacagcggcacctacggcttcgtgctgcccgaggcccagatccagcccacctgcgaggagaccatggaggccgtgctgagcgtgctggacgacgtgtacgccaagcactggcacagcgacagcgccggcagagtgaccagcgccaccatgctgctgggcctgctggtgagctgcatgagcctgctgtag

SEQ ID NO: 3621 - DNA, 1728 bp, Artificial Sequence
  Description of Artificial Sequence: Synthetic coding sequence
atggccagctggctgagaagaaagctgagaggcaagagaagacccgtgatcgccttctgcctgctgatgatcctgagcgccatggccgtgaccagattccccccccagagacccagcgccggccccgaccccggccccatggagccccagggcgtgaccggcgcccccgccacccacatcagacaggccctgagcagcagcagaagacagagagccagaaacatgggcttctggagaagcagagccctgcccagaaacagcatcctggtgtgcgccgaggagcagggccacagagccagagtggacagaagcagagagagccccggcggcgacctgagacaccccggcagagtgagaagagacatcaccctgagcggccaccccagactgagcacccagcacgtggtgctgctgagagaggacgaggtgggcgaccccggcaccaaggacctgggccacccccagcacggcagccccatccaggagacccagagcgaggtggtgaccctggtgagccccctgcccggcagcgacatggccgccctgcccgcctggagagccaccagcggcctgaccctgtggccccacaccgccgagggcagagacctgctgggcgccgagaacagagccctgaccggcggccagcaggccgaggaccccaccctggccagcggcgcccaccagtggcccggcagcgtggagaagctgcagggcagcgtgtggtgcgacgccgagaccctgctgagcagcagcagaaccggcggccaggcccccccctggctgaccgaccacgacgtgcagatgctgagactgctggcccagggcgaggtggtggacaaggccagagtgcccgcccacggccaggtgctgcaggtgggcttcagcaccgaggccgccctgcaggacctgagcagccccagactgagccagctgtgcagccagggcctgtgcggcctgatcaagagacccggcgacctgcccgaggtgctgagcttccacgtggacagagtgctgggcctgagaagaagcctgcccgccgtggccagaagattccacagccccctgctgccctacagatacaccgacggcggcgccagacccgtgatctggtgggcccccgacgtgcagcacctgagcgaccccgacgaggaccagaacagcctggccctgggctggctgcagtaccaggccctgctggcccacagctgcaactggcccggccaggccccctgccccggcatccaccacaccgagtgggccagactggccctgttcgacttcctgctgcaggtgcacgacagactggacagatactgctgcggcttcgagcccgagcccagcgacccctgcgtggaggagagactgagagagaagtgccagaaccccgccgagctgagactggtgcacatcctggtgagaagcagcgaccccagccacctggtgtacatcgacaacgccggcaacctgcagcaccccgaggacaagctgaacttcagactgctggagggcatcgacggcttccccgagagcgccgtgaaggtgctggccagcggctgcctgcagaacatgctgctgaagagcctgcagatggaccccgtgttctgggagagccagggcggcgcccagggcctgaagcaggtgctgcagaccctggagcagagaggccaggtgctgctgggccacatccagaagcacaacctgaccctgttcagagacgaggacccctag

SEQ ID NO: 3622 - DNA, 1680 bp, Artificial Sequence
  Description of Artificial Sequence: Synthetic coding sequence
atgtggaccaacttcttcaagctgagactgttctgctgcctgctggccgtgctgatggtggtggtgctggtgatcaacgtgacccaggtggagtacctggaccacgagaccgtgagcgccaccttcatcgacagcagcggccagttcgtgagcagccaggtgaccggcatcagcagaaacccctactgcggctacgaccagcagaccctgagcagccaggagagaatggaggaggacagcctgctggccgccctgcacagacaggtgcccgacgtgggccccgtgcccttcgtgaagagcaccgaccccagcagcagctacttcgtgatcctgaacagcgccgccttcttcaaggtgggcagccagctggaggtgctggtgcacgtgcaggacttccagagaaagcccaagaagtacggcggcgactacctgcaggccagaatccacagcctgaagctgcaggccggcgccgtgggcagagtggtggactaccagaacggcttctacaaggtgttcttcaccctgctgtggcccggcaaggtgaaggtgagcgtgagcctggtgcaccccagcgagggcatcagagtgctgcagagactgcaggaggacaagcccgacagagtgtacttcaagagcctgttcagaagcggcagaatcagcgagaccaccgagtgcaacgtgtgcctgcccggcaacctgcccctgtgcaacttcaccgacctgtacaccggcgagccctggttctgcttcaagcccaagaagctgccctgcagcagcagaatcacccacttcaagggcggctacctgaagggcctgctgaccgccgccgagagcgccttcttccagagcggcgtgaacatcaagatgcccgtgaacagcagcggccccgactgggtgaccgtgatccccagaagaatcaaggagaccaacagcctggagctgagccagggcagcggcaccttccccagcggctactactacaaggaccagtggagacccagaaagttcaagatgagacagttcaacgaccccgacaacatcaccgagtgcctgcagagaaaggtggtgcacctgttcggcgacagcaccatcagacagtggttcgagtacctgaccaccttcgtgcccgacctggtggagttcaacctgggcagccccaagaacgtgggccccttcctggccgtggaccagaagcacaacatcctgctgaagtacagatgccacggcccccccatcagattcaccaccgtgttcagcaacgagctgcactacgtggccaacgagctgaacggcatcgtgggcggcaagaacaccgtggtggccatcgccgtgtggagccacttcagcaccttccccctggaggtgtacatcagaagactgagaaacatcagaagagccgtggtgagactgctggacagaagccccaagaccgtggtggtgatcagaaccgccaacgcccaggagctgggccccgaggtgagcctgttcaacagcgactggtacaacttccagctggacaccatcctgagaagaatgttcagcggcgtgggcgtgtacctggtggacgcctgggagatgaccctggcccactacctgccccacaagctgcaccccgacgaggtgatcgtgaagaaccagctggacatgttcctgagcttcgtgtgccccctggagacctag

SEQ ID NO: 3623 - DNA, 3624 bp, Artificial Sequence
  Description of Artificial Sequence: Synthetic coding sequence
atgagactgacccacatctgctgctgctgcctgctgtaccagctgggcttcctgagcaacggcatcgtgagcgagctgcagttcgcccccgacagagaggagtgggaggtggtgttccccgccctgtggagaagagagcccgtggaccccgccggcggcagcggcggcagcgccgaccccggctgggtgagaggcgtgggcggcggcggcagcgccagagcccaggccgccggcagcagcagagaggtgagaagcgtggcccccgtgcccctggaggagcccgtggagggcagaagcgagagcagactgagaccccccccccccagcgagggcgaggaggacgaggagctggagagccaggagctgcccagaggcagcagcggcgccgccgccctgagccccggcgcccccgccagctggcagccccccccccccccccagcccccccccagccccccccccgcccagcacgccgagcccgacggcgacgaggtgctgctgagaatccccgccttcagcagagacctgtacctgctgctgagaagagacggcagattcctggcccccagattcgccgtggagcagagacccaaccccggccccggccccaccggcgccgccagcgccccccagccccccgccccccccgacgccggctgcttctacaccggcgccgtgctgagacaccccggcagcctggccagcttcagcacctgcggcggcggcctgatgggcttcatccagctgaacgaggacttcatcttcatcgagcccctgaacgacaccatggccatcaccggccacccccacagagtgtacagacagaagagaagcatggaggagaaggtgaccgagaagagcgccctgcacagccactactgcggcatcatcagcgacaagggcagacccagaagcagaaagatcgccgagagcggcagaggcaagagatacagctacaagctgccccaggagtacaacatcgagaccgtggtggtggccgaccccgccatggtgagctaccacggcgccgacgccgccagaagattcatcctgaccatcctgaacatggtgttcaacctgttccagcacaagagcctgagcgtgcaggtgaacctgagagtgatcaagctgatcctgctgcacgagaccccccccgagctgtacatcggccaccacggcgagaagatgctggagagcttctgcaagtggcagcacgaggagttcggcaagaagaacgacatccacctggagatgagcaccaactggggcgaggacatgaccagcgtggacgccgccatcctgatcaccagaaaggacttctgcgtgcacaaggacgagccctgcgacaccgtgggcatcgcctacctgagcggcatgtgcagcgagaagagaaagtgcatcatcgccgaggacaacggcctgaacctggccttcaccatcgcccacgagatgggccacaacatgggcatcaaccacgacaacgaccaccccagctgcgccgacggcctgcacatcatgagcggcgagtggatcaagggccagaacctgggcgacgtgagctggagcagatgcagcaaggaggacctggagagattcctgagaagcaaggccagcaactgcctgctgcagaccaacccccagagcgtgaacagcgtgatggtgcccagcaagctgcccggcatgacctacaccgccgacgagcagtgccagatcctgttcggccccctggccagcttctgccaggagatgcagcacgtgatctgcaccggcctgtggtgcaaggtggagggcgagaaggagtgcagaaccaagctggacccccccatggacggcaccgactgcgacctgggcaagtggtgcaaggccggcgagtgcaccagcagaaccagcgcccccgagcacctggccggcgagtggagcctgtggagcccctgcagcagaacctgcagcgccggcatcagcagcagagagagaaagtgccccggcctggacagcgaggccagagactgcaacggccccagaaagcagtacagaatctgcgagaaccccccctgccccgccggcctgcccggcttcagagactggcagtgccaggcctacagcgtgagaaccagcagccccaagcacatcctgcagtggcaggccgtgctggacgaggagaagccctgcgccctgttctgcagccccgtgggcaaggagcagcccatcctgctgagcgagaaggtgatggacggcaccagctgcggctaccagggcctggacatctgcgccaacggcagatgccagaaggtgggctgcgacggcctgctgggcagcctggccagagaggaccactgcggcgtgtgcaacggcaacggcaagagctgcaagatcatcaagggcgacttcaaccacaccagaggcgccggctacgtggaggtgctggtgatccccgccggcgccagaagaatcaaggtggtggaggagaagcccgcccacagctacctggccctgagagacgccggcaagcagagcatcaacagcgactggaagatcgagcacagcggcgccttcaacctggccggcaccaccgtgcactacgtgagaagaggcctgtgggagaagatcagcgccaagggccccaccaccgcccccctgcacctgctggtgctgctgttccaggaccagaactacggcctgcactacgagtacaccatccccagcgaccccctgcccgagaaccagagcagcaaggcccccgagcccctgttcatgtggacccacaccagctgggaggactgcgacgccacctgcggcggcggcgagagaaagaccaccgtgagctgcaccaagatcatgagcaagaacatcagcatcgtggacaacgagaagtgcaagtacctgaccaagcccgagccccagatcagaaagtgcaacgagcagccctgccagaccagatggatgatgaccgagtggaccccctgcagcagaacctgcggcaagggcatgcagagcagacaggtggcctgcacccagcagctgagcaacggcaccctgatcagagccagagagagagactgcatcggccccaagcccgccagcgcccagagatgcgagggccaggactgcatgaccgtgtgggaggccggcgtgtggagcgagtgcagcgtgaagtgcggcaagggcatcagacacagaaccgtgagatgcaccaaccccagaaagaagtgcgtgctgagcaccagacccagagaggccgaggactgcgaggactacagcaagtgctacgtgtggagaatgggcgactggagcaagtgcagcatcacctgcggcaagggcatgcagagcagagtgatccagtgcatgcacaagatcaccggcagacacggcaacgagtgcttcagcagcgagaagcccgccgcctacagaccctgccacctgcagccctgcaacgagaagatcaacgtgaacaccatcaccagccccagactggccgccctgaccttcaagtgcctgggcgaccagtggcccgtgtactgcagagtgatcagagagaagaacctgtgccaggacatgagatggtaccagagatgctgcgagacctgcagagacttctacgcccagaagctgcagcagaagagctag

SEQ ID NO: 3624 - DNA, 258 bp, Artificial Sequence
  Description of Artificial Sequence: Synthetic coding sequence
atgaagatcaccggcggcctgctgctgctgtgcaccgtggtgtacttctgcagcagcagcgaggccgccagcctgagccccaagaaggtggactgcagcatctacaagaagtaccccgtggtggccatcccctgccccatcacctacctgcccgtgtgcggcagcgactacatcacctacggcaacgagtgccacctgtgcaccgagagcctgaagagcaacggcagagtgcagttcctgcacgacggcagctgctag

SEQ ID NO: 3625 - DNA, 2982 bp, Artificial Sequence
  Description of Artificial Sequence: Synthetic coding sequence
atgggcagcggcagagtgcccggcctgtgcctgctggtgctgctggtgcacgccagagccgcccagtacagcaaggccgcccaggacgtggacgagtgcgtggagggcaccgacaactgccacatcgacgccatctgccagaacacccccagaagctacaagtgcatctgcaagagcggctacaccggcgacggcaagcactgcaaggacgtggacgagtgcgagagagaggacaacgccggctgcgtgcacgactgcgtgaacatccccggcaactacagatgcacctgctacgacggcttccacctggcccacgacggccacaactgcctggacgtggacgagtgcgccgagggcaacggcggctgccagcagagctgcgtgaacatgatgggcagctacgagtgccactgcagagagggcttcttcctgagcgacaaccagcacacctgcatccagagacccgaggagggcatgaactgcatgaacaagaaccacggctgcgcccacatctgcagagagacccccaagggcggcatcgcctgcgagtgcagacccggcttcgagctgaccaagaaccagagagactgcaagctgacctgcaactacggcaacggcggctgccagcacacctgcgacgacaccgagcagggccccagatgcggctgccacatcaagttcgtgctgcacaccgacggcaagacctgcatcgagacctgcgccgtgaacaacggcggctgcgacagcaagtgccacgacgccgccaccggcgtgcactgcacctgccccgtgggcttcatgctgcagcccgacagaaagacctgcaaggacatcgacgagtgcagactgaacaacggcggctgcgaccacatctgcagaaacaccgtgggcagcttcgagtgcagctgcaagaagggctacaagctgctgatcaacgagagaaactgccaggacatcgacgagtgcagcttcgacagaacctgcgaccacatctgcgtgaacacccccggcagcttccagtgcctgtgccacagaggctacctgctgtacggcatcacccactgcggcgacgtggacgagtgcagcatcaacagaggcggctgcagattcggctgcatcaacacccccggcagctaccagtgcacctgccccgccggccagggcagactgcactggaacggcaaggactgcaccgagcccctgaagtgccagggcagccccggcgccagcaaggccatgctgagctgcaacagaagcggcaagaaggacacctgcgccctgacctgccccagcagagccagattcctgcccgagagcgagaacggcttcaccgtgagctgcggcacccccagccccagagccgcccccgccagagccggccacaacggcaacagcaccaacagcaaccactgccacgaggccgccgtgctgagcatcaagcagagagccagcttcaagatcaaggacgccaagtgcagactgcacctgagaaacaagggcaagaccgaggaggccggcagaatcaccggccccggcggcgccccctgcagcgagtgccaggtgaccttcatccacctgaagtgcgacagcagcagaaagggcaagggcagaagagccagaaccccccccggcaaggaggtgaccagactgaccctggagctggaggccgaggtgagagccgaggagaccaccgccagctgcggcctgccctgcctgagacagagaatggagagaagactgaagggcagcctgaagatgctgagaaagagcatcaaccaggacagattcctgctgagactggccggcctggactacgagctggcccacaagcccggcctggtggccggcgagagagccgagcccatggagagctgcagacccggccagcacagagccggcaccaagtgcgtgagctgcccccagggcacctactaccacggccagaccgagcagtgcgtgccctgccccgccggcaccttccaggagagagagggccagctgagctgcgacctgtgccccggcagcgacgcccacggccccctgggcgccaccaacgtgaccacctgcgccggccagtgcccccccggccagcacagcgtggacggcttcaagccctgccagccctgccccagaggcacctaccagcccgaggccggcagaaccctgtgcttcccctgcggcggcggcctgaccaccaagcacgagggcgccatcagcttccaggactgcgacaccaaggtgcagtgcagccccggccactactacaacaccagcatccacagatgcatcagatgcgccatgggcagctaccagcccgacttcagacagaacttctgcagcagatgccccggcaacaccagcaccgacttcgacggcagcaccagcgtggcccagtgcaagaacagacagtgcggcggcgagctgggcgagttcaccggctacatcgagagccccaactaccccggcaactaccccgccggcgtggagtgcatctggaacatcaaccccccccccaagagaaagatcctgatcgtggtgcccgagatcttcctgcccagcgaggacgagtgcggcgacgtgctggtgatgagaaagaacagcagccccagcagcatcaccacctacgagacctgccagacctacgagagacccatcgccttcaccgccagaagcagaaagctgtggatcaacttcaagaccagcgaggccaacagcgccagaggcttccagatcccctacgtgacctacgacgaggactacgagcagctggtggaggacatcgtgagagacggcagactgtacgccagcgagaaccaccaggagatcctgaaggacaagaagctgatcaaggccttcttcgaggtgctggcccacccccagaactacttcaagtacaccgagaagcacaaggagatgctgcccaagagcttcatcaagctgctgagaagcaaggtgagcagcttcctgagaccctacaagtag

SEQ ID NO: 3626 - DNA, 4773 bp, Artificial Sequence
  Description of Artificial Sequence: Synthetic coding sequence
atgcccggcggcgcctgcgtgctggtgatcgccctgatgttcctggcctggggcgaggcccaggagtgcagccccggcggccaccagttcctgagaagcccctacagaagcgtgagattcgacagctggcacctgcagcagagcgccgtgcaggacctgatctgcgaccacagcctgagccccggctggtacagattcctgatcctggacagacccgccgagatgcccaccaagtgcgtggagatgaaccactgcggcacccaggcccccatctggctgagcctgagagacagcgagaccctgcccagccccggcgagatcaagcagctgaccgcctgcgccacctggcagttcctgttcagcaccaccaaggactgctgcctgttccagatccccgtgagcgtgagaaactgcggcaacttcagcgtgtacctgctgcagcccacccagggctgcatgggctactgcgccgaggccatcagcgacgccagactgcacccctgcggcagcgacgagaccgagaccggcggcgactgcgtgagacagctggccgccagcctgccccccccccccgccggcagacccgaggtgctggtggagctgatcgagagcagactgttctgcagatgcagcttcgacgtgcccgccaccaagaacagcgtgggcttccacatcgcctggagcagactgagcagccaggaggtgaaggaggagctgacccaggagaccaccgtgcaggccttcagcctgctggagctggacggcatcaacctgagactgggcgacagaatcttctgcagcgccagcgtgttcttcctggagaacccccacgtgcagagcgtggccatcgagagccaggagttcttcgccggcttcaagctgcagcccgagctgagcaccatcagcgaggacggcaaggagtactacctgagaatcgagagcaccgtgcccatcatctgcagcgagttcagcgagctggaccaggagtgcaagatcagcctgaagctgaagaccatcggccagggcagagagcacctgggcctgaacctggccctgagcagctgccacgtggacctgctgcagaccagcagctgcgccaacggcacctgcagccacaccttcgtgtactacaccgccgtgaccgacttcagcagagacggcgacagagtgagcaacatcgtggtgcagcccatcgtgaacgaggacttcctgtggaacaactacatccccgacagcatccagatcaaggtgaaggacgtgcccaccgcctactgctacaccttcaccgacccccacatcatcaccttcgacggcagagtgtacgacaacttcaagaccggcaccttcgtgctgtacaagagcatgagcagagacttcgaggtgcacgtgagacagtgggactgcagaagcctgcactaccccgtgagctgcaactgcggcttcgtggcccaggagggcggcgacatcgtgaccttcgacatgtgcaacggccagctgagagagagccagccctacctgttcatcaagagccaggacgtgaccagaaacatcaagatcagcgagagctacctgggcagaaaggtgaccatctggttcagcagcggcgccttcatcagagccgacctgggcgagtggggcatgagcctgaccatcagagcccccagcgtggactacagaaacaccctgggcctgtgcggcaccttcgacgagaaccccgagaacgacttccacgacaagaacggcatgcagatcgaccagaacttcaacaactacgtggccttcatcaacgagtggagaatcctgcccggcaagagcatgagcgacaccctgcccgtgagcatgaccagccccggcaagcccagctactgcagctgcagcctggacaccgccgcctaccccagcagcgaggacctggacagcgtgagcagaagcgagatcgccctgggctgcaaggacctgaaccacgtgagcctgagcagcctgatccccgagctggacgtgaccagcgagtacatcaacagcgacaccctggtgagagagatcaacaagcacaccagccccgaggagtacaacctgaacctgttcctgcaggagaagaagcacatcaacctgaccaagctgggcctgaacgtgcagaagcaccccggcaacgagaaggaggacagcctgcagtacctggccaacaagaagtacacccagggcagaggcagccacagccaggagatgagatacaacagacagaacagatggaagagacagaacttccacgagttcccccccctgttcgccttccccagcctgagccagaccgacctggaggagctgacctacttcttccccgaggaccacgccgaggacgtgcagcaggagttcttccccagctggcccacccccagcggcctgaccgagtacagcaccctgaccctgtgccaggagaccctggccaacagcagcatcggcagactgtgcctggccttcctgggcaagagactggacagcgtgatcgagatgtgcgtgaaggacgtgctgctgaaggacgacctgagctgggccgaggccggcgtggccctgctggagaacgagtgcgagaagagaatcgtggaggagggcaagtacaacaccgaggagtacggcaccagcatcgaggacatcctgagcgtgctgaagtgccccaacctgtgcagcggcaacggccagtgcatggagtggggctgcgcctgcagccccagcttcagcagctacgactgcagcgacagctacgacaaggcccccgagatcaccgagctgggcaacgccggcttctgcgacgtgcagaagtacaactgcatgatggtgagagtgttcggcaagggcttcaaggagctgcccagcatcaagtgcgaggtgaccaagctgcagtacaacagcagcgagtggatgcccggcgagcccatctacacccagaccgtgttccacaacagcagagccgtggactgccagctgcccaccgacgtgcagcagttcgacaccatggacctggtgggcggcaagcccaccggcaagtggcagctgaaggtgagcaacgacggctacaagttcagcaaccccaagatcaccgtgatctacgacggcgcctgccaggtgtgcggcctgtacaagaacgacagctgcaccatcaaggagaacgtgtgcatcatcgacggcctgtgctacgtggagggcgacaagaaccccaccagcccctgcctgatctgcagacccaagatcagcagattcacctggagcttcctggagaacaaccagccccccgtgatccaggccctgcaggacaagctgcagaccttctacggcgagaacttcgagtaccagttcgtggccttcgaccccgagggcagcgacatccacttcaccctggacagcggccccgagggcgccagcgtgagcagcgccggcctgttcatgtggaagaccgacctgctgaccacccagcagatcaccgtgagactgaacgacgactgcgacgccgagaccagagtgaccatcgaggtgaccgtgaagagctgcgactgcctgaacggcggcagctgcgtgagcgacagaaacttcagccccggcagcggcgtgtacctgtgcgtgtgcctgcccggcttccacggcagcctgtgcgaggtggacatcagcggctgccagagcaacccctgcggcctgggcagctacatcagcggcttccacagctacagctgcgactgcccccccgagctgaaggtggagacccagttcgtgaaccagttcaccacccagaccgtggtgctgaccagaagcgacaagagcgtgaacaaggaggaggacgacaagaacgcccagggcagaaagagacacgtgaagcccaccagcggcaacgccttcaccatctgcaagtacccctgcggcaagagcagagagtgcgtggcccccaacatctgcaagtgcaagcccggctacatcggcagcaactgccagaccgccctgtgcgaccccgactgcaagaaccacggcaagtgcatcaagcccaacatctgccagtgcctgcccggccacggcggcgccacctgcgacgaggagcactgcaaccccccctgccagcacggcggcacctgcctggccggcaacctgtgcacctgcccctacggcttcgtgggccccagatgcgagaccatggtgtgcaacagacactgcgagaacggcggccagtgcctgacccccgacatctgccagtgcaagcccggctggtacggccccacctgcagcaccgccctgtgcgaccccgtgtgcctgaacggcggcagctgcaacaagcccaacacctgcctgtgccccaacggcttcttcggcgagcactgccagaacgccttctgccaccccccctgcaagaacggcggccactgcatgagaaacaacgtgtgcgtgtgcagagagggctacaccggcagaagattccagaagagcatctgcgaccccacctgcatgaacggcggcaagtgcgtgggccccagcacctgcagctgccccagcggctggagcggcaagagatgcaacacccccatctgcctgcagaagtgcaagaacggcggcgagtgcatcgcccccagcatctgccactgccccagcagctgggagggcgtgagatgccagatccccatctgcaaccccaagtgcctgtacggcggcagatgcatcttccccaacgtgtgcagctgcagaaccgagtacagcggcgtgaagtgcgagaagaagatccagatcagaagacactag

SEQ ID NO: 3627 - DNA, 624 bp, Artificial Sequence
  Description of Artificial Sequence: Synthetic coding sequence
atgagcaccaagcccgacatgatccagaagtgcctgtggctggagatcctgatgggcatcttcatcgccggcaccctgagcctggactgcaacctgctgaacgtgcacctgagaagagtgacctggcagaacctgagacacctgagcagcatgagcaacagcttccccgtggagtgcctgagagagaacatcgccttcgagctgccccaggagttcctgcagtacacccagcccatgaagagagacatcaagaaggccttctacgagatgagcctgcaggccttcaacatcttcagccagcacaccttcaagtactggaaggagagacacctgaagcagatccagatcggcctggaccagcaggccgagtacctgaaccagtgcctggaggaggacaagaacgagaacgaggacatgaaggagatgaaggagaacgagatgaagcccagcgaggccagagtgccccagctgagcagcctggagctgagaagatacttccacagaatcgacaacttcctgaaggagaagaagtacagcgactgcgcctgggagatcgtgagagtggagatcagaagatgcctgtactacttctacaagttcaccgccctgttcagaagaaagtag

SEQ ID NO: 3628 - DNA, 939 bp, Artificial Sequence
  Description of Artificial Sequence: Synthetic coding sequence
atggagagcgccctgcccgccgccggcttcctgtactgggtgggcgccggcaccgtggcctacctggccctgagaatcagctacagcctgttcaccgccctgagagtgtggggcgtgggcaacgaggccggcgtgggccccggcctgggcgagtgggccgtggtgaccggcagcaccgacggcatcggcaagagctacgccgaggagctggccaagcacggcatgaaggtggtgctgatcagcagaagcaaggacaagctggaccaggtgagcagcgagatcaaggagaagttcaaggtggagaccagaaccatcgccgtggacttcgccagcgaggacatctacgacaagatcaagaccggcctggccggcctggagatcggcatcctggtgaacaacgtgggcatgagctacgagtaccccgagtacttcctggacgtgcccgacctggacaacgtgatcaagaagatgatcaacatcaacatcctgagcgtgtgcaagatgacccagctggtgctgcccggcatggtggagagaagcaagggcgccatcctgaacatcagcagcggcagcggcatgctgcccgtgcccctgctgaccatctacagcgccaccaagaccttcgtggacttcttcagccagtgcctgcacgaggagtacagaagcaagggcgtgttcgtgcagagcgtgctgccctacttcgtggccaccaagctggccaagatcagaaagcccaccctggacaagcccagccccgagaccttcgtgaagagcgccatcaagaccgtgggcctgcagagcagaaccaacggctacctgatccacgccctgatgggcagcatcatcagcaacctgcccagctggatctacctgaagatcgtgatgaacatgaacaagagcaccagagcccactacctgaagaagaccaagaagaactag

SEQ ID NO: 3629 - DNA, 2214 bp, Artificial Sequence
  Description of Artificial Sequence: Synthetic coding sequence
atggagctgggctgctggacccagctgggcctgaccttcctgcagctgctgctgatcagcagcctgcccagagagtacaccgtgatcaacgaggcctgccccggcgccgagtggaacatcatgtgcagagagtgctgcgagtacgaccagatcgagtgcgtgtgccccggcaagagagaggtggtgggctacaccatcccctgctgcagaaacgaggagaacgagtgcgacagctgcctgatccaccccggctgcaccatcttcgagaactgcaagagctgcagaaacggcagctggggcggcaccctggacgacttctacgtgaagggcttctactgcgccgagtgcagagccggctggtacggcggcgactgcatgagatgcggccaggtgctgagagcccccaagggccagatcctgctggagagctaccccctgaacgcccactgcgagtggaccatccacgccaagcccggcttcgtgatccagctgagattcgtgatgctgagcctggagttcgactacatgtgccagtacgactacgtggaggtgagagacggcgacaacagagacggccagatcatcaagagagtgtgcggcaacgagagacccgcccccatccagagcatcggcagcagcctgcacgtgctgttccacagcgacggcagcaagaacttcgacggcttccacgccatctacgaggagatcaccgcctgcagcagcagcccctgcttccacgacggcacctgcgtgctggacaaggccggcagctacaagtgcgcctgcctggccggctacaccggccagagatgcgagaacctgctggaggccggcaagagcaagatcaaggccagcgaggacagcctgagcgtgctggaggagagaaactgcagcgaccccggcggccccgtgaacggctaccagaagatcaccggcggccccggcctgatcaacggcagacacgccaagatcggcaccgtggtgagcttcttctgcaacaacagctacgtgctgagcggcaacgagaagagaacctgccagcagaacggcgagtggagcggcaagcagcccatctgcatcaaggcctgcagagagcccaagatcagcgacctggtgagaagaagagtgctgcccatgcaggtgcagagcagagagacccccctgcaccagctgtacagcgccgccttcagcaagcagaagctgcagagcgcccccaccaagaagcccgccctgcccttcggcgacctgcccatgggctaccagcacctgcacacccagctgcagtacgagtgcatcagccccttctacagaagactgggcagcagcagaagaacctgcctgagaaccggcaagtggagcggcagagcccccagctgcatccccatctgcggcaagatcgagaacatcaccgcccccaagacccagggcctgagatggccctggcaggccgccatctacagaagaaccagcggcgtgcacgacggcagcctgcacaagggcgcctggttcctggtgtgcagcggcgccctggtgaacgagagaaccgtggtggtggccgcccactgcgtgaccgacctgggcaaggtgaccatgatcaagaccgccgacctgaaggtggtgctgggcaagttctacagagacgacgacagagacgagaagaccatccagagcctgcagatcagcgccatcatcctgcaccccaactacgaccccatcctgctggacgccgacatcgccatcctgaagctgctggacaaggccagaatcagcaccagagtgcagcccatctgcctggccgccagcagagacctgagcaccagcttccaggagagccacatcaccgtggccggctggaacgtgctggccgacgtgagaagccccggcttcaagaacgacaccctgagaagcggcgtggtgagcgtggtggacagcctgctgtgcgaggagcagcacgaggaccacggcatccccgtgagcgtgaccgacaacatgttctgcgccagctgggagcccaccgcccccagcgacatctgcaccgccgagaccggcggcatcgccgccgtgagcttccccggcagagccagccccgagcccagatggcacctgatgggcctggtgagctggagctacgacaagacctgcagccacagactgagcaccgccttcaccaaggtgctgcccttcaaggactggatcgagagaaacatgaagtag

SEQ ID NO: 3630 - DNA, 1503 bp, Artificial Sequence
  Description of Artificial Sequence: Synthetic coding sequence
atgggcaccgccagatggctggccctgggcagcctgttcgccctggccggcctgctggagggcagactggtgggcgaggaggaggccggcttcggcgagtgcgacaagttcttctacgccggcaccccccccgccggcctggccgccgacagccacgtgaagatctgccagagagccgagggcgccgagagattcgccaccctgtacagcaccagagacagaatccccgtgtacagcgccttcagagcccccagacccgcccccggcggcgccgagcagagatggctggtggagccccagatcgacgaccccaacagcaacctggaggaggccatcaacgaggccgaggccatcaccagcgtgaacagcctgggcagcaagcaggccctgaacaccgactacctggacagcgactaccagagaggccagctgtaccccttcagcctgagcagcgacgtgcaggtggccaccttcaccctgaccaacagcgcccccatgacccagagcttccaggagagatggtacgtgaacctgcacagcctgatggacagagccctgaccccccagtgcggcagcggcgaggacctgtacatcctgaccggcaccgtgcccagcgactacagagtgaaggacaaggtggccgtgcccgagttcgtgtggctggccgcctgctgcgccgtgcccggcggcggctgggccatgggcttcgtgaagcacaccagagacagcgacatcatcgaggacgtgatggtgaaggacctgcagaagctgctgcccttcaacccccagctgttccagaacaactgcggcgagaccgagcaggacaccgagaagatgaagaagatcctggaggtggtgaaccagatccaggacgaggagagaatggtgcagagccagaagagcagcagccccctgagcagcaccagaagcaagagaagcaccctgctgccccccgaggccagcgagggcagcagcagcttcctgggcaagctgatgggcttcatcgccacccccttcatcaagctgttccagctgatctactacctggtggtggccatcctgaagaacatcgtgtacttcctgtggtgcgtgaccaagcaggtgatcaacggcatcgagagctgcctgtacagactgggcagcgccaccatcagctacttcatggccatcggcgaggagctggtgagcatcccctggaaggtgctgaaggtggtggccaaggtgatcagagccctgctgagaatcctgtgctgcctgctgaaggccatctgcagagtgctgagcatccccgtgagagtgctggtggacgtggccaccttccccgtgtacaccatgggcgccatccccatcgtgtgcaaggacatcgccctgggcctgggcggcaccgtgagcctgctgttcgacaccgccttcggcaccctgggcggcctgttccaggtggtgttcagcgtgtgcaagagaatcggctacaaggtgaccttcgacaacagcggcgagctgtag

SEQ ID NO: 3631 - DNA, 300 bp, Artificial Sequence
  Description of Artificial Sequence: Synthetic coding sequence
atgaagagcgccaagctgggcttcctgctgagattcttcatcttctgcagcctgaacaccctgctgctgggcggcgtgaacaagatcgccgagaagatctgcggcgacctgaaggacccctgcaagctggacatgaacttcggcagctgctacgaggtgcacttcagatacttctacaacagaaccagcaagagatgcgagaccttcgtgttcagcggctgcaacggcaacctgaacaacttcaagctgaagatcgagagagaggtggcctgcgtggccaagtacaagccccccagatag

SEQ ID NO: 3632 - DNA, 390 bp, Artificial Sequence
  Description of Artificial Sequence: Synthetic coding sequence
atgcccatggccagcccccagaccctggtgctgtacctgctggtgctggccgtgaccgaggcctggggccaggaggccgtgatccccggctgccacctgcaccccttcaacgtgaccgtgagaagcgacagacagggcacctgccagggcagccacgtggcccaggcctgcgtgggccactgcgagagcagcgccttccccagcagatacagcgtgctggtggccagcggctacagacacaacatcaccagcgtgagccagtgctgcaccatcagcggcctgaagaaggtgaaggtgcagctgcagtgcgtgggcagcagaagagaggagctggagatcttcaccgccagagcctgccagtgcgacatgtgcagactgagcagatactag

SEQ ID NO: 3633 - DNA, 1965 bp, Artificial Sequence
  Description of Artificial Sequence: Synthetic coding sequence
atggccaagttcggcgtgcacagaatcctgctgctggccatcagcctgaccaagtgcctggagagcaccaagctgctggccgacctgaagaagtgcggcgacctggagtgcgaggccctgatcaacagagtgagcgccatgagagactacagaggccccgactgcagatacctgaacttcaccaagggcgaggagatcagcgtgtacgtgaagctggccggcgagagagaggacctgtgggccggcagcaagggcaaggagttcggctacttccccagagacgccgtgcagatcgaggaggtgttcatcagcgaggagatccagatgagcaccaaggagagcgacttcctgtgcctgctgggcgtgagctacaccttcgacaacgaggacagcgagctgaacggcgactacggcgagaacatctacccctacgaggaggacaaggacgagaagagcagcatctacgagagcgacttccagatcgagcccggcttctacgccacctacgagagcaccctgttcgaggaccaggtgcccgccctggaggcccccgaggacatcggcagcaccagcgagagcaaggactgggaggaggtggtggtggagagcatggagcaggacagaatccccgaggtgcacgtgccccccagcagcgccgtgagcggcgtgaaggagtggttcggcctgggcggcgagcaggccgaggagaaggccttcgagagcgtgatcgagcccgtgcaggagagcagcttcagaagcagaaagatcgccgtggaggacgagaacgacctggaggagctgaacaacggcgagccccagaccgagcaccagcaggagagcgagagcgagatcgacagcgtgcccaagacccagagcgagctggccagcgagagcgagcacatccccaagccccagagcaccggctggttcggcggcggcttcaccagctacctgggcttcggcgacgaggacaccggcctggagctgatcgccgaggagagcaacccccccctgcaggacttccccaacagcatcagcagcgacaaggaggccaccgtgccctgcaccgagatcctgaccgagaagaaggacaccatcaccaacgacagcctgagcctgaagcccagctggttcgacttcggcttcgccatcctgggcttcgcctacgccaaggaggacaagatcatgctggacgacagaaagaacgaggaggacggcggcgccgacgagcacgagcaccccctgaccagcgagctggaccccgagaaggagcaggagatcgagaccatcaagatcatcgagaccgaggaccagatcgacaagaagcccgtgagcgagaagaccgacgagagcgacaccatcccctacctgaagaagttcctgtacaacttcgacaacccctggaacttccagaacatccccaaggagaccgagctgcccttccccaagcagatcctggaccagaacaacgtgatcgagaacgaggagaccggcgagttcagcatcgacaactaccccaccgacaacaccaaggtgatgatcttcaagagcagctacagcctgagcgacatggtgagcaacatcgagctgcccaccagaatccacgaggaggtgtacttcgagcccagcagcagcaaggacagcgacgagaacagcaagcccagcgtggacaccgagggccccgccctggtggagatcgacagaagcgtggagaacaccctgctgaacagccagatggtgagcaccgacaacagcctgagcagccagaactacatcagccagaaggaggacgccagcgagttccagatcctgaagtacctgttccagatcgacgtgtacgacttcatgaacagcgccttcagccccatcgtgatcctgaccgagagagtgagcctgcccttcaagcccttcgccatcatcctgcccatcctgctgaacatcagagtggccaccaagtacgtgtag

SEQ ID NO: 3634 - DNA, 1152 bp, Artificial Sequence
  Description of Artificial Sequence: Synthetic coding sequence
atggccggcatccccggcctgctgttcctgctgttcttcctgctgtgcgccgtgggccaggtgagcccctacagcgccccctggaagcccacctggcccgcctacagactgcccgtggtgctgccccagagcaccctgaacctggccaagcccgacttcggcgccgaggccaagctggaggtgagcagcagctgcggcccccagtgccacaagggcacccccctgcccacctacgaggaggccaagcagtacctgagctacgagaccctgtacgccaacggcagcagaaccgagacccaggtgggcatctacatcctgagcagcagcggcgacggcgcccagcacagagacagcggcagcagcggcaagagcagaagaaagagacagatctacggctacgacagcagattcagcatcttcggcaaggacttcctgctgaactaccccttcagcaccagcgtgaagctgagcaccggctgcaccggcaccctggtggccgagaagcacgtgctgaccgccgcccactgcatccacgacggcaagacctacgtgaagggcacccagaagctgagagtgggcttcctgaagcccaagttcaaggacggcggcagaggcgccaacgacagcaccagcgccatgcccgagcagatgaagttccagtggatcagagtgaagagaacccacgtgcccaagggctggatcaagggcaacgccaacgacatcggcatggactacgactacgccctgctggagctgaagaagccccacaagagaaagttcatgaagatcggcgtgagcccccccgccaagcagctgcccggcggcagaatccacttcagcggctacgacaacgacagacccggcaacctggtgtacagattctgcgacgtgaaggacgagacctacgacctgctgtaccagcagtgcgacgcccagcccggcgccagcggcagcggcgtgtacgtgagaatgtggaagagacagcagcagaagtgggagagaaagatcatcggcatcttcagcggccaccagtgggtggacatgaacggcagcccccaggacttcaacgtggccgtgagaatcacccccctgaagtacgcccagatctgctactggatcaagggcaactacctggactgcagagagggctag

SEQ ID NO: 3635 - DNA, 1662 bp, Artificial Sequence
  Description of Artificial Sequence: Synthetic coding sequence
atgaagtggtgctggggccccgtgctgctgatcgccggcgccaccgtgctgatggagggcctgcaggccgcccagagagcctgcggccagagaggccccggcccccccaagccccaggagggcaacaccgtgcccggcgagtggccctggcaggccagcgtgagaagacagggcgcccacatctgcagcggcagcctggtggccgacacctgggtgctgaccgccgcccactgcttcgagaaggccgccgccaccgagctgaacagctggagcgtggtgctgggcagcctgcagagagagggcctgagccccggcgccgaggaggtgggcgtggccgccctgcagctgcccagagcctacaaccactacagccagggcagcgacctggccctgctgcagctggcccaccccaccacccacacccccctgtgcctgccccagcccgcccacagattccccttcggcgccagctgctgggccaccggctgggaccaggacaccagcgacgcccccggcaccctgagaaacctgagactgagactgatcagcagacccacctgcaactgcatctacaaccagctgcaccagagacacctgagcaaccccgccagacccggcatgctgtgcggcggcccccagcccggcgtgcagggcccctgccagggcgacagcggcggccccgtgctgtgcctggagcccgacggccactgggtgcaggccggcatcatcagcttcgccagcagctgcgcccaggaggacgcccccgtgctgctgaccaacaccgccgcccacagcagctggctgcaggccagagtgcagggcgccgccttcctggcccagagccccgagacccccgagatgagcgacgaggacagctgcgtggcctgcggcagcctgagaaccgccggcccccaggccggcgcccccagcccctggccctgggaggccagactgatgcaccagggccagctggcctgcggcggcgccctggtgagcgaggaggccgtgctgaccgccgcccactgcttcatcggcagacaggcccccgaggagtggagcgtgggcctgggcaccagacccgaggagtggggcctgaagcagctgatcctgcacggcgcctacacccaccccgagggcggctacgacatggccctgctgctgctggcccagcccgtgaccctgggcgccagcctgagacccctgtgcctgccctaccccgaccaccacctgcccgacggcgagagaggctgggtgctgggcagagccagacccggcgccggcatcagcagcctgcagaccgtgcccgtgaccctgctgggccccagagcctgcagcagactgcacgccgcccccggcggcgacggcagccccatcctgcccggcatggtgtgcaccagcgccgtgggcgagctgcccagctgcgagggcctgagcggcgcccccctggtgcacgaggtgagaggcacctggttcctggccggcctgcacagcttcggcgacgcctgccagggccccgccagacccgccgtgttcaccgccctgcccgcctacgaggactgggtgagcagcctggactggcaggtgtacttcgccgaggagcccgagcccgaggccgagcccggcagctgcctggccaacatcagccagcccaccagctgctag

SEQ ID NO: 3636 - DNA, 936 bp, Artificial Sequence
  Description of Artificial Sequence: Synthetic coding sequence
atgggcatcatccagagcatcctggccaccagcagagactgctacagcttcaagaagaagcccatccccaagaagcccaccatgctggccctggccaagatcctgctgatcagcaccctgttctacagcctgctgagcggcagccacggcaaggagaaccaggacatcaacaccacccagaacatcgccgaggtgttcaagaccatggagaacaagcccatcagcctggagagcgaggccaacctgaacagcgacaaggagaacatcaccaccagcaacctgaaggccagccacagcccccccctgaacctgcccaacaacagccacggcatcaccgacttcagcagcaacagcagcgccgagcacagcctgggcagcctgaagcccaccagcaccatcagcaccagcccccccctgatccacagcttcgtgagcaaggtgccctggaacgcccccatcgccgacgaggacctgctgcccatcagcgcccaccccaacgccacccccgccctgagcagcgagaacttcacctggagcctggtgaacgacaccgtgaagacccccgacaacagcagcatcaccgtgagcatcctgagcagcgagcccaccagccccagcgtgacccccctgatcgtggagcccagcggctggctgaccaccaacagcgacagcttcaccggcttcaccccctaccaggagaagaccaccctgcagcccaccctgaagttcaccaacaacagcaagctgttccccaacaccagcgacccccagaaggtgctgagactggacaacgcccccgagccctacgacgtgagcttcggcaacagcagctactacaaccccaccctgaacgacagcgccatgcccgagagcgaggagaacgccagagacggcatccccatggacgacatcccccccctgagaaccagcgtgtag

SEQ ID NO: 3637 - DNA, 3120 bp, Artificial Sequence
  Description of Artificial Sequence: Synthetic coding sequence
atgcagagcagactgctgctgctgggcgcccccggcggccacggcggccccgccagcagaagaatgagactgctgctgagacaggtggtgcagagaagacccggcggcgacagacagagacccgaggtgagactgctgcacgccggcagcggcgccgacaccggcgacaccgtgaacatcggcgacgtgagctacaagctgaagatccccaagaaccccgagctggtgccccagaactacatcagcgacagcctggcccagagcgtggtgcagcacctgagatggatcatgcagaaggacctgctgggccaggacgtgttcctgatcggcccccccggccccctgagaagaagcatcgccatgcagtacctggagctgaccaagagagaggtggagtacatcgccctgagcagagacaccaccgagaccgacctgaagcagagaagagagatcagagccggcaccgccttctacatcgaccagtgcgccgtgagagccgccaccgagggcagaaccctgatcctggagggcctggagaaggccgagagaaacgtgctgcccgtgctgaacaacctgctggagaacagagagatgcagctggaggacggcagattcctgatgagcgccgagagatacgacaagctgctgagagaccacaccaagaaggagctggacagctggaagatcgtgagagtgagcgagaacttcagagtgatcgccctgggcctgcccgtgcccagatacagcggcaaccccctggacccccccctgagaagcagattccaggccagagacatctactacctgcccttcaaggaccagctgaagctgctgtacagcatcggcgccaacgtgagcgccgagaaggtgagccagctgctgagcttcgccaccaccctgtgcagccaggagagcagcaccctgggcctgcccgacttccccctggacagcctggccgccgccgtgcagatcctggacagcttccccatgatgcccatcaagcacgccatccagtggctgtacccctacagcatcctgctgggccacgagggcaagatggccgtggagggcgtgctgaagagattcgagctgcaggacagcggcagcagcctgctgcccaaggagatcgtgaaggtggagaagatgatggagaaccacgtgagccaggccagcgtgaccatcagaatcgccgacaaggaggtgaccatcaaggtgcccgccggcaccagactgctgagccagccctgcgccagcgacagattcatccagaccctgagccacaagcagctgcaggccgagatgatgcagagccacatggtgaaggacatctgcctgatcggcggcaagggctgcggcaagaccgtgatcgccaagaacttcgccgacaccctgggctacaacatcgagcccatcatgctgtaccaggacatgaccgccagagacctgctgcagcagagatacaccctgcccaacggcgacaccgcctggagaagcagccccctggtgaacgccgccctggagggcaagctggtgctgctggacggcatccacagagtgaacgccggcaccctggccgtgctgcagagactgatccacgacagagagctgagcctgtacgacggcagcagactgctgagagaggacagatacatgagactgaaggaggagctgcagctgagcgacgagcagctgcagaagagaagcatcttccccatccaccccagcttcagaatcatcgccctggccgagccccccgtgatcggcagcaccgcccaccagtggctgggccccgagttcctgaccatgttcttcttccactacatgaagcccctggtgaagagcgaggagatccaggtgatcaaggagaaggtgcccaacgtgccccaggaggccctggacaagctgctgagcttcacccacaagctgagagagacccaggaccccaccgcccagagcctggccgccagcctgagcaccagacagctgctgagaatcagcagaagactgagccagtaccccaacgagaacctgcacagcgccgtgaccaaggcctgcctgagcagattcctgcccagcctggccagaagcgccctggagaagaacctggccgacgccaccatcgagatcaacaccgacgacaacctggagcccgagctgaaggactacaagtgcgaggtgaccagcggcaccctgagaatcggcgccgtgagcgcccccatctacaacgcccacgagaagatgaaggtgcccgacgtgctgttctacgacaacatccagcacgtgatcgtgatggaggacatgctgaaggacttcctgctgggcgagcacctgctgctggtgggcaaccagggcgtgggcaagaacaagatcgtggacagattcctgcacctgctgaacagacccagagagtacatccagctgcacagagacaccaccgtgcagaccctgaccctgcagcccagcgtgaaggacggcctgatcgtgtacgaggacagccccctggtgaaggccgtgaagctgggccacatcctggtggtggacgaggccgacaaggcccccaccaacgtgacctgcatcctgaagaccctggtggagaacggcgagatgatcctggccgacggcagaagaatcgtggccaacagcgccaacgtgaacggcagagagaacgtggtggtgatccaccccgacttcagaatgatcgtgctggccaacagacccggcttccccttcctgggcaacgacttcttcggcaccctgggcgacatcttcagctgccacgccgtggacaaccccaagccccacagcgagctggagatgctgagacagtacggccccaacgtgcccgagcccatcctgcagaagctggtggccgccttcggcgagctgagaagcctggccgaccagggcatcatcaactacccctacagcaccagagaggtggtgaacatcgtgaagcacctgcagaagttccccaccgagggcctgagcagcgtggtgagaaacgtgttcgacttcgacagctacaacaacgacatgagagagatcctgatcaacaccctgcacaagtacggcatccccatcggcgccaagcccaccagcgtgcagctggccaaggagtag

SEQ ID NO: 3638 - DNA, 801 bp, Artificial Sequence
  Description of Artificial Sequence: Synthetic coding sequence
atgagactgctgttcctggccgtgctgagaccccacaccggcaacgccgtgaccgcccagagagtgagagcccacctggaggccgccggccacgtgtgcgtgctgaaggacgccttcgacttcgagagcagaagcgagatcgccaacctgatcctggccgagaactgcgaggccgccctggccctgcacctgtacagaggcggcagactgctgcagggccacagaatccccttcggcgtgatcttcggcggcaccgacgtgaacgaggacgccaaccaggccgagaagaacaccgtgatgggcagagtgctggaggaggccagattcgccgtggccttcaccgagagcatgaaggagatggcccaggcccagtgggtggaccccgtgttcaccagagaggtgaaggccaaggtgaagagagccgccggcgtgagactgatcggcgagatgccccaggaggacctgcacgccgtggtgaagaactgcttcgccgtggtgaacagcagcgtgagcgagggcatgagcgccgccatcctggaggccatggacctggaggtgcccgtgctggccagaaacatccccggcaacgccgccgtggtgaagcacgaggtgaccggcctgctgttcagcaacccccaggagttcgtgcacctggccaagagactggtgagcgaccccgccctggagaaggagatcgtggtgaacggcagagagtacgtgagaatgtaccacagctggcaggtggagagagacacctaccagcagctgatcagaaagctggagggcagcaccgaggactag

SEQ ID NO: 3639 - DNA, 2478 bp, Artificial Sequence
  Description of Artificial Sequence: Synthetic coding sequence
atgttcagcggcttcaacgtgttcagagtgggcatcagcttcgtgatcatgtgcatcttctacatgcccaccgtgaacagcctgcccgagctgagcccccagaagtacttcagcaccctgcagcccggcaaggccagcctggcctacttctgccaggccgacagccccagaaccagcgtgttcctggaggagctgaacgaggccgtgagacccctgcaggactacggcatcagcgtggccaaggtgaactgcgtgaaggaggagatcagcagatactgcggcaaggagaaggacctgatgaaggcctacctgttcaagggcaacatcctgctgagagagttccccaccgacaccctgttcgacgtgaacgccatcgtggcccacgtgctgttcgccctgctgttcagcgaggtgaagtacatcaccaacctggaggacctgcagaacatcgagaacgccctgaagggcaaggccaacatcatcttcagctacgtgagagccatcggcatccccgagcacagagccgtgatggaggccgccttcgtgtacggcaccacctaccagttcgtgctgaccaccgagatcgccctgctggagagcatcggcagcgaggacgtggagtacgcccacctgtacttcttccactgcaagctggtgctggacctgacccagcagtgcagaagaaccctgatggagcagcccctgaccaccctgaacatccacctgttcatcaagaccatgaaggcccccctgctgaccgaggtggccgaggacccccagcaggtgagcaccgtgcacctgcagctgggcctgcccctggtgttcatcgtgagccagcaggccacctacgaggccgacagaagaaccgccgagtgggtggcctggagactgctgggcaaggccggcgtgctgctgctgctgagagacagcctggaggtgaacatcccccaggacgccaacgtggtgttcaagagagccgaggagggcgtgcccgtggagttcctggtgctgcacgacgtggacctgatcatcagccacgtggagaacaacatgcacatcgaggagatccaggaggacgaggacaacgacatggagggccccgacatcgacgtgcaggacgacgaggtggccgagaccgtgttcagagacagaaagagaaagctgcccctggagctgaccgtggagctgaccgaggagaccttcaacgccaccgtgatggccagcgacagcatcgtgctgttctacgccggctggcaggccgtgagcatggccttcctgcagagctacatcgacgtggccgtgaagctgaagggcaccagcaccatgctgctgaccagaatcaactgcgccgactggagcgacgtgtgcaccaagcagaacgtgaccgagttccccatcatcaagatgtacaagaagggcgagaaccccgtgagctacgccggcatgctgggcaccgaggacctgctgaagttcatccagctgaacagaatcagctaccccgtgaacatcaccagcatccaggaggccgaggagtacctgagcggcgagctgtacaaggacctgatcctgtacagcagcgtgagcgtgctgggcctgttcagccccaccatgaagaccgccaaggaggacttcagcgaggccggcaactacctgaagggctacgtgatcaccggcatctacagcgaggaggacgtgctgctgctgagcaccaagtacgccgccagcctgcccgccctgctgctggccagacacaccgagggcaagatcgagagcatccccctggccagcacccacgcccaggacatcgtgcagatcatcaccgacgccctgctggagatgttccccgagatcaccgtggagaacctgcccagctacttcagactgcagaagcccctgctgatcctgttcagcgacggcaccgtgaacccccagtacaagaaggccatcctgaccctggtgaagcagaagtacctggacagcttcaccccctgctggctgaacctgaagaacacccccgtgggcagaggcatcctgagagcctacttcgaccccctgccccccctgcccctgctggtgctggtgaacctgcacagcggcggccaggtgttcgccttccccagcgaccaggccatcatcgaggagaacctggtgctgtggctgaagaagctggaggccggcctggagaaccacatcaccatcctgcccgcccaggagtggaagccccccctgcccgcctacgacttcctgagcatgatcgacgccgccaccagccagagaggcaccagaaaggtgcccaagtgcatgaaggagaccgacgtgcaggagaacgacaaggagcagcacgaggacaagagcgccgtgagaaaggagcccatcgagaccctgagaatcaagcactggaacagaagcaactggttcaaggaggccgagaagagcttcagaagagacaaggagctgggctgcagcaaggtgaactag

SEQ ID NO: 3640 - DNA, 672 bp, Artificial Sequence
  Description of Artificial Sequence: Synthetic coding sequence
atgacctggagacaccacgtgagactgctgttcaccgtgagcctggccctgcagatcatcaacctgggcaacagctaccagagagagaagcacaacggcggcagagaggaggtgaccaaggtggccacccagaagcacagacagagccccctgaactggaccagcagccacttcggcgaggtgaccggcagcgccgagggctggggccccgaggagcccctgccctacagctgggccttcggcgagggcgccagcgccagacccagatgctgcagaaacggcggcacctgcgtgctgggcagcttctgcgtgtgccccgcccacttcaccggcagatactgcgagcacgaccagagaagaagcgagtgcggcgccctggagcacggcgcctggaccctgagagcctgccacctgtgcagatgcatcttcggcgccctgcactgcctgcccctgcagacccccgacagatgcgaccccaaggacttcctggccagccacgcccacggccccagcgccggcggcgcccccagcctgctgctgctgctgccctgcgccctgctgcacagactgctgagacccgacgcccccgcccaccccagaagcctggtgcccagcgtgctgcagagagagagaagaccctgcggcagacccggcctgggccacagactgtag

SEQ ID NO: 3641 - DNA, 1320 bp, Artificial Sequence
  Description of Artificial Sequence: Synthetic coding sequence
atgcccgccatcgccgtgctggccgccgccgccgccgcctggtgcttcctgcaggtggagagcagacacctggacgccctggccggcggcgccggccccaaccacggcaacttcctggacaacgaccagtggctgagcaccgtgagccagtacgacagagacaagtactggaacagattcagagacgacgactacttcagaaactggaaccccaacaagcccttcgaccaggccctggaccccagcaaggacccctgcctgaaggtgaagtgcagcccccacaaggtgtgcgtgacccaggactaccagaccgccctgtgcgtgagcagaaagcacctgctgcccagacagaagaagggcaacgtggcccagaagcactgggtgggccccagcaacctggtgaagtgcaagccctgccccgtggcccagagcgccatggtgtgcggcagcgacggccacagctacaccagcaagtgcaagctggagttccacgcctgcagcaccggcaagagcctggccaccctgtgcgacggcccctgcccctgcctgcccgagcccgagccccccaagcacaaggccgagagaagcgcctgcaccgacaaggagctgagaaacctggccagcagactgaaggactggttcggcgccctgcacgaggacgccaacagagtgatcaagcccaccagcagcaacaccgcccagggcagattcgacaccagcatcctgcccatctgcaaggacagcctgggctggatgttcaacaagctggacatgaactacgacctgctgctggaccccagcgagatcaacgccatctacctggacaagtacgagccctgcatcaagcccctgttcaacagctgcgacagcttcaaggacggcaagctgagcaacaacgagtggtgctactgcttccagaagcccggcggcctgccctgccagaacgagatgaacagaatccagaagctgagcaagggcaagagcctgctgggcgccttcatccccagatgcaacgaggagggctactacaaggccacccagtgccacggcagcaccggccagtgctggtgcgtggacaagtacggcaacgagctggccggcagcagaaagcagggcgccgtgagctgcgaggaggagcaggagaccagcggcgacttcggcagcggcggcagcgtggtgctgctggacgacctggagtacgagagagagctgggccccaaggacaaggagggcaagctgagagtgcacaccagagccgtgaccgaggacgacgaggacgaggacgacgacaaggaggacgaggtgggctacatctggtag

SEQ ID NO: 3642 - DNA, 7872 bp, Artificial Sequence
  Description of Artificial Sequence: Synthetic coding sequence
atgaaggtgaagggcagaggcatcacctgcctgctggtgagcttcgccgtgatctgcctggtggccacccccggcggcaaggcctgccccagaagatgcgcctgctacatgcccaccgaggtgcactgcaccttcagatacctgaccagcatccccgacagcatcccccccaacgtggagagaatcaacctgggctacaacagcctggtgagactgatggagaccgacttcagcggcctgaccaagctggagctgctgatgctgcacagcaacggcatccacaccatccccgacaagaccttcagcgacctgcaggccctgcaggtgctgaagatgagctacaacaaggtgagaaagctgcagaaggacaccttctacggcctgagaagcctgaccagactgcacatggaccacaacaacatcgagttcatcaaccccgaggtgttctacggcctgaacttcctgagactggtgcacctggagggcaaccagctgaccaagctgcaccccgacaccttcgtgagcctgagctacctgcagatcttcaagatcagcttcatcaagttcctgtacctgagcgacaacttcctgaccagcctgccccaggagatggtgagctacatgcccgacctggacagcctgtacctgcacggcaacccctggacctgcgactgccacctgaagtggctgagcgactggatccaggagaagcccgacgtgatcaagtgcaagaaggacagaagccccagcagcgcccagcagtgccccctgtgcatgaaccccagaaccagcaagggcaagcccctggccatggtgagcgccgccgccttccagtgcgccaagcccaccatcgacagcagcctgaagagcaagagcctgaccatcctggaggacagcagcagcgccttcatcagcccccagggcttcatggcccccttcggcagcctgaccctgaacatgaccgaccagagcggcaacgaggccaacatggtgtgcagcatccagaagcccagcagaaccagccccatcgccttcaccgaggagaacgactacatcgtgctgaacaccagcttcagcaccttcctggtgtgcaacatcgactacggccacatccagcccgtgtggcagatcctggccctgtacagcgacagccccctgatcctggagagaagccacctgctgagcgagaccccccagctgtactacaagtacaagcaggtggcccccaagcccgaggacatcttcaccaacatcgaggccgacctgagagccgaccccagctggctgatgcaggaccagatcagcctgcagctgaacagaaccgccaccaccttcagcaccctgcagatccagtacagcagcgacgcccagatcaccctgcccagagccgagatgagacccgtgaagcacaagtggaccatgatcagcagagacaacaacaccaagctggagcacaccgtgctggtgggcggcaccgtgggcctgaactgccccggccagggcgaccccaccccccacgtggactggctgctggccgacggcagcaaggtgagagccccctacgtgagcgaggacggcagaatcctgatcgacaagagcggcaagctggagctgcagatggccgacagcttcgacaccggcgtgtaccactgcatcagcagcaactacgacgacgccgacatcctgacctacagaatcaccgtggtggagcccctggtggaggcctaccaggagaacggcatccaccacaccgtgttcatcggcgagaccctggacctgccctgccacagcaccggcatccccgacgccagcatcagctgggtgatccccggcaacaacgtgctgtaccagagcagcagagacaagaaggtgctgaacaacggcaccctgagaatcctgcaggtgacccccaaggaccagggctactacagatgcgtggccgccaaccccagcggcgtggacttcctgatcttccaggtgagcgtgaagatgaagggccagagacccctggagcacgacggcgagaccgagggcagcggcctggacgagagcaaccccatcgcccacctgaaggagccccccggcgcccagctgagaaccagcgccctgatggaggccgaggtgggcaagcacaccagcagcaccagcaagagacacaactacagagagctgaccctgcagagaagaggcgacagcacccacagaagattcagagagaacagaagacacttcccccccagcgccagaagaatcgacccccagcactgggccgccctgctggagaaggccaagaagaacgccatgcccgacaagagagagaacaccaccgtgagccccccccccgtggtgacccagctgcccaacatccccggcgaggaggacgacagcagcggcatgctggccctgcacgaggagttcatggtgcccgccaccaaggccctgaacctgcccgccagaaccgtgaccgccgacagcagaaccatcagcgacagccccatgaccaacatcaactacggcaccgagttcagccccgtggtgaacagccagatcctgccccccgaggagcccaccgacttcaagctgagcaccgccatcaagaccaccgccatgagcaagaacatcaaccccaccatgagcagccagatccagggcaccaccaaccagcacagcagcaccgtgttccccctgctgctgggcgccaccgagttccaggacagcgaccagatgggcagaggcagagagcacttccagagcagaccccccatcaccgtgagaaccatgatcaaggacgtgaacgtgaagatgctgagcagcaccaccaacaagctgctgctggagagcgtgaacaccaccaacagccaccagaccagcgtgagagaggtgagcgagcccagacacaaccacttctacagccacaccacccagatcctgagcaccagcaccttccccagcgacccccacaccgccgcccacagccagttccccatccccagaaacagcaccgtgaacatccccctgttcagaagattcggcagacagagaaagatcggcggcagaggcagaatcatcagcccctacagaacccccgtgctgagaagacacagatacagcatcttcagaagcaccaccagaggcagcagcgagaagagcaccaccgccttcagcgccaccgtgctgaacgtgacctgcctgagctgcctgcccagagagagactgaccaccgccaccgccgccctgagcttccccagcgccgcccccatcaccttccccaaggccgacatcgccagagtgcccagcgaggagagcaccaccctggtgcagaaccccctgctgctgctggagaacaagcccagcgtggagaagaccacccccaccatcaagtacttcagaaccgagatcagccaggtgacccccaccggcgccgtgatgacctacgcccccaccagcatccccatggagaagacccacaaggtgaacgccagctaccccagagtgagcagcaccaacgaggccaagagagacagcgtgatcaccagcagcctgagcggcgccatcaccaagccccccatgaccatcatcgccatcaccagattcagcagaagaaagatcccctggcagcagaacttcgtgaacaaccacaaccccaagggcagactgagaaaccagcacaaggtgagcctgcagaagagcaccgccgtgatgctgcccaagaccagccccgccctgcccagagacaaggtgagccccttccacttcaccaccctgagcaccagcgtgatgcagatccccagcaacaccctgaccaccgcccaccacaccaccaccaagacccacaaccccggcagcctgcccaccaagaaggagctgcccttcccccccctgaaccccatgctgcccagcatcatcagcaaggacagcagcaccaagagcatcatcagcacccagaccgccatccccgccaccacccccaccttccccgccagcgtgatcacctacgagacccagaccgagagaagcagagcccagaccatccagagagagcaggagccccagaagaagaacagaaccgaccccaacatcagccccgaccagagcagcggcttcaccacccccaccgccatgaccccccccgtgctgaccaccgccgagaccagcgtgaagcccagcgtgagcgccttcacccacagcccccccgagaacaccaccggcatcagcagcaccatcagcttccacagcagaaccctgaacctgaccgacgtgatcgaggagctggcccaggccagcacccagaccctgaagagcaccatcgccagcgagaccaccctgagcagcaagagccaccagagcaccaccaccagaaaggccatcatcagacacagcaccatcccccccttcctgagcagcagcgccaccctgatgcccgtgcccatcagcccccccttcacccagagagccgtgaccgacaacgtggccacccccatcagcggcctgatgaccaacaccgtggtgaagctgcacgagagcagcagacacaacgccaagccccagcagctggtggccgaggtggccaccagccccaaggtgcaccccaacgccaagttcaccatcggcaccacccacttcatctacagcaacctgctgcacagcacccccatgcccgccctgaccaccgtgaagagccagaacagcaagctgacccccagcccctgggccgagaaccagttctggcacaagccctacagcgagatcgccgagaagggcaagaagcccgaggtgagcatgctggccaccaccggcctgagcgaggccaccaccctggtgagcgactgggacggccagaagaacaccaagaagagcgacttcgacaagaagcccgtgcaggaggccaccaccagcaagctgctgcccttcgacagcctgagcagatacatcttcgagaagcccagaatcgtgggcggcaaggccgccagcttcaccatccccgccaacagcgacgccttcctgccctgcgaggccgtgggcaaccccctgcccaccatccactggaccagagtgcccagcggcctggacctgagcaagagaaagcagaacagcagagtgcaggtgctgcccaacggcaccctgagcatccagagagtggagatccaggacagaggccagtacctgtgcagcgccagcaacctgttcggcaccgaccacctgcacgtgaccctgagcgtggtgagctacccccccagaatcctggagagaagaaccaaggagatcaccgtgcacagcggcagcaccgtggagctgaagtgcagagccgagggcagacccagccccaccgtgacctggatcctggccaaccagaccgtggtgagcgagagcagccagggcagcagacaggccgtggtgaccgtggacggcaccctggtgctgcacaacctgagcatctacgacagaggcttctacaagtgcgtggccagcaaccccggcggccaggacagcctgctggtgaagatccaggtgatcgccgccccccccgtgatcctggagcagagaagacaggtgatcgtgggcacctggggcgagagcctgaagctgccctgcaccgccaagggcaccccccagcccagcgtgtactgggtgctgagcgacggcaccgaggtgaagcccctgcagttcaccaacagcaagctgttcctgttcagcaacggcaccctgtacatcagaaacctggccagcagcgacagaggcacctacgagtgcatcgccaccagcagcaccggcagcgagagaagagtggtgatgctgaccatggaggagagagtgaccagccccagaatcgaggccgccagccagaagagaaccgaggtgaacttcggcgacaagctgctgctgaactgcagcgccaccggcgagcccaagccccagatcatgtggagactgcccagcaaggccgtggtggaccagcagcacagagtgggcagctggatccacgtgtaccccaacggcagcctgttcatcggcagcgtgaccgagaaggacagcggcgtgtacctgtgcgtggccagaaacaagatgggcgacgacctgatcctgatgcacgtgagcctgagactgaagcccgccaagatcgaccacaagcagtacttcagaaagcaggtgctgcacggcaaggacttccaggtggactgcaaggccagcggcagccccgtgcccgagatcagctggagcctgcccgacggcaccatgatcaacaacgccatgcaggccgacgacagcggccacagaaccagaagatacaccctgttcaacaacggcaccctgtacttcaacaaggtgggcgtggccgaggagggcgactacacctgctacgcccagaacaccctgggcaaggacgagatgaaggtgcacctgaccgtgatcaccgccgcccccagaatcagacagagcaacaagaccaacaagagaatcaaggccggcgacaccgccgtgctggactgcgaggtgaccggcgaccccaagcccaagatcttctggctgctgcccagcaacgacatgatcagcttcagcatcgacagatacaccttccacgccaacggcagcctgaccatcaacaaggtgaagctgctggacagcggcgagtacgtgtgcgtggccagaaaccccagcggcgacgacaccaagatgtacaagctggacgtggtgagcaagccccccctgatcaacggcctgtacaccaacagaaccgtgatcaaggccaccgccgtgagacacagcaagaagcacttcgactgcagagccgagggcacccccagccccgaggtgatgtggatcatgcccgacaacatcttcctgaccgccccctactacggcagcagaatcaccgtgcacaagaacggcaccctggagatcagaaacgtgagactgagcgacagcgccgacttcatctgcgtggccagaaacgagggcggcgagagcgtgctggtggtgcagctggaggtgctggagatgctgagaagacccaccttcagaaaccccttcaacgagaagatcgtggcccagctgggcaagagcaccgccctgaactgcagcgtggacggcaaccccccccccgagatcatctggatcctgcccaacggcaccagattcagcaacggcccccagagctaccagtacctgatcgccagcaacggcagcttcatcatcagcaagaccaccagagaggacgccggcaagtacagatgcgccgccagaaacaaggtgggctacatcgagaagctggtgatcctggagatcggccagaagcccgtgatcctgacctacgcccccggcaccgtgaagggcatcagcggcgagagcctgagcctgcactgcgtgagcgacggcatccccaagcccaacatcaagtggaccatgcccagcggctacgtggtggacagaccccagatcaacggcaagtacatcctgcacgacaacggcaccctggtgatcaaggaggccaccgcctacgacagaggcaactacatctgcaaggcccagaacagcgtgggccacaccctgatcaccgtgcccgtgatgatcgtggcctacccccccagaatcaccaacagaccccccagaagcatcgtgaccagaaccggcgccgccttccagctgcactgcgtggccctgggcgtgcccaagcccgagatcacctgggagatgcccgaccacagcctgctgagcaccgccagcaaggagagaacccacggcagcgagcagctgcacctgcagggcaccctggtgatccagaacccccagaccagcgacagcggcatctacaagtgcaccgccaagaaccccctgggcagcgactacgccgccacctacatccaggtgatctag

SEQ ID NO: 3643 - DNA, 1995 bp, Artificial Sequence
  Description of Artificial Sequence: Synthetic coding sequence
atgaagaccggcctgttcttcctgtgcctgctgggcaccgccgccgccatccccaccaacgccagactgctgagcgaccacagcaagcccaccgccgagaccgtggcccccgacaacaccgccatccccagcctgagagccgaggccgaggagaacgagaaggagaccgccgtgagcaccgaggacgacagccaccacaaggccgagaagagcagcgtgctgaagagcaaggaggagagccacgagcagagcgccgagcagggcaagagcagcagccaggagctgggcctgaaggaccaggaggacagcgacggccacctgagcgtgaacctggagtacgcccccaccgagggcaccctggacatcaaggaggacatgagcgagccccaggagaagaagctgagcgagaacaccgacttcctggcccccggcgtgagcagcttcaccgacagcaaccagcaggagagcatcaccaagagagaggagaaccaggagcagcccagaaactacagccaccaccagctgaacagaagcagcaagcacagccagggcctgagagaccagggcaaccaggagcaggaccccaacatcagcaacggcgaggaggaggaggagaaggagcccggcgaggtgggcacccacaacgacaaccaggagagaaagaccgagctgcccagagagcacgccaacagcaagcaggaggaggacaacacccagagcgacgacatcctggaggagagcgaccagcccacccaggtgagcaagatgcaggaggacgagttcgaccagggcaaccaggagcaggaggacaacagcaacgccgagatggaggaggagaacgccagcaacgtgaacaagcacatccaggagaccgagtggcagagccaggagggcaagaccggcctggaggccatcagcaaccacaaggagaccgaggagaagaccgtgagcgaggccctgctgatggagcccaccgacgacggcaacaccacccccagaaaccacggcgtggacgacgacggcgacgacgacggcgacgacggcggcaccgacggccccagacacagcgccagcgacgactacttcatccccagccaggccttcctggaggccgagagagcccagagcatcgcctaccacctgaagatcgaggagcagagagagaaggtgcacgagaacgagaacatcggcaccaccgagcccggcgagcaccaggaggccaagaaggccgagaacagcagcaacgaggaggagaccagcagcgagggcaacatgagagtgcacgccgtggacagctgcatgagcttccagtgcaagagaggccacatctgcaaggccgaccagcagggcaagccccactgcgtgtgccaggaccccgtgacctgcccccccaccaagcccctggaccaggtgtgcggcaccgacaaccagacctacgccagcagctgccacctgttcgccaccaagtgcagactggagggcaccaagaagggccaccagctgcagctggactacttcggcgcctgcaagagcatccccacctgcaccgacttcgaggtgatccagttccccctgagaatgagagactggctgaagaacatcctgatgcagctgtacgaggccaacagcgagcacgccggctacctgaacgagaagcagagaaacaaggtgaagaagatctacctggacgagaagagactgctggccggcgaccaccccatcgacctgctgctgagagacttcaagaagaactaccacatgtacgtgtaccccgtgcactggcagttcagcgagctggaccagcaccccatggacagagtgctgacccacagcgagctggcccccctgagagccagcctggtgcccatggagcactgcatcaccagattcttcgaggagtgcgaccccaacaaggacaagcacatcaccctgaaggagtggggccactgcttcggcatcaaggaggaggacatcgacgagaacctgctgttctag

SEQ ID NO: 3644 - DNA, 1254 bp, Artificial Sequence
  Description of Artificial Sequence: Synthetic coding sequence
atgctggccctgctggtgctggtgaccgtggccctggccagcgcccaccacggcggcgagcacttcgagggcgagaaggtgttcagagtgaacgtggaggacgagaaccacatcaacatcatcagagagctggccagcaccacccagatcgacttctggaagcccgacagcgtgacccagatcaagccccacagcaccgtggacttcagagtgaaggccgaggacaccgtgaccgtggagaacgtgctgaagcagaacgagctgcagtacaaggtgctgatcagcaacctgagaaacgtggtggaggcccagttcgacagcagagtgagagccaccggccacagctacgagaagtacaacaagtgggagaccatcgaggcctggacccagcaggtggccaccgagaaccccgccctgatcagcagaagcgtgatcggcaccaccttcgagggcagagccatctacctgctgaaggtgggcaaggccggccagaacaagcccgccatcttcatggactgcggcttccacgccagagagtggatcagccccgccttctgccagtggttcgtgagagaggccgtgagaacctacggcagagagatccaggtgaccgagctgctggacaagctggacttctacgtgctgcccgtgctgaacatcgacggctacatctacacctggaccaagagcagattctggagaaagaccagaagcacccacaccggcagcagctgcatcggcaccgaccccaacagaaacttcgacgccggctggtgcgagatcggcgccagcagaaacccctgcgacgagacctactgcggccccgccgccgagagcgagaaggagaccaaggccctggccgacttcatcagaaacaagctgagcagcatcaaggcctacctgaccatccacagctacagccagatgatgatctacccctacagctacgcctacaagctgggcgagaacaacgccgagctgaacgccctggccaaggccaccgtgaaggagctggccagcctgcacggcaccaagtacacctacggccccggcgccaccaccatctaccccgccgccggcggcagcgacgactgggcctacgaccagggcatcagatacagcttcaccttcgagctgagagacaccggcagatacggcttcctgctgcccgagagccagatcagagccacctgcgaggagaccttcctggccatcaagtacgtggccagctacgtgctggagcacctgtactag

SEQ ID NO: 3645 - DNA, 588 bp, Artificial Sequence
  Description of Artificial Sequence: Synthetic coding sequence
atggccgtgagccagggcgacggcaccctgtgcttcgtgctgctgctgtgctgctggcaggagaccgagctgagacccagaaccgtgatccccggcagccccaccgagatccccttcagcagcaagcaggaggacatgagcgagctgctggacgagatcctggtgcaggagatcctggacctgaacaagaccacccccagcgagatgcccagcaccgccagcaccctgagcacccccctgcacgccggcatcgacgagaactaccaggccggcggcagcgagaactaccacgagctgctggagaacctgcagttcagccccggcatcgaggtgaagatcagcaacgacgaggccaacgccaacgccaacctgcacggcgaccccagcgagaactacagaggcccccaggtgagccccggcagcgagaagagcgtgagcagcaaggagaagaacagcaagaacacccagtacgagaacctgagcatcctggaccagatcctgcagaacatcggcagaagcagcggcaacatcttccacaaggagcagcagagaaccagcgcccagagaagaagccagggcagccagtag

SEQ ID NO: 3646 - DNA, 2334 bp, Artificial Sequence
  Description of Artificial Sequence: Synthetic coding sequence
atgaacgccaacaaggacgagagactgaaggccagaagccaggacttccacctgttccccgccctgatgatgctgagcatgaccatgctgttcctgcccgtgaccggcaccctgaagcagaacatccccagactgaagctgacctacaaggacctgctgctgagcaacagctgcatccccttcctgggcagcagcgagggcctggacttccagaccctgctgctggacgaggagagaggcagactgctgctgggcgccaaggaccacatcttcctgctgagcctggtggacctgaacaagaacttcaagaagatctactggcccgccgccaaggagagagtggagctgtgcaagctggccggcaaggacgccaacaccgagtgcgccaacttcatcagagtgctgcagccctacaacaagacccacatctacgtgtgcggcaccggcgccttccaccccatctgcggctacatcgacctgggcgtgtacaaggaggacatcatcttcaagctggacacccacaacctggagagcggcagactgaagtgccccttcgacccccagcagcccttcgccagcgtgatgaccgacgagtacctgtacagcggcaccgccagcgacttcctgggcaaggacaccgccttcaccagaagcctgggccccacccacgaccaccactacatcagaaccgacatcagcgagcactactggctgaacggcgccaagttcatcggcaccttcttcatccccgacacctacaaccccgacgacgacaagatctacttcttcttcagagagagcagccaggagggcagcaccagcgacaagaccatcctgagcagagtgggcagagtgtgcaagaacgacgtgggcggccagagaagcctgatcaacaagtggaccaccttcctgaaggccagactgatctgcagcatccccggcagcgacggcgccgacacctacttcgacgagctgcaggacatctacctgctgcccaccagagacgagagaaaccccgtggtgtacggcgtgttcaccaccaccagcagcatcttcaagggcagcgccgtgtgcgtgtacagcatggccgacatcagagccgtgttcaacggcccctacgcccacaaggagagcgccgaccacagatgggtgcagtacgacggcagaatcccctaccccagacccggcacctgccccagcaagacctacgaccccctgatcaagagcaccagagacttccccgacgacgtgatcagcttcatcaagagacacagcgtgatgtacaagagcgtgtaccccgtggccggcggccccaccttcaagagaatcaacgtggactacagactgacccagatcgtggtggaccacgtgatcgccgaggacggccagtacgacgtgatgttcctgggcaccgacatcggcaccgtgctgaaggtggtgagcatcagcaaggagaagtggaacatggaggaggtggtgctggaggagctgcagatcttcaagcacagcagcatcatcctgaacatggagctgagcctgaagcagcagcagctgtacatcggcagcagagacggcctggtgcagctgagcctgcacagatgcgacacctacggcaaggcctgcgccgactgctgcctggccagagacccctactgcgcctgggacggcaacgcctgcagcagatacgcccccaccagcaagagaagagccagaagacaggacgtgaagtacggcgaccccatcacccagtgctgggacatcgaggacagcatcagccacgagaccgccgacgagaaggtgatcttcggcatcgagttcaacagcaccttcctggagtgcatccccaagagccagcaggccaccatcaagtggtacatccagagaagcggcgacgagcacagagaggagctgaagcccgacgagagaatcatcaagaccgagtacggcctgctgatcagaagcctgcagaagaaggacagcggcatgtactactgcaaggcccaggagcacaccttcatccacaccatcgtgaagctgaccctgaacgtgatcgagaacgagcagatggagaacacccagagagccgagcacgaggagggcaaggtgaaggacctgctggccgagagcagactgagatacaaggactacatccagatcctgagcagccccaacttcagcctggaccagtactgcgagcagatgtggcacagagagaagagaagacagagaaacaagggcggccccaagtggaagcacatgcaggagatgaagaagaagagaaacagaagacaccacagagacctggacgagctgcccagagccgtggccacctag

SEQ ID NO: 3647 - DNA, 1332 bp, Artificial Sequence
  Description of Artificial Sequence: Synthetic coding sequence
atgcagcccagcgagatggtgatgaaccccaagcaggtgttcctgagcgtgctgatcttcggcgtggccggcctgctgctgttcatgtacctgcaggtgtggatcgaggagcagcacaccggcagagtggagaagagaagagagcagaaggtgaccagcggctggggccccgtgaagtacctgagacccgtgcccagaatcatgagcaccgagaagatccaggagcacatcaccaaccagaaccccaagttccacatgcccgaggacgtgagagagaagaaggagaacctgctgctgaacagcgagagaagcaccagactgctgaccaagaccagccacagccagggcggcgaccaggccctgagcaagagcaccggcagccccaccgagaagctgatcgagaagagacagggcgccaagaccgtgttcaacaagttcagcaacatgaactggcccgtggacatccaccccctgaacaagagcctggtgaaggacaacaagtggaagaagaccgaggagacccaggagaagagaagaagcttcctgcaggagttctgcaagaagtacggcggcgtgagccaccaccagagccacctgttccacaccgtgagcagaatctacgtggaggacaagcacaagatcctgtactgcgaggtgcccaaggccggctgcagcaactggaagagaatcctgatggtgctgaacggcctggccagcagcgcctacaacatcagccacaacgccgtgcactacggcaagcacctgaagaagctggacagcttcgacctgaagggcatctacaccagactgaacacctacaccaaggccgtgttcgtgagagaccccatggagagactggtgagcgccttcagagacaagttcgagcaccccaacagctactaccaccccgtgttcggcaaggccatcatcaagaagtacagacccaacgcctgcgaggaggccctgatcaacggcagcggcgtgaagttcaaggagttcatccactacctgctggacagccacagacccgtgggcatggacatccactgggagaaggtgagcaagctgtgctacccctgcctgatcaactacgacttcgtgggcaagttcgagaccctggaggaggacgccaactacttcctgcagatgatcggcgcccccaaggagctgaagttccccaacttcaaggacagacacagcagcgacgagagaaccaacgcccaggtggtgagacagtacctgaaggacctgaccagaaccgagagacagctgatctacgacttctactacctggactacctgatgttcaactacaccacccccttcctgtag

SEQ ID NO: 3648 - DNA, 3228 bp, Artificial Sequence
  Description of Artificial Sequence: Synthetic coding sequence
atgagaggcggcaagtgcaacatgctgagcagcctgggctgcctgctgctgtgcggcagcatcaccctggccctgggcaacgcccagaagctgcccaagggcaagagacccaacctgaaggtgcacatcaacaccaccagcgacagcatcctgctgaagttcctgagacccagccccaacgtgaagctggagggcctgctgctgggctacggcagcaacgtgagccccaaccagtacttccccctgcccgccgagggcaagttcaccgaggccatcgtggacgccgagcccaagtacctgatcgtggtgagacccgcccccccccccagccagaagaagagctgcagcggcaagaccagaagcagaaagcccctgcagctggtggtgggcaccctgacccccagcagcgtgttcctgagctggggcttcctgatcaacccccaccacgactggaccctgcccagccactgccccaacgacagattctacaccatcagatacagagagaaggacaaggagaagaagtggatcttccagatctgccccgccaccgagaccatcgtggagaacctgaagcccaacaccgtgtacgagttcggcgtgaaggacaacgtggagggcggcatctggagcaagatcttcaaccacaagaccgtggtgggcagcaagaaggtgaacggcaagatccagagcacctacgaccaggaccacaccgtgcccgcctacgtgcccagaaagctgatccccatcaccatcatcaagcaggtgatccagaacgtgacccacaaggacagcgccaagagccccgagaaggcccccctgggcggcgtgatcctggtgcacctgatcatccccggcctgaacgagaccaccgtgaagctgcccgccagcctgatgttcgagatcagcgacgccctgaagacccagctggccaagaacgagaccctggccctgcccgccgagagcaagacccccgaggtggagaagatcagcgccagacccaccaccgtgacccccgagaccgtgcccagaagcaccaagcccaccaccagcagcgccctggacgtgagcgagaccaccctggccagcagcgagaagccctggatcgtgcccaccgccaagatcagcgaggacagcaaggtgctgcagccccagaccgccacctacgacgtgttcagcagccccaccaccagcgacgagcccgagatcagcgacagctacaccgccaccagcgacagaatcctggacagcatcccccccaagaccagcagaaccctggagcagcccagagccaccctggcccccagcgagacccccttcgtgccccagaagctggagatcttcaccagccccgagatgcagcccaccacccccgccccccagcagaccaccagcatccccagcacccccaagagaagacccagacccaagccccccagaaccaagcccgagagaaccaccagcgccggcaccatcacccccaagatcagcaagagccccgagcccacctggaccacccccgcccccggcaagacccagttcatcagcctgaagcccaagatccccctgagccccgaggtgacccacaccaagcccgcccccaagcagacccccagagccccccccaagcccaagaccagccccagacccagaatcccccagacccagcccgtgcccaaggtgccccagagagtgaccgccaagcccaagaccagccccagccccgaggtgagctacaccacccccgcccccaaggacgtgctgctgccccacaagccctaccccgaggtgagccagagcgagcccgcccccctggagaccagaggcatccccttcatccccatgatcagccccagccccagccaggaggagctgcagaccaccctggaggagaccgaccagagcacccaggagcccttcaccaccaagatccccagaaccaccgagctggccaagaccacccaggccccccacagattctacaccaccgtgagacccagaaccagcgacaagccccacatcagacccggcgtgaagcaggcccccagacccagcggcgccgacagaaacgtgagcgtggacagcacccaccccaccaagaagcccggcaccagaagaccccccctgccccccagacccacccaccccagaagaaagcccctgccccccaacaacgtgaccggcaagcccggcagcgccggcatcatcagcagcggccccatcaccaccccccccctgagaagcacccccagacccaccggcacccccctggagagaatcgagaccgacatcaagcagcccaccgtgcccgccagcggcgaggagctggagaacatcaccgacttcagcagcagccccaccagagagaccgaccccctgggcaagcccagattcaagggcccccacgtgagatacatccagaagcccgacaacagcccctgcagcatcaccgacagcgtgaagagattccccaaggaggaggccaccgagggcaacgccaccagccccccccagaacccccccaccaacctgaccgtggtgaccgtggagggctgccccagcttcgtgatcctggactgggagaagcccctgaacgacaccgtgaccgagtacgaggtgatcagcagagagaacggcagcttcagcggcaagaacaagagcatccagatgaccaaccagaccttcagcaccgtggagaacctgaagcccaacaccagctacgagttccaggtgaagcccaagaaccccctgggcgagggccccgtgagcaacaccgtggccttcagcaccgagagcgccgaccccagagtgagcgagcccgtgagcgccggcagagacgccatctggaccgagagacccttcaacagcgacagctacagcgagtgcaagggcaagcagtacgtgaagagaacctggtacaagaagttcgtgggcgtgcagctgtgcaacagcctgagatacaagatctacctgagcgacagcctgaccggcaagttctacaacatcggcgaccagagaggccacggcgaggaccactgccagttcgtggacagcttcctggacggcagaaccggccagcagctgaccagcgaccagctgcccatcaaggagggctacttcagagccgtgagacaggagcccgtgcagttcggcgagatcggcggccacacccagatcaactacgtgcagtggtacgagtgcggcaccaccatccccggcaagtggtag

SEQ ID NO: 3649 - DNA, 483 bp, Artificial Sequence
  Description of Artificial Sequence: Synthetic coding sequence
atgctgcccttcctgttcttcagcaccctgttcagcagcatcttcaccgaggcccagaagcagtactgggtgtgcaacagcagcgacgccagcatcagctacacctactgcgacaagatgcagtaccccatcagcatcaacgtgaacccctgcatcgagctgaagagaagcaagggcctgctgcacatcttctacatccccagaagagacctgaagcagctgtacttcaacctgtacatcaccgtgaacaccatgaacctgcccaagagaaaggaggtgatctgcagaggcagcgacgacgactacagcttctgcagagccctgaagggcgagaccgtgaacaccaccatcagcttcagcttcaagggcatcaagttcagcaagggcaagtacaagtgcgtggtggaggccatcagcggcagccccgaggagatgctgttctgcctggagttcgtgatcctgcaccagcccaacagcaactag

SEQ ID NO: 3650 - DNA, 780 bp, Artificial Sequence
  Description of Artificial Sequence: Synthetic coding sequence
atggccgccctgatgagaagcaaggacagcagctgctgcctgctgctgctggccgccgtgctgatggtggagagcagccagatcggcagcagcagagccaagctgaacagcatcaagagcagcctgggcggcgagacccccggccaggccgccaacagaagcgccggcatgtaccagggcctggccttcggcggcagcaagaagggcaagaacctgggccaggcctacccctgcagcagcgacaaggagtgcgaggtgggcagatactgccacagcccccaccagggcagcagcgcctgcatggtgtgcagaagaaagaagaagagatgccacagagacggcatgtgctgccccagcaccagatgcaacaacggcatctgcatccccgtgaccgagagcatcctgaccccccacatccccgccctggacggcaccagacacagagacagaaaccacggccactacagcaaccacgacctgggctggcagaacctgggcagaccccacaccaagatgagccacatcaagggccacgagggcgacccctgcctgagaagcagcgactgcatcgagggcttctgctgcgccagacacttctggaccaagatctgcaagcccgtgctgcaccagggcgaggtgtgcaccaagcagagaaagaagggcagccacggcctggagatcttccagagatgcgactgcgccaagggcctgagctgcaaggtgtggaaggacgccacctacagcagcaaggccagactgcacgtgtgccagaagatctag

SEQ ID NO: 3651 - DNA, 3030 bp, Artificial Sequence
  Description of Artificial Sequence: Synthetic coding sequence
atgggccagctgtgctggctgcccctgctggcccccctgctgctgctgagaccccccggcgtgcagagcgccggccccatcagagccttcgtggtgccccacagccacatggacgtgggctgggtgtacaccgtgcaggagagcatgagagcctacgccgccaacgtgtacaccagcgtggtggaggagctggccagaggccagcagagaagattcatcgccgtggagcaggagttcttcagactgtggtgggacggcgtggccagcgaccagcagaagtaccaggtgagacagctgctggaggagggcagactggagttcgtgatcggcggccaggtgatgcacgacgaggccgtgacccacctggacgaccagatcctgcagctgaccgagggccacggcttcctgtacgagaccttcggcatcagaccccagttcagctggcacgtggaccccttcggcgccagcgccaccacccccaccctgttcgccctggccggcttcaacgcccacctgggcagcagaatcgactacgacctgaaggccgccatgcaggaggccagaggcctgcagttcgtgtggagaggcagccccagcctgagcgagagacaggagatcttcacccacatcatggaccagtacagctactgcacccccagccacatccccttcagcaacagaagcggcttctactggaacggcgtggccgtgttccccaagcccccccaggacggcgtgtaccccaacatgagcgagcccgtgacccccgccaacatcaacctgtacgccgaggccctggtggccaacgtgaagcagagagccgcctggttcagaaccccccacgtgctgtggccctggggctgcgacaagcagttcttcaacgccagcgtgcagttcgccaacatggaccccctgctggaccacatcaacagccacgccgccgagctgggcgtgagcgtgcagtacgccaccctgggcgactacttcagagccctgcacgccctgaacgtgacctggagagtgagagaccaccacgacttcctgccctacagcaccgagcccttccaggcctggaccggcttctacaccagcagaagcagcctgaagggcctggccagaagagccagcgccctgctgtacgccggcgagagcatgttcaccagatacctgtggcccgcccccagaggccacctggaccccacctgggccctgcagcagctgcagcagctgagatgggccgtgagcgaggtgcagcaccacgacgccatcaccggcaccgagagccccaaggtgagagacatgtacgccacccacctggccagcggcatgctgggcatgagaaagctgatggccagcatcgtgctggacgagctgcagccccaggcccccatggccgccagcagcgacgccggccccgccggccacttcgccagcgtgtacaaccccctggcctggaccgtgaccaccatcgtgaccctgaccgtgggcttccccggcgtgagagtgaccgacgaggccggccaccccgtgcccagccagatccagaacagcaccgagacccccagcgcctacgacctgctgatcctgaccaccatccccggcctgagctacagacactacaacatcagacccaccgccggcgcccaggagggcacccaggagcccgccgccaccgtggccagcaccctgcagttcggcagaagactgagaagaagaaccagccacgccggcagatacctggtgcccgtggccaacgactgctacatcgtgctgctggaccaggacaccaacctgatgcacagcatctgggagagacagagcaacagaaccgtgagagtgacccaggagttcctggagtaccacgtgaacggcgacgtgaagcagggccccatcagcgacaactacctgttcacccccggcaaggccgccgtgcccgcctgggaggccgtggagatggagatcgtggccggccagctggtgaccgagatcagacagtacttctacagaaacatgaccgcccagaactacacctacgccatcagaagcagactgacccacgtgccccagggccacgacggcgagctgctgtgccacagaatcgagcaggagtaccaggccggccccctggagctgaacagagaggccgtgctgagaaccagcaccaacctgaacagccagcaggtgatctacagcgacaacaacggctaccagatgcagagaagaccctacgtgagctacgtgaacaacagcatcgccagaaactactaccccatggtgcagagcgccttcatggaggacggcaagagcagactggtgctgctgagcgagagagcccacggcatcagcagccagggcaacggccaggtggaggtgatgctgcacagaagactgtggaacaacttcgactgggacctgggctacaacctgaccctgaacgacaccagcgtggtgcaccccgtgctgtggctgctgctgggcagctggagcctgaccaccgccctgagacagagaagcgccctggccctgcagcacagacccgtggtgctgttcggcgacctggccggcaccgcccccaagctgcccggcccccagcagcaggaggccgtgaccctgccccccaacctgcacctgcagatcctgagcatccccggctggagatacagcagcaaccacaccgagcacagccagaacctgagaaagggccacagaggcgaggcccaggccgacctgagaagagtgctgctgagactgtaccacctgtacgaggtgggcgaggaccccgtgctgagccagcccgtgaccgtgaacctggaggccgtgctgcaggccctgggcagcgtggtggccgtggaggagagaagcctgaccggcacctgggacctgagcatgctgcacagatggagctggagaaccggccccggcagacacagaggcgacaccaccagccccagcagaccccccggcggccccatcatcaccgtgcaccccaaggagatcagaaccttcttcatccacttccagcagcagtag

SEQ ID NO: 3652 - DNA, 1443 bp, Artificial Sequence
  Description of Artificial Sequence: Synthetic coding sequence
atgctgttcagaaacagattcctgctgctgctggccctggccgccctgctggccttcgtgagcctgagcctgcagttcttccacctgatccccgtgagcacccccaagaacggcatgagcagcaagagcagaaagagaatcatgcccgaccccgtgaccgagccccccgtgaccgaccccgtgtacgaggccctgctgtactgcaacatccccagcgtggccgagagaagcatggagggccacgccccccaccacttcaagctggtgagcgtgcacgtgttcatcagacacggcgacagataccccctgtacgtgatccccaagaccaagagacccgagatcgactgcaccctggtggccaacagaaagccctaccaccccaagctggaggccttcatcagccacatgagcaagggcagcggcgccagcttcgagagccccctgaacagcctgcccctgtaccccaaccaccccctgtgcgagatgggcgagctgacccagaccggcgtggtgcagcacctgcagaacggccagctgctgagagacatctacctgaagaagcacaagctgctgcccaacgactggagcgccgaccagctgtacctggagaccaccggcaagagcagaaccctgcagagcggcctggccctgctgtacggcttcctgcccgacttcgactggaagaagatctacttcagacaccagcccagcgccctgttctgcagcggcagctgctactgccccgtgagaaaccagtacctggagaaggagcagagaagacagtacctgctgagactgaagaacagccagctggagaagacctacggcgagatggccaagatcgtggacgtgcccaccaagcagctgagagccgccaaccccatcgacagcatgctgtgccacttctgccacaacgtgagcttcccctgcaccagaaacggctgcgtggacatggagcacttcaaggtgatcaagacccaccagatcgaggacgagagagagagaagagagaagaagctgtacttcggctacagcctgctgggcgcccaccccatcctgaaccagaccatcggcagaatgcagagagccaccgagggcagaaaggaggagctgttcgccctgtacagcgcccacgacgtgaccctgagccccgtgctgagcgccctgggcctgagcgaggccagattccccagattcgccgccagactgatcttcgagctgtggcaggacagagagaagcccagcgagcacagcgtgagaatcctgtacaacggcgtggacgtgaccttccacaccagcttctgccaggaccaccacaagagaagccccaagcccatgtgccccctggagaacctggtgagattcgtgaagagagacatgttcgtggccctgggcggcagcggcaccaactactacgacgcctgccacagagagggcttctag

SEQ ID NO: 3653 - DNA, 1341 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcacccccacccccagcctggccagcggcctgtggagaaccctgcaggtgggctggaacatgcagctgctgcccgccggcctggtgagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcggcgcccagtgcgccaccaaggtgcacttccccttccacacctgcgacctgagaatcgacggcgactgcttcatggtgagcagcgaggccgacacctactacagagccagaatgaagtgccagagaaagggcggcgtgctggcccagatcaagagccagaaggtgcaggacatcctggccttctacctgggcagactggagaccaccaacgaggtgatcgacagcgacttcgagaccagaaacttctggatcggcctgacctacaagaccgccaaggacagcttcagatgggccaccggcgagcaccaggccttcaccagcttcgccttcggccagcccgacaaccacggcttcggcaactgcgtggagctgcaggccagcgccgccttcaactggaacgaccagagatgcaagaccagaaacagatacatctgccagttcgcccaggagcacatcagcagatggggccccggcagctag

SEQ ID NO: 3654 - DNA, 2313 bp, Artificial Sequence
  Description of Artificial Sequence: Synthetic coding sequence
atggtggagagcgccggcagagccggccagaagagacccggcttcctggagggcggcctgctgctgctgctgctgctggtgaccgccgccctggtggccctgggcgtgctgtacgccgacagaagaggcaagcagctgcccagactggccagcagactgtgcttcctgcaggaggagagaaccttcgtgaagagaaagcccagaggcatccccgaggcccaggaggtgagcgaggtgtgcaccacccccggctgcgtgatcgccgccgccagaatcctgcagaacatggaccccaccaccgagccctgcgacgacttctaccagttcgcctgcggcggctggctgagaagacacgtgatccccgagaccaacagcagatacagcatcttcgacgtgctgagagacgagctggaggtgatcctgaaggccgtgctggagaacagcaccgccaaggacagacccgccgtggagaaggccagaaccctgtacagaagctgcatgaaccagagcgtgatcgagaagagaggcagccagcccctgctggacatcctggaggtggtgggcggctggcccgtggccatggacagatggaacgagaccgtgggcctggagtgggagctggagagacagctggccctgatgaacagccagttcaacagaagagtgctgatcgacctgttcatctggaacgacgaccagaacagcagcagacacatcatctacatcgaccagcccaccctgggcatgcccagcagagagtactacttcaacggcggcagcaacagaaaggtgagagaggcctacctgcagttcatggtgagcgtggccaccctgctgagagaggacgccaacctgcccagagacagctgcctggtgcaggaggacatggtgcaggtgctggagctggagacccagctggccaaggccaccgtgccccaggaggagagacacgacgtgatcgccctgtaccacagaatgggcctggaggagctgcagagccagttcggcctgaagggcttcaactggaccctgttcatccagaccgtgctgagcagcgtgaagatcaagctgctgcccgacgaggaggtggtggtgtacggcatcccctacctgcagaacctggagaacatcatcgacacctacagcgccagaaccatccagaactacctggtgtggagactggtgctggacagaatcggcagcctgagccagagattcaaggacaccagagtgaactacagaaaggccctgttcggcaccatggtggaggaggtgagatggagagagtgcgtgggctacgtgaacagcaacatggagaacgccgtgggcagcctgtacgtgagagaggccttccccggcgacagcaagagcatggtgagagagctgatcgacaaggtgagaaccgtgttcgtggagaccctggacgagctgggctggatggacgaggagagcaagaagaaggcccaggagaaggccatgagcatcagagagcagatcggccaccccgactacatcctggaggagatgaacagaagactggacgaggagtacagcaacctgaacttcagcgaggacctgtacttcgagaacagcctgcagaacctgaaggtgggcgcccagagaagcctgagaaagctgagagagaaggtggaccccaacctgtggatcatcggcgccgccgtggtgaacgccttctacagccccaacagaaaccagatcgtgttccccgccggcatcctgcagccccccttcttcagcaaggagcagccccaggccctgaacttcggcggcatcggcatggtgatcggccacgagatcacccacggcttcgacgacaacggcagaaacttcgacaagaacggcaacatgatggactggtggagcaacttcagcacccagcacttcagagagcagagcgagtgcatgatctaccagtacggcaactacagctgggacctggccgacgagcagaacgtgaacggcttcaacaccctgggcgagaacatcgccgacaacggcggcgtgagacaggcctacaaggcctacctgaagtggatggccgagggcggcaaggaccagcagctgcccggcctggacctgacccacgagcagctgttcttcatcaactacgcccaggtgtggtgcggcagctacagacccgagttcgccatccagagcatcaagaccgacgtgcacagccccctgaagtacagagtgctgggcagcctgcagaacctggccgccttcgccgacaccttccactgcgccagaggcacccccatgcaccccaaggagagatgcagagtgtggtag

SEQ ID NO: 3655 - DNA, 1317 bp, Artificial Sequence
  Description of Artificial Sequence: Synthetic coding sequence
atgagcaagagagacaaggccggcaaggacaccgccagaggcaagggcaaggacatcagcaagtacggcagcgtgcagaagagcttcgccgacagaggcctgcccaagccccccaaggagaagctgctgcaggtggagaagctgagaaaggagagcggcaagggcagcttcctgcagcccaccgccaagcccagagccctggcccagcagcaggccgtgatcagaggcttcacctactacaaggccggcaagcaggaggtgaccgaggccgtggccgacaacaccctgcagggcaccagctggctggagcagctgccccccaaggtggagggcagaagcaacagcgccgagcccaacagcgccgagcaggacgaggccgagcccagaagcagcgagagagtggacctggccagcggcacccccaccagcatccccgccaccaccaccaccgccaccaccacccccacccccaccaccagcctgctgcccaccgagccccccagcggccccgaggtgagcagccagggcagagaggccagctgcgagggcaccctgagagccgtggacccccccgtgagacaccacagctacggcagacacgagggcgcctggatgaaggaccccgccgccagagacgacagaatctacgtgaccaactactactacggcaacagcctggtggagttcagaaacctggagaacttcaagcagggcagatggagcaacatgtacaagctgccctacaactggatcggcaccggccacgtggtgtaccagggcgccttctactacaacagagccttcaccaagaacatcatcaagtacgacctgagacagagattcgtggccagctgggccctgctgcccgacgtggtgtacgaggacaccaccccctggaagtggagaggccacagcgacatcgacttcgccgtggacgagagcggcctgtgggtgatctaccccgccgtggacgacagagacgaggcccagcccgaggtgatcgtgctgagcagactggaccccggcgacctgagcgtgcacagagagaccacctggaagaccagactgagaagaaacagctacggcaactgcttcctggtgtgcggcatcctgtacgccgtggacacctacaaccagcaggagggccaggtggcctacgccttcgacacccacaccggcaccgacgccagaccccagctgcccttcctgaacgagcacgcctacaccacccagatcgactacaaccccaaggagagagtgctgtacgcctgggacaacggccaccagctgacctacaccctgcacttcgtggtgtag

SEQ ID NO: 3656 - DNA, 3570 bp, Artificial Sequence
  Description of Artificial Sequence: Synthetic coding sequence
atgcccggcctgctgaactggatcaccggcgccgccctgcccctgaccgccagcgacgtgaccagctgcgtgagcggctacgccctgggcctgaccgccagcctgacctacggcaacctggaggcccagcccttccagggcctgttcgtgtaccccctggacgagtgcaccaccgtgatcggcttcgaggccgtgatcgccgacagagtggtgaccgtgcagatcaaggacaaggccaagctggagagcggccacttcgacgccagccacgtgagaagccccaccgtgaccggcaacatcctgcaggacggcgtgagcatcgccccccacagctgcacccccggcaaggtgaccctggacgaggacctggagagaatcctgttcgtggccaacctgggcaccatcgcccccatggagaacgtgaccatcttcatcagcaccagcagcgagctgcccaccctgcccagcggcgccgtgagagtgctgctgcccgccgtgtgcgcccccaccgtgccccagttctgcaccaagagcaccggcaccagcaaccagcaggcccagggcaaggacagacactgcttcggcgcctgggcccccggcagctggaacaagctgtgcctggccaccctgctgaacaccgaggtgagcaaccccatggagtacgagttcaacttccagctggagatcagaggcccctgcctgctggccggcgtggagagccccacccacgagatcagagccgacgccgcccccagcgccagaagcgccaagagcatcatcatcaccctggccaacaagcacaccttcgacagacccgtggagatcctgatccaccccagcgagccccacatgccccacgtgctgatcgagaagggcgacatgaccctgggcgagttcgaccagcacctgaagggcagaaccgacttcatcaagggcatgaagaagaagagcagagccgagagaaagaccgagatcatcagaaagagactgcacaaggacatcccccaccacagcgtgatcatgctgaacttctgccccgacctgcagagcgtgcagccctgcctgagaaaggcccacggcgagttcatcttcctgatcgacagaagcagcagcatgagcggcatcagcatgcacagagtgaaggacgccatgctggtggccctgaagagcctgatgcccgcctgcctgttcaacatcatcggcttcggcagcaccttcaagagcctgttccccagcagccagacctacagcgaggacagcctggccatggcctgcgacgacatccagagaatgaaggccgacatgggcggcaccaacatcctgagccccctgaagtgggtgatcagacagcccgtgcacagaggccaccccagactgctgttcgtgatcaccgacggcgccgtgaacaacaccggcaaggtgctggagctggtgagaaaccacgccttcagcaccagatgctacagcttcggcatcggccccaacgtgtgccacagactggtgaagggcctggccagcgtgagcgagggcagcgccgagctgctgatggagggcgagagactgcagcccaagatggtgaagagcctgaagaaggccatggcccccgtgctgagcgacgtgaccgtggagtggatcttccccgagaccaccgaggtgctggtgagccccgtgagcgccagcagcctgttccccggcgagagactggtgggctacggcatcgtgtgcgacgccagcctgcacatcagcaaccccagaagcgacaagagaagaagatacagcatgctgcacagccaggagagcggcagcagcgtgttctaccacagccaggacgacggccccggcctggagggcggcgactgcgccaagaacagcggcgcccccttcatcctgggccaggccaagaacgccagactggccagcggcgacagcaccaccaagcacgacctgaacctgagccagagaagaagagcctacagcaccaaccagatcaccaaccacaagcccctgcccagagccaccatggccagcgaccccatgcccgccgccaagagataccccctgagaaaggccagactgcaggacctgaccaaccagaccagcctggacgtgcagagatggcagatcgacctgcagcccctgctgaacagcggccaggacctgaaccagggccccaagctgagaggccccggcgccagaagacccagcctgctgccccagggctgccagcccttcctgccctggggccaggagacccaggcctggagccccgtgagagagagaaccagcgacagcagaagccccggcgacctggagcccagccaccaccccagcgccttcgagaccgagaccagcagcgactgggacccccccgccgagagccaggagagagccagccccagcagacccgccacccccgcccccgtgctgggcaaggccctggtgaagggcctgcacgacagccagagactgcagtgggaggtgagcttcgagctgggcacccccggccccgagagaggcggcgcccaggacgccgacctgtggagcgagaccttccaccacctggccgccagagccatcatcagagacttcgagcagctggccgagagagagggcgagatcgagcagggcagcaacagaagataccaggtgagcgccctgcacaccagcaaggcctgcaacatcatcagcaagtacaccgccttcgtgcccgtggacgtgagcaagagcagatacctgcccaccgtggtggagtaccccaacagcgccgccctgagaatgctgggcagcagagccctggcccagcagtggagaggcaccagcagcggcttcggcagaccccagaccatgctgggcgaggacagcgcccccggcaacggcccccagagaagcctggccaccaacaccctgagcagcatgaaggccagcgagaacctgttcggcagctggctgaacctgaacaagagcagactgctgaccagagccgccaagggcttcctgagcaagcccctgatcaaggccgtggagagcaccagcggcaaccagagcttcgactacatccccctggtgagcctgcagctggccagcggcgccttcctgctgaacgaggccttctgcgaggccacccacatccccatggagaagctgaagtggaccagccccttcacctgccacagagtgagcctgaccaccagacccagcgagagcaagacccccagcccccagctgtgcaccagcagcccccccagacaccccagctgcgacagcttcagcctggagcccctggccaagggcaagctgggcctggagcccagagccgtggtggagcacaccggcaagctgtgggccaccgtggtgggcctggcctggctggagcacagcagcgccagctacttcaccgagtgggagctggtggccgccaaggccaacagctggctggagcagcaggaggtgcccgagggcagaacccagggcaccctgaaggccgccgccagacagctgttcgtgctgctgagacactgggacgagaacctggagttcaacatgctgtgctacaaccccaactacgtgtag

SEQ ID NO: 3657 - DNA, 1344 bp, Artificial Sequence
  Description of Artificial Sequence: Synthetic coding sequence
atgccccacgtgctgatcgagaagggcgacatgaccctgggcgagttcgaccagcacctgaagggcagaaccgacttcatcaagggcatgaagaagaagagcagagccgagagaaagaccgagatcatcagaaagagactgcacaaggacatcccccaccacagcgtgatcatgctgaacttctgccccgacctgcagagcgtgcagccctgcctgagaaaggcccacggcgagttcatcttcctgatcgacagaagcagcagcatgagcggcatcagcatgcacagagtgaaggacgccatgctggtggccctgaagagcctgatgcccgcctgcctgttcaacatcatcggcttcggcagcaccttcaagagcctgttccccagcagccagacctacagcgaggacagcctggccatggcctgcgacgacatccagagaatgaaggccgacatgggcggcaccaacatcctgagccccctgaagtgggtgatcagacagcccgtgcacagaggccaccccagactgctgttcgtgatcaccgacggcgccgtgaacaacaccggcaaggtgctggagctggtgagaaaccacgccttcagcaccagatgctacagcttcggcatcggccccaacgtgtgccacagactggtgaagggcctggccagcgtgagcgagggcagcgccgagctgctgatggagggcgagagactgcagcccaagatggtgaagagcctgaagaaggccatggcccccgtgctgagcgacgtgaccgtggagtggatcttccccgagaccaccgaggtgctggtgagccccgtgagcgccagcagcctgttccccggcgagagactggtgggctacggcatcgtgtgcgacgccagcctgcacatcagcaaccccagaagcgacaagagaagaagatacagcatgctgcacagccaggagagcggcagcagcgtgttctaccacagccaggacgacggccccggcctggagggcggcgactgcgccaagaacagcggcgcccccttcatcctgggccaggccaagaacgccagactggccagcggcgacagcaccaccaagcacgacctgaacctgagccagagaagaagagcctacagcaccaaccagatcaccaaccacaagcccctgcccagagccaccatggccagcgaccccatgcccgccgccaagagataccccctgagaaaggccagactgcaggacctgaccaaccagaccagcctggacgtgcagagatggcagatcgacctgcaggccttcatctgcctgaccagcgaggacaccttccagatcagaacccccaccggccagtag

SEQ ID NO: 3658 - DNA, 726 bp, Artificial Sequence
  Description of Artificial Sequence: Synthetic coding sequence
atgtggaccgtgagaaccgagggcggccacttccccctgcacagccccaccttcagctggagaaacgtggccttcctgctgctgctgagcctggccctggagtggaccagcgccatgctgaccaagaagatcaagcacaagcccggcctgtgccccaaggagagactgacctgcaccaccgagctgcccgacagctgcaacaccgacttcgactgcaaggagtaccagaagtgctgcttcttcgcctgccagaagaagtgcatggaccccttccaggagccctgcatgctgcccgtgagacacggcaactgcaaccacgaggcccagagatggcacttcgacttcaagaactacagatgcacccccttcaagtacagaggctgcgagggcaacgccaacaacttcctgaacgaggacgcctgcagaaccgcctgcatgctgatcgtgaaggacggccagtgccccctgttccccttcaccgagagaaaggagtgcccccccagctgccacagcgacatcgactgcccccagaccgacaagtgctgcgagagcagatgcggcttcgtgtgcgccagagcctggaccgtgaagaagggcttctgccccagaaagcccctgctgtgcaccaagatcgacaagcccaagtgcctgcaggacgaggagtgccccctggtggagaagtgctgcagccactgcggcctgaagtgcatggaccccagaagatag

SEQ ID NO: 3659 - DNA, 1074 bp, Artificial Sequence
  Description of Artificial Sequence: Synthetic coding sequence
atgagacccccccccgccctggccctggccggcctgtgcctgctggccctgcccgccgccgccgccagctacttcggcctgaccggcagagaggtgctgacccccttccccggcctgggcaccgccgccgcccccgcccagggcggcgcccacctgaagcagtgcgacctgctgaagctgagcagaagacagaagcagctgtgcagaagagagcccggcctggccgagaccctgagagacgccgcccacctgggcctgctggagtgccagttccagttcagacacgagagatggaactgcagcctggagggcagaatgggcctgctgaagagaggcttcaaggagaccgccttcctgtacgccgtgagcagcgccgccctgacccacaccctggccagagcctgcagcgccggcagaatggagagatgcacctgcgacgacagccccggcctggagagcagacaggcctggcagtggggcgtgtgcggcgacaacctgaagtacagcaccaagttcctgagcaacttcctgggcagcaagagaggcaacaaggacctgagagccagagccgacgcccacaacacccacgtgggcatcaaggccgtgaagagcggcctgagaaccacctgcaagtgccacggcgtgagcggcagctgcgccgtgagaacctgctggaagcagctgagccccttcagagagaccggccaggtgctgaagctgagatacgacagcgccgtgaaggtgagcagcgccaccaacgaggccctgggcagactggagctgtgggcccccgccagacagggcagcctgaccaagggcctggcccccagaagcggcgacctggtgtacatggaggacagccccagcttctgcagacccagcaagtacagccccggcaccgccggcagagtgtgcagcagagaggccagctgcagcagcctgtgctgcggcagaggctacgacacccagagcagactggtggccttcagctgccactgccaggtgcagtggtgctgctacgtggagtgccagcagtgcgtgcaggaggagctggtgtacacctgcaagcactag

SEQ ID NO: 3660 - DNA, 810 bp, Artificial Sequence
  Description of Artificial Sequence: Synthetic coding sequence
atggtgagatgcctgggccccgccctgctgctgctgctgctgctgggcagcgccagcagcgtgggcggcaacagatgcgtggacgccgccgaggcctgcaccgccgacgccagatgccagagactgagaagcgagtacgtggcccagtgcctgggcagagccgcccagggcggctgccccagagccagatgcagaagagccctgagaagattcttcgccagaggcccccccgccctgacccacgccctgctgttctgcccctgcgccggccccgcctgcgccgagagaagaagacagaccttcgtgcccagctgcgccttcagcggccccggccccgccccccccagctgcctggagcccctgaacttctgcgagagaagcagagtgtgcagacccagactgctggccttccaggtgagctgcacccccgcccccagcgcccccgacggctgcctgctggaccagggcgccagatgcctgagagcctacgccggcctggtgggcaccgccgtgacccccaactacgtggacaacgtgagcgccagagtggccccctggtgcgactgcggcgccagcggcaacagaagagaggactgcgaggccttcagaggcctgttcaccagaaacagatgcctggacggcgccatccaggccttcgccagcggctggccccccgtgctgctggaccagctgaacccccagggcgaccccgagcacagcctgctgcaggtgagcagcaccggcagagccctggagagaagaagcctgctgagcatcctgcccgtgctggccctgcccgccctgctgtag

SEQ ID NO: 3661 - DNA, 1728 bp, Artificial Sequence
  Description of Artificial Sequence: Synthetic coding sequence
atgagcggcaactgggtgcaccccggccagatcctgatctgggccatctgggtgctggccgcccccaccaagggccccagcgccgagggcccccagagaaacaccagactgggctggatccagggcaagcaggtgaccgtgctgggcagccccgtgcccgtgaacgtgttcctgggcgtgcccttcgccgccccccccctgggcagcctgagattcaccaacccccagcccgccagcccctgggacaacctgagagaggccaccagctaccccaacctgtgcctgcagaacagcgagtggctgctgctggaccagcacatgctgaaggtgcactaccccaagttcggcgtgagcgaggactgcctgtacctgaacatctacgcccccgcccacgccgacaccggcagcaagctgcccgtgctggtgtggttccccggcggcgccttcaagaccggcagcgccagcatcttcgacggcagcgccctggccgcctacgaggacgtgctggtggtggtggtgcagtacagactgggcatcttcggcttcttcaccacctgggaccagcacgcccccggcaactgggccttcaaggaccaggtggccgccctgagctgggtgcagaagaacatcgagttcttcggcggcgaccccagcagcgtgaccatcttcggcgagagcgccggcgccatcagcgtgagcagcctgatcctgagccccatggccaagggcctgttccacaaggccatcatggagagcggcgtggccatcatcccctacctggaggcccacgactacgagaagagcgaggacctgcaggtggtggcccacttctgcggcaacaacgccagcgacagcgaggccctgctgagatgcctgagaaccaagcccagcaaggagctgctgaccctgagccagaagaccaagagcttcaccagagtggtggacggcgccttcttccccaacgagcccctggacctgctgagccagaaggccttcaaggccatccccagcatcatcggcgtgaacaaccacgagtgcggcttcctgctgcccatgaaggaggcccccgagatcctgagcggcagcaacaagagcctggccctgcacctgatccagaacatcctgcacatccccccccagtacctgcacctggtggccaacgagtacttccacgacaagcacagcctgaccgagatcagagacagcctgctggacctgctgggcgacgtgttcttcgtggtgcccgccctgatcaccgccagataccacagagacgccggcgcccccgtgtacttctacgagttcagacacagaccccagtgcttcgaggacaccaagcccgccttcgtgaaggccgaccacgccgacgaggtgagattcgtgttcggcggcgccttcctgaagggcgacatcgtgatgttcgagggcgccaccgaggaggagaagctgctgagcagaaagatgatgaagtactgggccaccttcgccagaaccggcaaccccaacggcaacgacctgagcctgtggcccgcctacaacctgaccgagcagtacctgcagctggacctgaacatgagcctgggccagagactgaaggagcccagagtggacttctggaccagcaccatccccctgatcctgagcgccagcgacatgctgcacagccccctgagcagcctgaccttcctgagcctgctgcagcccttcttcttcttctgcgccccctag

SEQ ID NO: 3662 - DNA, 1026 bp, Artificial Sequence
  Description of Artificial Sequence: Synthetic coding sequence
atgggcaccctgccctggctgctggccttcttcatcctgggcctgcaggcctgggacacccccaccatcgtgagcagaaaggagtggggcgccagacccctggcctgcagagccctgctgaccctgcccgtggcctacatcatcaccgaccagctgcccggcatgcagtgccagcagcagagcgtgtgcagccagatgctgagaggcctgcagagccacagcgtgtacaccatcggctggtgcgacgtggcctacaacttcctggtgggcgacgacggcagagtgtacgagggcgtgggctggaacatccagggcctgcacacccagggctacaacaacatcagcctgggcatcgccttcttcggcaacaagatcggcagcagccccagccccgccgccctgagcgccgccgagggcctgatcagctacgccatccagaagggccacctgagccccagatacatccagcccctgctgctgaaggaggagacctgcctggacccccagcaccccgtgatgcccagaaaggtgtgccccaacatcatcaagagaagcgcctgggaggccagagagacccactgccccaagatgaacctgcccgccaagtacgtgatcatcatccacaccgccggcaccagctgcaccgtgagcaccgactgccagaccgtggtgagaaacatccagagcttccacatggacaccagaaacttctgcgacatcggctaccacttcctggtgggccaggacggcggcgtgtacgagggcgtgggctggcacatccagggcagccacacctacggcttcaacgacatcgccctgggcatcgccttcatcggctacttcgtggagaagccccccaacgccgccgccctggaggccgcccaggacctgatccagtgcgccgtggtggagggctacctgacccccaactacctgctgatgggccacagcgacgtggtgaacatcctgagccccggccaggccctgtacaacatcatcagcacctggccccacttcaagcactag

SEQ ID NO: 3663 - DNA, 897 bp, Artificial Sequence
  Description of Artificial Sequence: Synthetic coding sequence
atgggcatcgtgtgcgcccagtgcagcttcatcctgctgctgagcatcatcagagccagacccccccccttcctgttctgccccctgagcagccagagaaccgagagcccctacaagcccgtgcacctgggcctgggccccaccgacaaggtggccgccatcgccatggccagaatcatcgacctggtgccctgggacgacggcagcacccacgtgtacgccagccccgccatcctgctgcccatggagagacagagaaaccagctggccggcgtgaagcagcagctgtaccaccccgccctgcccaccctgagacacatggacagagacaccgtgaaggcctgcctgcccgacgagcactgccagagcaccacctactgcagaaaggacgagttcgacaacgcccacttcaccctgctgggcgtgcccaacaagcccctgcagtgcctggacatcaccgccaccggccagaagctgagaaacagataccacgagggcaagctggcccccatcgcccccggcatcaacagagtggactggccctgcttcaccagagccatcgaggactggagccacttcgtgagcagcgccggcgagttcaagctgccctgcctgagaaagagagccgagggcctgagcggctacgccgtgagatacctgaagcccgacgtgacccagacctggagacaggaggccctgtgcggcgcctgggccggcagaccctgcagccccgacagccccagaccctacccctgctgccccccccagtactgcctgagccagaaccccagcctggacagatacggccagaagcccctgcccttcgacagcctgaacaccttcagaagcttcggcagcagctacagcagagtgaactacctgaccccctggcactag

SEQ ID NO: 3664 - DNA, 5799 bp, Artificial Sequence
  Description of Artificial Sequence: Synthetic coding sequence
atggcccccggcgccctgagaggcggctgcgagcagagagcccccggcggcggcgccagaaccgccgccctgggcccctggccctggcccagccccggccccgcccccagccccggcgccgccccccccagaagcagaaagatgagcggcgccctgctgtggcccctgctgcccctgctgctgctgctgctgagcgccagagacggcgtgagagccgcccagccccaggcccccggctacctgatcgccgcccccagcgtgttcagagccggcgtggaggaggtgatcagcgtgaccatcttcaacagccccagagaggtgaccgtgcaggcccagctggtggcccagggcgagcccgtggtgcagagccagggcgccatcctggacaagggcaccatcaagctgaaggtgcccaccggcctgagaggccaggccctgctgaaggtgtggggcagaggctggcaggccgaggagggccccctgttccacaaccagaccagcgtgaccgtggacggcagaggcgccagcgtgttcatccagaccgacaagcccgtgtacagaccccagcacagagtgctgatcagcatcttcaccgtgagccccaacctgagacccgtgaacgagaagctggaggcctacatcctggaccccagaggcagcagaatgatcgagtggagacacctgaagcccttctgctgcggcatcaccaacatgagcttccccctgagcgaccagcccgtgctgggcgagtggttcatcttcgtggagatgcagggccacgcctacaacaagagcttcgaggtgcagaagtacgtgctgcccaagttcgagctgctgatcgacccccccagatacatccaggacctggacgcctgcgagaccggcaccgtgagagccagatacaccttcggcaagcccgtggccggcgccctgatgatcaacatgaccgtgaacggcgtgggctactacagccacgaggtgggcagacccgtgctgagaaccaccaagatcctgggcagcagagacttcgacatctgcgtgagagacatgatccccgccgacgtgcccgagcacttcagaggcagagtgagcatctgggccatggtgaccagcgtggacggcagccagcaggtggccttcgacgacagcacccccgtgcagagacagctggtggacatcagatacagcaaggacaccagaaagcagttcaagcccggcctggcctacgtgggcaaggtggagctgagctaccccgacggcagccccgccgagggcgtgaccgtgcagatcaaggccgagctgacccccaaggacaacatctacaccagcgaggtggtgagccagagaggcctggtgggcttcgagatccccagcatccccaccagcgcccagcacgtgtggctggagaccaaggtgatggccctgaacggcaagcccgtgggcgcccagtacctgcccagctacctgagcctgggcagctggtacagccccagccagtgctacctgcagctgcagccccccagccaccccctgcaggtgggcgaggaggcctacttcagcgtgaagagcacctgcccctgcaacttcaccctgtactacgaggtggccgccagaggcaacatcgtgctgagcggccagcagcccgcccacaccacccagcagagaagcaagagagccgcccccgccctggagaagcccatcagactgacccacctgagcgagaccgagcccccccccgcccccgaggccgaggtggacgtgtgcgtgaccagcctgcacctggccgtgacccccagcatggtgcccctgggcagactgctggtgttctacgtgagagagaacggcgagggcgtggccgacagcctgcagttcgccgtggagaccttcttcgagaaccaggtgagcgtgacctacagcgccaacgagacccagcccggcgaggtggtggacctgagaatcagagccgccagaggcagctgcgtgtgcgtggccgccgtggacaagagcgtgtacctgctgagaagcggcttcagactgacccccgcccaggtgttccaggagctggaggactacgacgtgagcgacagcttcggcgtgagcagagaggacggccccttctggtgggccggcctgaccgcccagagaagaagaagaagcagcgtgttcccctggccctggggcatcaccaaggacagcggcttcgccttcaccgagaccggcctggtggtgatgaccgacagagtgagcctgaaccacagacaggacggcggcctgtacaccgacgaggccgtgcccgccttccagccccacaccggcagcctggtggccgtggcccccagcagacacccccccagaaccgagaagagaaagagaaccttcttccccgagacctggatctggcactgcctgaacatcagcgaccccagcggcgagggcaccctgagcgtgaaggtgcccgacagcatcaccagctgggtgggcgaggccgtggccctgagcaccagccagggcctgggcatcgccgagcccagcctgctgaagaccttcaagcccttcttcgtggacttcatgctgcccgccctgatcatcagaggcgagcaggtgaagatccccctgagcgtgtacaactacatgggcacctgcgccgaggtgtacatgaagctgagcgtgcccaagggcatccagttcgtgggccaccccggcaagagacacgtgaccaagaagatgtgcgtggcccccggcgaggccgagcccatctgggtggtgctgagcttcagcgacctgggcctgaacaacatcaccgccaaggccctggcctacggcgacaccaactgctgcagagacggcagaagcagcaagcaccccgaggagaaccacgccgacagaagagtgcccatcggcgtggaccacgtgagaagaagcgtgatggtggaggccgagggcgtgcccagagcctacacctacagcgccttcttctgccccagcgagagagtgcacatcagcacccccaacaagtacgagttccagtacgtgcagagacccctgagactgaccagattcgacgtggccgtgagagcccacaacgacgccagagtggccctgagcagcggcccccaggacaccgccggcatgatcgagatcgtgctgggcggccaccagaacaccagaagctggatcagcaccagcaagatgggcgagcccgtggccagcgcccacaccgccaagatcctgagctgggacgagttcagaaccttctggatcagctggagaggcggcctgatccaggtgggccacggccccgagcccagcaacgagagcgtgatcgtggcctggaccctgcccagaccccccgaggtgcagttcatcggcttcagcaccggctggggcagcatgggcgagttcagaatctggagaaagatggaggtggacgagagctacagcgaggccttcaccctgggcgtgccccacggcgccatccccggcagcgagagagccaccgccagcatcatcggcgacgtgatgggccccaccctgaaccacctgaacaacctgctgagactgcccttcggctgcggcgagcagaacatgatccacttcgcccccaacgtgttcgtgctgaagtacctgcagaagacccagcagctgagccccgaggtggagagagagaccaccgactacctggtgcagggctaccagagacagctgacctacaagagacaggacggcagctacagcgccttcggcgagagagacgccagcggcagcatgtggctgaccgccttcgtgctgaagagcttcgcccaggccagaagcttcatcttcgtggaccccagagagctggccgccgccaagagctggatcatccagcagcagcaggccgacggcagcttcctggccgtgggcagagtgctgaacaaggacatccagggcggcatccacggcaccgtgcccctgaccgcctacgtggtggtggccctgctggagaccggcaccgccagcgaggaggagagaggcagcaccgacaaggccagacacttcctggagagcgccgcccccctggccatggacccctacagctgcgccctgaccacctacgccctgaccctgctgagaagccccgccgcccccgaggccctgagaaagctgagaagcctggccatcatgagagacggcgtgacccactggagcctgagcaacagctgggacgtggacaagggcaccttcctgagcttcagcgacagagtgagccagagcgtggtgagcgccgaggtggagatgaccgcctacgccctgctgacctacaccctgctgggcgacgtggccgccgccctgcccgtggtgaagtggctgagccagcagagaaacgccctgggcggcttcagcagcacccaggacacctgcgtggccctgcaggccctggccgagtacgccatcctgagctacgccggcggcatcaacctgaccgtgagcctggccagcaccaacctggactaccaggagaccttcgagctgcacagaaccaaccagaaggtgctgcagaccgccgccatccccagcctgcccaccggcctgttcgtgagcgccaagggcgacggctgctgcctgatgcagatcgacgtgacctacaacgtgcccgaccccgtggccaagcccgccttccagctgctggtgagcctgcaggagcccgaggcccagggcagacccccccccatgcccgccagcgccgccgagggcagcagaggcgactggccccccgccgacgacgacgaccccgccgccgaccagcaccaccaggagtacaaggtgatgctggaggtgtgcaccagatggctgcacgccggcagcagcaacatggccgtgctggaggtgcccctgctgagcggcttcagagccgacatcgagagcctggagcagctgctgctggacaagcacatgggcatgaagagatacgaggtggccggcagaagagtgctgttctacttcgacgagatccccagcagatgcctgacctgcgtgagattcagagccctgagagagtgcgtggtgggcagaaccagcgccctgcccgtgagcgtgtacgactactacgagcccgccttcgaggccaccagattctacaacgtgagcacccacagccccctggccagagagctgtgcgccggccccgcctgcaacgaggtggagagagcccccgccagaggccccggctggttccccggcgagagcggccccgccgtggcccccgaggagggcgccgccatcgccagatgcggctgcgaccacgactgcggcgcccagggcaaccccgtgtgcggcagcgacggcgtggtgtacgccagcgcctgcagactgagagaggccgcctgcagacaggccgcccccctggagcccgccccccccagctgctgcgccctggagcagagactgcccgccagcagcagcagcacctacggcgacgacctggccagcgtggcccccggccccctgcagcaggacgtgaagctgaacggcgccggcctggaggtggaggacagcgaccccgagcccgagggcgaggccgaggacagagtgaccgccggccccagaccccccgtgagcagcggcaacctggagagcagcacccagagcgccagccccttccacagatggggccagacccccgccccccagagacacagcggcagagtggtgggcgcccacagacccggcctgctgagccccgtgttcgtgtacagccccgccttccagagcggcggcgaggagggcctgtggatgagcaacacctgcaccctgagatag

SEQ ID NO: 3665 - DNA, 1209 bp, Artificial Sequence
  Description of Artificial Sequence: Synthetic coding sequence
atggtgtgcgccagagccgccctgggccccggcgccctgtgggccgccgcctggggcgtgctgctgctgaccgcccccgccggcgcccagagaggcagaaagaaggtggtgcacgtgctggagggcgagagcggcagcgtggtggtgcagaccgcccccggccaggtggtgagccacagaggcggcaccatcgtgctgccctgcagataccactacgaggccgccgcccacggccacgacggcgtgagactgaagtggaccaaggtggtggaccccctggccttcaccgacgtgttcgtggccctgggcccccagcacagagccttcggcagctacagaggcagagccgagctgcagggcgacggccccggcgacgccagcctggtgctgagaaacgtgaccctgcaggactacggcagatacgagtgcgaggtgaccaacgagctggaggacgacgccggcatggtgaagctggacctggagggcgtggtgttcccctaccaccccagaggcggcagatacaagctgaccttcgccgaggcccagagagcctgcgccgagcaggacggcatcctggccagcgccgagcagctgcacgccgcctggagagacggcctggactggtgcaacgccggctggctgagagacggcagcgtgcagtaccccgtgaacagacccagagagccctgcggcggcctgggcggcaccggcagcgccggcggcggcggcgacgccaacggcggcctgagaaactacggctacagacacaacgccgaggagagatacgacgccttctgcttcaccagcaacctgcccggcagagtgttcttcctgaagcccctgagacccgtgcccttcagcggcgccgccagagcctgcgccgccagaggcgccgccgtggccaaggtgggccagctgttcgccgcctggaagctgcagctgctggacagatgcaccgccggctggctggccgacggcagcgccagataccccatcgtgaaccccagagccagatgcggcggcagaagacccggcgtgagaagcctgggcttccccgacgccaccagaagactgttcggcgtgtactgctacagagcccccggcgcccccgaccccgcccccggcggctggggctggggctgggccggcggcggcggctgggccggcggcgccagagaccccgccgcctggacccccctgcacgtgtag

SEQ ID NO: 3666 - DNA, 1740 bp, Artificial Sequence
  Description of Artificial Sequence: Synthetic coding sequence
atgagcgccctgagacccctgctgctgctgctgctgcccctgtgccccggccccggccccggccccggcagcgaggccaaggtgaccagaagctgcgccgagaccagacaggtgctgggcgccagaggctacagcctgaacctgatcccccccgccctgatcagcggcgagcacctgagagtgtgcccccaggagtacacctgctgcagcagcgagaccgagcagagactgatcagagagaccgaggccaccttcagaggcctggtggaggacagcggcagcttcctggtgcacaccctggccgccagacacagaaagttcgacgagttcttcctggagatgctgagcgtggcccagcacagcctgacccagctgttcagccacagctacggcagactgtacgcccagcacgccctgatcttcaacggcctgttcagcagactgagagacttctacggcgagagcggcgagggcctggacgacaccctggccgacttctgggcccagctgctggagagagtgttccccctgctgcacccccagtacagcttcccccccgactacctgctgtgcctgagcagactggccagcagcaccgacggcagcctgcagcccttcggcgacagccccagaagactgagactgcagatcaccagaaccctggtggccgccagagccttcgtgcagggcctggagaccggcagaaacgtggtgagcgaggccctgaaggtgcccgtgagcgagggctgcagccaggccctgatgagactgatcggctgccccctgtgcagaggcgtgcccagcctgatgccctgccagggcttctgcctgaacgtggtgagaggctgcctgagcagcagaggcctggagcccgactggggcaactacctggacggcctgctgatcctggccgacaagctgcagggccccttcagcttcgagctgaccgccgagagcatcggcgtgaagatcagcgagggcctgatgtacctgcaggagaacagcgccaaggtgagcgcccaggtgttccaggagtgcggcccccccgaccccgtgcccgccagaaacagaagagcccccccccccagagaggaggccggcagactgtggagcatggtgaccgaggaggagagacccaccaccgccgccggcaccaacctgcacagactggtgtgggagctgagagagagactggccagaatgagaggcttctgggccagactgagcctgaccgtgtgcggcgacagcagaatggccgccgacgccagcctggaggccgccccctgctggaccggcgccggcagaggcagatacctgccccccgtggtgggcggcagccccgccgagcaggtgaacaaccccgagctgaaggtggacgccagcggccccgacgtgcccaccagaagaagaagactgcagctgagagccgccaccgccagaatgaagaccgccgccctgggccacgacctggacggccaggacgccgacgaggacgccagcggcagcggcggcggccagcagtacgccgacgactggatggccggcgccgtggccccccccgccagaccccccagacccccctacccccccagaagagacggcagcggcggcaagggcggcggcggcagcgccagatacaaccagggcagaagcagaagcggcggcgccagcatcggcttccacacccagaccatcctgatcctgagcctgagcgccctggccctgctgggccccagatag

SEQ ID NO: 3667 - DNA, 498 bp, Artificial Sequence
  Description of Artificial Sequence: Synthetic coding sequence
atggccctgctggccctgctgctggtggtggccctgcccagagtgtggaccgacgccaacctgaccgccagacagagagaccccgaggacagccagagaaccgacgagggcgacaacagagtgtggtgccacgtgtgcgagagagagaacaccttcgagtgccagaaccccagaagatgcaagtggaccgagccctactgcgtgatcgccgccgtgaagatcttccccagattcttcatggtggccaagcagtgcagcgccggctgcgccgccatggagagacccaagcccgaggagaagagattcctgctggaggagcccatgcccttcttctacctgaagtgctgcaagatcagatactgcaacctggagggcccccccatcaacagcagcgtgttcaaggagtacgccggcagcatgggcgagagctgcggcggcctgtggctggccatcctgctgctgctggccagcatcgccgccggcctgagcctgagctag

SEQ ID NO: 3668 - DNA, 933 bp, Artificial Sequence
  Description of Artificial Sequence: Synthetic coding sequence
atgaacggcctgagcctgagcgagctgtgctgcctgttctgctgccccccctgccccggcagaatcgccgccaagctggccttcctgccccccgaggccacctacagcctggtgcccgagcccgagcccggccccggcggcgccggcgccgcccccctgggcaccctgagagccagcagcggcgcccccggcagatggaagctgcacctgaccgagagagccgacttccagtacagccagagagagctggacaccatcgaggtgttccccaccaagagcgccagaggcaacagagtgagctgcatgtacgtgagatgcgtgcccggcgccagatacaccgtgctgttcagccacggcaacgccgtggacctgggccagatgagcagcttctacatcggcctgggcagcagactgcactgcaacatcttcagctacgactacagcggctacggcgccagcagcggcagacccagcgagagaaacctgtacgccgacatcgacgccgcctggcaggccctgagaaccagatacggcatcagccccgacagcatcatcctgtacggccagagcatcggcaccgtgcccaccgtggacctggccagcagatacgagtgcgccgccgtggtgctgcacagccccctgaccagcggcatgagagtggccttccccgacaccaagaagacctactgcttcgacgccttccccaacatcgagaaggtgagcaagatcaccagccccgtgctgatcatccacggcaccgaggacgaggtgatcgacttcagccacggcctggccctgtacgagagatgccccaaggccgtggagcccctgtgggtggagggcgccggccacaacgacatcgagctgtacagccagtacctggagagactgagaagattcatcagccaggagctgcccagccagagagcctag

SEQ ID NO: 3669 - DNA, 1905 bp, Artificial Sequence
  Description of Artificial Sequence: Synthetic coding sequence
atggcccagggcgtgctgtggatcctgctgggcctgctgctgtggagcgaccccggcaccgccagcctgcccctgctgatggacagcgtgatccaggccctggccgagctggagcagaaggtgcccgccgccaagaccagacacaccgccagcgcctggctgatgagcgcccccaacagcggcccccacaacagactgtaccacttcctgctgggcgcctggagcctgaacgccaccgagctggacccctgccccctgagccccgagctgctgggcctgaccaaggaggtggccagacacgacgtgagagagggcaaggagtacggcgtggtgctggcccccgacggcagcaccgtggccgtggagcccctgctggccggcctggaggccggcctgcagggcagaagagtgatcaacctgcccctggacagcatggccgccccctgggagaccggcgacaccttccccgacgtggtggccatcgcccccgacgtgagagccaccagcagccccggcctgagagacggcagccccgacgtgaccaccgccgacatcggcgccaacacccccgacgccaccaagggctgccccgacgtgcaggccagcctgcccgacgccaaggccaagagcccccccaccatggtggacagcctgctggccgtgaccctggccggcaacctgggcctgaccttcctgagaggcagccagacccagagccaccccgacctgggcaccgagggctgctgggaccagctgagcgcccccagaaccttcaccctgctggaccccaaggccagcctgctgaccatggccttcctgaacggcgccctggacggcgtgatcctgggcgactacctgagcagaacccccgagcccagacccagcctgagccacctgctgagccagtactacggcgccggcgtggccagagaccccggcttcagaagcaacttcagaagacagaacggcgccgccctgaccagcgccagcatcctggcccagcaggtgtggggcaccctggtgctgctgcagagactggagcccgtgcacctgcagctgcagtgcatgagccaggagcagctggcccaggtggccgccaacgccaccaaggagttcaccgaggccttcctgggctgccccgccatccaccccagatgcagatggggcgccgccccctacagaggcagacccaagctgctgcagctgcccctgggcttcctgtacgtgcaccacacctacgtgcccgcccccccctgcaccgacttcaccagatgcgccgccaacatgagaagcatgcagagataccaccaggacacccagggctggggcgacatcggctacagcttcgtggtgggcagcgacggctacgtgtacgagggcagaggctggcactgggtgggcgcccacaccctgggccacaacagcagaggcttcggcgtggccatcgtgggcaactacaccgccgccctgcccaccgaggccgccctgagaaccgtgagagacaccctgcccagctgcgccgtgagagccggcctgctgagacccgactacgccctgctgggccacagacagctggtgagaaccgactgccccggcgacgccctgttcgacctgctgagaacctggccccacttcaccgccgtgagcctgagaagcctgcactacaccgccagaagacccagcgtgtacaccagcagcaccagacccctgccccccgcctgcaacagctgcgccagaaccgccagcgccagaccccccaccagcagaagacacgtgtacagcggcaacctgggccccgccttcgccggccacagcgccggcaacatccccgaccccgtgaccagcgcctacgccgccagcgcccagccccagacccagcccgcctgccccttccccagcagctag

SEQ ID NO: 3670 - DNA, 777 bp, Artificial Sequence
  Description of Artificial Sequence: Synthetic coding sequence
atgctggtgctgtacggccacagcacccaggacctgcccgagaccaacgccagagtggtgggcggcaccgaggccggcagaaacagctggcccagccagatcagcctgcagtacagaagcggcggcagcagataccacacctgcggcggcaccctgatcagacagaactgggtgatgaccgccgcccactgcgtggactaccagaagaccttcagagtggtggccggcgaccacaacctgagccagaacgacggcaccgagcagtacgtgagcgtgcagaagatcgtggtgcacccctactggaacagcgacaacgtggccgccggctacgacatcgccctgctgagactggcccagagcgtgaccctgaacagctacgtgcagctgggcgtgctgccccaggagggcgccatcctggccaacaacagcccctgctacatcaccggctggggcaagaccaagaccaacggccagctggcccagaccctgcagcaggcctacctgcccagcgtggactacgccatctgcagcagcagcagctactggggcagcaccgtgaagaacaccatggtgtgcgccggcggcgacggcgtgagaagcggctgccagggcgacagcggcggccccctgcactgcctggtgaacggcaagtacagcgtgcacggcgtgaccagcttcgtgagcagcagaggctgcaacgtgagcagaaagcccaccgtgttcacccaggtgagcgcctacatcagctggatcaacaacgtgatcgccagcaactag

SEQ ID NO: 3671 - DNA, 993 bp, Artificial Sequence
  Description of Artificial Sequence: Synthetic coding sequence
atggccgccagaagaagccagagaagaagaggcagaagaggcgagcccggcaccgccctgctggtgcccctggccctgggcctgggcctggccctggcctgcctgggcctgctgctggccgtggtgagcctgggcagcagagccagcctgagcgcccaggagcccgcccaggaggagctggtggccgaggaggaccaggaccccagcgagctgaacccccagaccgaggagagccaggaccccgcccccttcctgaacagactggtgagacccagaagaagcgcccccaagggcagaaagaccagagccagaagagccatcgccgcccactacgaggtgcaccccagacccggccaggacggcgcccaggccggcgtggacggcaccgtgagcggctgggaggaggccagaatcaacagcagcagccccctgagatacaacagacagatcggcgagttcatcgtgaccagagccggcctgtactacctgtactgccagagcagcgacgccctggaggcctgggagaacggcgagagaagcagaaagagaagagccgtgctgacccagaagcagaagaagcagcacagcgtgctgcacctggtgcccatcaacgccaccagcaaggacgacagcgacgtgaccgaggtgatgtggcagcccgccctgagaagaggcagaggcctgcaggcccagggctacggcgtgagaatccaggacgccggcgtgtacctgctgtacagccaggtgctgttccaggacgtgaccttcaccatgggccaggtggtgagcagagagggccagggcagacaggagaccctgttcagatgcatcagaagcatgcccagccaccccgacagagcctacaacagctgctacagcgccggcgtgttccacctgcaccagggcgacatcctgagcgtgatcatccccagagccagagccaagctgaacctgagcccccacggcaccttcctgggcttcgtgaagctgtag

SEQ ID NO: 3672 - DNA, 2253 bp, Artificial Sequence
  Description of Artificial Sequence: Synthetic coding sequence
atggccaagcccagactgctggtgctgtacttcgccctgatcgtggtgcccgcctgggtgagcagcatcgtgctgaccggcaccagcgagccccccgacgcccagaccgtggcccccgccgaggacgagaccctgcagaacgaggccgacaaccaggagaacgtgctgagccagctgctgggcgactacgacaaggtgaaggccatgagcgagggcagcgactgccagtgcaagtgcgtggtgagacccctgggcagagacgcctgccagagaatcaacgccggcgccagcagaaaggaggacttctacaccgtggagaccatcaccagcggcagcagctgcaagtgcgcctgcgtggccccccccagcgccctgaacccctgcgagggcgacttcagactgcagaagctgagagaggccgacagccaggacctgaagctgagcaccatcatcgacatgctggagggcgccttctacggcctggacctgctgaagctgcacagcgtgaccaccaagctggtgggcagagtggacaagctggaggaggaggtgagcaagaacctgaccaaggagaacgagcagatcaaggaggacatggaggagatcagaaccgagatgaacaagagaggcaaggagaactgcagcgagaacatcctggacagcatgcccgacatcagaagcgccctgcagagagacgccgccgccgcctacgcccaccccgagtacgaggagagattcctgcaggaggagaccgtgagccagcagatcaacagcatcgagctgctgcagaccagacccctggccctgcccgaggtggtgaagagccagagacccctgcagagacaggtgcacctgagaggcagacccgccagccagcccaccgtgatcagaggcatcacctactacaaggccaaggtgagcgaggaggagaacgacatcgaggagcagcaggacgagttcttcagcggcgacaacggcgtggacctgctgatcgaggaccagctgctgagacacaacggcctgatgaccagcgtgaccagaagacccgccgccaccagacagggccacagcaccgccgtgaccagcgacctgaacgccagaaccgccccctggagcagcgccctgccccagcccagcaccagcgaccccagcatcgccaaccacgccagcgtgggccccaccctgcagaccaccagcgtgagccccgaccccaccagagagagcgtgctgcagcccagcccccaggtgcccgccaccaccgtggcccacaccgccacccagcagcccgccgcccccgccccccccgccgtgagccccagagaggccctgatggaggccatgcacaccgtgcccgtgccccccaccaccgtgagaaccgacagcctgggcaaggacgcccccgccggctggggcaccacccccgccagccccaccctgagccccgaggaggaggacgacatcagaaacgtgatcggcagatgcaaggacaccctgagcaccatcaccggccccaccacccagaacacctacggcagaaacgagggcgcctggatgaaggaccccctggccaaggacgagagaatctacgtgaccaactactactacggcaacaccctggtggagttcagaaacctggagaacttcaagcagggcagatggagcaacagctacaagctgccctacagctggatcggcaccggccacgtggtgtacaacggcgccttctactacaacagagccttcaccagaaacatcatcaagtacgacctgaagcagagatacgtggccgcctgggccatgctgcacgacgtggcctacgaggaggccaccccctggagatggcagggccacagcgacgtggacttcgccgtggacgagaacggcctgtggctgatctaccccgccctggacgacgagggcttcagccaggaggtgatcgtgctgagcaagctgaacgccgccgacctgagcacccagaaggagaccacctggagaaccggcctgagaagaaacttctacggcaactgcttcgtgatctgcggcgtgctgtacgccgtggacagctacaaccagagaaacgccaacatcagctacgccttcgacacccacaccaacacccagatcgtgcccagactgctgttcgagaacgagtacagctacaccacccagatcgactacaaccccaaggacagactgctgtacgcctgggacaacggccaccaggtgacctaccacgtgatcttcgcctactag

SEQ ID NO: 3673 - DNA, 678 bp, Artificial Sequence
  Description of Artificial Sequence: Synthetic coding sequence
atgaagctgggctgcgtgctgatggcctgggccctgtacctgagcctgggcgtgctgtgggtggcccagatgctgctggccgccggctgccacgccgagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 3674 - DNA, 891 bp, Artificial Sequence
  Description of Artificial Sequence: Synthetic coding sequence
atgagcagacaggagcccaagatgttcgtgctgctgtacgtgaccagcttcgccatctgcgccagcggccagcccagaggcaaccagctgaagggcgagaactacagccccagatacatctgcagcatccccggcctgcccggcccccccggcccccccggcgccaacggcagccccggcccccacggcagaatcggcctgcccggcagagacggcagagacggcagaaagggcgagaagggcgagaagggcaccgccggcctgagaggcaagaccggccccctgggcctggccggcgagaagggcgaccagggcgagaccggcaagaagggccccatcggccccgagggcgagaagggcgaggtgggccccatcggcccccccggccccaagggcgacagaggcgagcagggcgaccccggcctgcccggcgtgtgcagatgcggcagcatcgtgctgaagagcgccttcagcgtgggcatcaccaccagctaccccgaggagagactgcccatcatcttcaacaaggtgctgttcaacgagggcgagcactacaaccccgccaccggcaagttcatctgcgccttccccggcatctactacttcagctacgacatcaccctggccaacaagcacctggccatcggcctggtgcacaacggccagtacagaatcaagaccttcgacgccaacaccggcaaccacgacgtggccagcggcagcaccgtgatctacctgcagcccgaggacgaggtgtggctggagatcttcttcaccgaccagaacggcctgttcagcgaccccggctgggccgacagcctgttcagcggcttcctgctgtacgtggacaccgactacctggacagcatcagcgaggacgacgagctgtag

SEQ ID NO: 3675 - DNA, 1275 bp, Artificial Sequence
  Description of Artificial Sequence: Synthetic coding sequence
atgggcagcctggtgctgaccctgtgcgccctgttctgcctggccgcctacctggtgagcggcagccccatcatgaacctggagcagagccccctggaggaggacatgagcctgttcggcgacgtgttcagcgagcaggacggcgtggacttcaacaccctgctgcagagcatgaaggacgagttcctgaagaccctgaacctgagcgacatccccacccaggacagcgccaaggtggacccccccgagtacatgctggagctgtacaacaagttcgccaccgacagaaccagcatgcccagcgccaacatcatcagaagcttcaagaacgaggacctgttcagccagcccgtgagcttcaacggcctgagaaagtaccccctgctgttcaacgtgagcatcccccaccacgaggaggtgatcatggccgagctgagactgtacaccctggtgcagagagacagaatgatctacgacggcgtggacagaaagatcaccatcttcgaggtgctggagagcaagggcgacaacgagggcgagagaaacatgctggtgctggtgagcggcgagatctacggcaccaacagcgagtgggagaccttcgacgtgaccgacgccatcagaagatggcagaagagcggcagcagcacccaccagctggaggtgcacatcgagagcaagcacgacgaggccgaggacgccagcagcggcagactggagatcgacaccagcgcccagaacaagcacaaccccctgctgatcgtgttcagcgacgaccagagcagcgacaaggagagaaaggaggagctgaacgagatgatcagccacgagcagctgcccgagctggacaacctgggcctggacagcttcagcagcggccccggcgaggaggccctgctgcagatgagaagcaacatcatctacgacagcaccgccagaatcagaagaaacgccaagggcaactactgcaagagaacccccctgtacatcgacttcaaggagatcggctgggacagctggatcatcgccccccccggctacgaggcctacgagtgcagaggcgtgtgcaactaccccctggccgagcacctgacccccaccaagcacgccatcatccaggccctggtgcacctgaagaacagccagaaggccagcaaggcctgctgcgtgcccaccaagctggagcccatcagcatcctgtacctggacaagggcgtggtgacctacaagttcaagtacgagggcatggccgtgagcgagtgcggctgcagatag

SEQ ID NO: 3676 - DNA, 381 bp, Artificial Sequence
  Description of Artificial Sequence: Synthetic coding sequence
atgcacctgagccagctgctggcctgcgccctgctgctgaccctgctgagcctgagacccagcgaggccaagcccggcgccccccccaaggtgcccagaaccccccccgccgaggagctggccgagccccaggccgccggcggcggccagaagaagggcgacaaggcccccggcggcggcggcgccaacctgaagggcgacagaagcagactgctgagagacctgagagtggacaccaagagcagagccgcctgggccagactgctgcaggagcaccccaacgccagaaagtacaagggcgccaacaagaagggcctgagcaagggctgcttcggcctgaagctggacagaatcggcagcatgagcggcctgggctgctag

SEQ ID NO: 3677 - DNA, 423 bp, Artificial Sequence
  Description of Artificial Sequence: Synthetic coding sequence
atgagaagccccagaatgagagtgtgcgccaagagcgtgctgctgagccactggctgttcctggcctacgtgctgatggtgtgctgcaagctgatgagcgccagcagccagcacctgagaggccacgccggccaccaccagatcaagcagggcacctgcgaggtggtggccgtgcacagatgctgcaacaagaacagaatcgaggagagaagccagaccgtgaagtgcagctgcttccccggccaggtggccggcaccaccagagcccagcccagctgcgtggaggccagcatcgtgatccagaagtggtggtgccacatgaacccctgcctggagggcgaggactgcaaggtgctgcccgactacagcggctggagctgcagcagcggcaacaaggtgaagaccaccaaggtgaccagatag

SEQ ID NO: 3678 - DNA, 1332 bp, Artificial Sequence
  Description of Artificial Sequence: Synthetic coding sequence
atgctgatgctgttcgtgttcggcgtgctgctgcacgaggtgagcctgagcggccagaacgaggccccccccaacacccacagcatccccggcgagcccctgtacaactacgccagcatcagactgcccgaggagcacatccccttcttcctgcacaacaacagacacatcgccaccgtgtgcagaaaggacagcctgtgcccctacaagaagcacctggagaagctgaagtactgctggggctacgagaagagctgcaagcccgagttcagattcggctaccccgtgtgcagctacgtggacatgggctggaccgacaccctggagagcgccgaggacatcttctggaagcaggccgacttcggctacgccagagagagactggaggagatgcacgtgctgtgccagcccaaggagaccagcgacagcagcctggtgtgcagcagatacctgcagtactgcagagccaccaacctgtacctggacctgagaaacatcaagagaaaccacgacagattcaaggaggacttcttccagagcggcgagatcggcggccactgcaagctggacatcagaaccctgaccagcgagggccagagaaagagccccctgcagagctggttcgccgagctgcagagctacacccagctgaacttcagacccatcgaggacgccaagtgcgacatcgtgatcgagaagcccacctacttcatgaagctggacgccggcgtgaacatgtaccaccacttctgcgacttcatcaacctgtacatcacccagcacgtgaacaacagcttcagcaccgacgtgtacatcgtgatgtgggacaccgacggcaagatcagagtgaccatcctggccagaagcaccgagtacagaaagatcctgaaccagaacgagctggtgaacgccctgaagaccgtgagcaccttcgaggtgcagatcgtggactacaagtacagagagctgggcttcctggaccagctgagaatcacccacaacaccgacatcttcatcggcatgcacggcgccggcctgacccacctgctgttcctgcccgactgggccgccgtgttcgagctgtacaactgcgaggacgagagatgctacctggacctggccagactgagaggcgtgcactacatcacctggagaagacagaacaaggtgttcccccaggacaagggccaccaccccaccctgggcgagcaccccaagttcaccaactacagcttcgacgtggaggagttcatgtacctggtgctgcaggccgccgaccacgtgctgcagcaccccaagtggcccttcaagaagaagcacgacgagctgtag

SEQ ID NO: 3679 - DNA, 336 bp, Artificial Sequence
  Description of Artificial Sequence: Synthetic coding sequence
atgggccccagcagctgcctgctgctgatcctgatccccctgctgcagctgatcaaccccggcagcacccagtgcagcctggacagcgtgatggacaagaagatcaaggacgtgctgaacagcctggagtacagccccagccccatcagcaagaagctgagctgcgccagcgtgaagagccagggcagacccagcagctgccccgccggcatggccgtgaccggctgcgcctgcggctacggctgcggcagctgggacgtgcagctggagaccacctgccactgccagtgcagcgtggtggactggaccaccgccagatgctgccacctgacctag

SEQ ID NO: 3680 - DNA, 1965 bp, Artificial Sequence
  Description of Artificial Sequence: Synthetic coding sequence
atggcccccaagaagctgagctgcctgagaagcctgctgctgcccctgagcctgaccctgctgctgccccaggccgacaccagaagcttcgtggtggacagaggccacgacagattcctgctggacggcgcccccttcagatacgtgagcggcagcctgcactacttcagagtgcccagagtgctgtgggccgacagactgctgaagatgagatggagcggcctgaacgccatccagttctacgtgccctggaactaccacgagccccagcccggcgtgtacaacttcaacggcagcagagacctgatcgccttcctgaacgaggccgccctggccaacctgctggtgatcctgagacccggcccctacatctgcgccgagtgggagatgggcggcctgcccagctggctgctgagaaagcccgagatccacctgagaaccagcgaccccgacttcctggccgccgtggacagctggttcaaggtgctgctgcccaagatctacccctggctgtaccacaacggcggcaacatcatcagcatccaggtggagaacgagtacggcagctacagagcctgcgacttcagctacatgagacacctggccggcctgttcagagccctgctgggcgagaagatcctgctgttcaccaccgacggccccgagggcctgaagtgcggcagcctgagaggcctgtacaccaccgtggacttcggccccgccgacaacatgaccaagatcttcaccctgctgagaaagtacgagccccacggccccctggtgaacagcgagtactacaccggctggctggactactggggccagaaccacagcaccagaagcgtgagcgccgtgaccaagggcctggagaacatgctgaagctgggcgccagcgtgaacatgtacatgttccacggcggcaccaacttcggctactggaacggcgccgacaagaagggcagattcctgcccatcaccaccagctacgactacgacgcccccatcagcgaggccggcgaccccacccccaagctgttcgccctgagagacgtgatcagcaagttccaggaggtgcccctgggccccctgcccccccccagccccaagatgatgctgggccccgtgaccctgcacctggtgggccacctgctggccttcctggacctgctgtgccccagaggccccatccacagcatcctgcccatgaccttcgaggccgtgaagcaggaccacggcttcatgctgtacagaacctacatgacccacaccatcttcgagcccacccccttctgggtgcccaacaacggcgtgcacgacagagcctacgtgatggtggacggcgtgttccagggcgtggtggagagaaacatgagagacaagctgttcctgaccggcaagctgggcagcaagctggacatcctggtggagaacatgggcagactgagcttcggcagcaacagcagcgacttcaagggcctgctgaagccccccatcctgggccagaccatcctgacccagtggatgatgttccccctgaagatcgacaacctggtgaagtggtggttccccctgcagctgcccaagtggccctacccccaggcccccagcggccccaccttctacagcaagaccttccccatcctgggcagcgtgggcgacaccttcctgtacctgcccggctggaccaagggccaggtgtggatcaacggcttcaacctgggcagatactggaccaagcagggcccccagcagaccctgtacgtgcccagattcctgctgttccccagaggcgccctgaacaagatcaccctgctggagctggaggacgtgcccctgcagccccaggtgcagttcctggacaagcccatcctgaacagcaccagcaccctgcacagaacccacatcaacagcctgagcgccgacaccctgagcgccagcgagcccatggagctgagcggccactag

SEQ ID NO: 3681 - DNA, 2502 bp, Artificial Sequence
  Description of Artificial Sequence: Synthetic coding sequence
atgaacatggagatcggccacccccacgagggcaaggacgacctgggcgacaagagagtgatcatgggcaccaagttccccatggagctgggcatcagagtgggcctgggcaaggaggacagcagatgcggcgagagccccgtggtgagcaacaagtgcgagggcagaatggccccccccgagaccaagttccccctgagcaagggcctggagatgggcctggagagacagaacatcagcagaaccgtgatgcagagaggcagcctgggcgtggacagcgtgagcgccagccagggcaccaagcccagcctgctgcccggcagaatgggcctggagaacgagagcctgctggccggctacacccacgagagaatcatccagccccccctgggcagagtgtgcggcagcagccaggccgccggcagcagaagagcccccctggccagcggccccgagggcgtggaggagctggtgggcaagcccgccttcgtgatggagcccagacaggagatggagaaggagagcacctgcgtgctgatgaagcccaacaccgagatcaagctgcccgtggaggtggacatcggcctgacccaggccgagggccccgacgagaccaagaacaccgagccccagatgggcctggtgatcgagcccccccagtgccagttcgcccagcagcacgagcagagaaaggaggccggcaacatcgagagcggcgtggagccccccgacagaatcagacccatctacagcggcaagttcttcgacagaaccccctgctggcccagcgccggcaaggtgatccccgtgggctacagagtggccacctgcctgaccgagaagctgcccagactgatcaccccccccgaggccaagaagtacttcaacttcagatacccccccgccggcgtggagagagtgttctacggcagagccaacgacccccagatcgccccctacctgacccacggcatcagaagcaagatcagcgtgctggccaacaccctgatcaacccccagcccatcaccaccttccagcagaagatcaaggacaagaaggagagcatctacctgagcaacagaagagcccccctgggcaagagccacgaccaggcccccggcctgcccaagggcatggacaccaccaacaccaccttcggcaccgccgtgatcaaggagtacagcgccaaggacgtggtgaacccccccaagagctacgaggaggtgttcaaggagggcaacgagggccacgacctgtacgtggtgagccacaacgactactacgccggcgaggccaagaacagaaagtacaaccccagcagcttccacagatgcagcgtgtacggcgtgcccaccccccacttcaacgacggcagagccatggccaagagcctgtactggctgcacgagctgcagatgaagagaggcgccaagttcgtgagcaagagagccgacgacttcaaggagaagttccagcacaagctgggcagagtgctggaccccatcgccgagaccatgaacgtgccccccgactgcaccttcggcgcctgcctgagacccgaggagtacggcgtgggcgacctgatccacaacagactgcccgacgagtacctgagaggcaaggacagacagagagccctgatcgccgccgtgagacaccacctgaagaaggtgaactaccagaagttcgacaccctgctggccgccttcagacactacgacaagaagggcgacggcatgatcgacaaggacgagctgcaggaggcctgcgaccaggccaacctgagcctggacgacaagctgctggaccagctgttcgactactgcgacgtggacaacgacggcttcatcaactacctggagttcgccaacttcctgaactggaaggacaagatgctgctgaaggagtacgaggagagagtgatcatcaagggcagaaagcccgactgcgtgaaccccaccgaggccaacgtggaggagcccgagcagaccctgctgatcaagcccgaggacatcgtgctgaaggaggccggcagcaccgagaagaccctgagaaccctgctgagacccagcgacaaggtgagcaactactacaagaccaccagcagcgagatcaacgccatcgtgggcgccatccccagcacctgctaccccatctgcggcgtgcccaccatcagaagcgacatccccgcccccagaatcagaagaatcagcgacagaaccaactacggcgaggagggcagcgcctacagcctgctgtaccccaccatcttcgccagaaagggcgtgttcgagagagacttcttcaagaccagaagcaaggaggagatcgccgagatcctgtgcaacatcggcgtgaagctgagcgacgaggagttcgagaacgtgtggaacctggccagcaagaagcaccacagaggcgaggtgtgcgtggagaacatcagaaacgtgctggacgagctgagacacgccgacagaatcaagtgcaagaccctgatgtag

SEQ ID NO: 3682 - DNA, 2004 bp, Artificial Sequence
  Description of Artificial Sequence: Synthetic coding sequence
atgggcagcagcagactggccgccctgctgctgcccctgctgctgatcgtgatcgacctgagcgacagcgccggcatcggcttcagacacctgccccactggaacaccagatgccccctggccagccacaccgacgacagcttcaccggcagcagcgcctacatcccctgcagaacctggtgggccctgttcagcaccaagccctggtgcgtgagagtgtggcactgcagcagatgcctgtgccagcacctgctgagcggcggcagcggcctgcagagaggcctgttccacctgctggtgcagaagagcaagaagagcagcaccttcaagttctacagaagacacaagatgcccgcccccgcccagagaaagctgctgcccagaagacacctgagcgagaagagccaccacatcagcatccccagccccgacatcagccacaagggcctgagaagcaagagaacccagcccagcgaccccgagacctgggagagcctgcccagactggacagccagagacacggcggccccgagttcagcttcgacctgctgcccgaggccagagccatcagagtgaccatcagcagcggccccgaggtgagcgtgagactgtgccaccagtgggccctggagtgcgaggagctgagcagcccctacgacgtgcagaagatcgtgagcggcggccacaccgtggagctgccctacgagttcctgctgccctgcctgtgcatcgaggccagctacctgcaggaggacaccgtgagaagaaagaagtgccccttccagagctggcccgaggcctacggcagcgacttctggaagagcgtgcacttcaccgactacagccagcacacccagatggtgatggccctgaccctgagatgccccctgaagctggaggccgccctgtgccagagacacgactggcacaccctgtgcaaggacctgcccaacgccaccgccagagagagcgacggctggtacgtgctggagaaggtggacctgcacccccagctgtgcttcaagttcagcttcggcaacagcagccacgtggagtgcccccaccagaccggcagcctgaccagctggaacgtgagcatggacacccaggcccagcagctgatcctgcacttcagcagcagaatgcacgccaccttcagcgccgcctggagcctgcccggcctgggccaggacaccctggtgccccccgtgtacaccgtgagccaggccagaggcagcagccccgtgagcctggacctgatcatccccttcctgagacccggctgctgcgtgctggtgtggagaagcgacgtgcagttcgcctggaagcacctgctgtgccccgacgtgagctacagacacctgggcctgctgatcctggccctgctggccctgctgaccctgctgggcgtggtgctggccctgacctgcagaagaccccagagcggccccggccccgccagacccgtgctgctgctgcacgccgccgacagcgaggcccagagaagactggtgggcgccctggccgagctgctgagagccgccctgggcggcggcagagacgtgatcgtggacctgtgggagggcagacacgtggccagagtgggccccctgccctggctgtgggccgccagaaccagagtggccagagagcagggcaccgtgctgctgctgtggagcggcgccgacctgagacccgtgagcggccccgaccccagagccgcccccctgctggccctgctgcacgccgcccccagacccctgctgctgctggcctacttcagcagactgtgcgccaagggcgacatccccccccccctgagagccctgcccagatacagactgctgagagacctgcccagactgctgagagccctggacgccagacccttcgccgaggccaccagctggggcagactgggcgccagacagagaagacagagcagactggagctgtgcagcagactggagagagaggccgccagactggccgacctgggctag

SEQ ID NO: 3683 - DNA, 609 bp, Artificial Sequence
  Description of Artificial Sequence: Synthetic coding sequence
atggagctgtggggcgcctacctgctgctgtgcctgttcagcctgctgacccaggtgaccaccgagccccccacccagaagcccaagaagatcgtgaacgccaagaaggacgtggtgaacaccaagatgttcgaggagctgaagagcagactggacaccctggcccaggaggtggccctgctgaaggagcagcaggccctgcagaccgtgtgcctgaagggcaccaaggtgcacatgaagtgcttcctggccttcacccagaccaagaccttccacgaggccagcgaggactgcatcagcagaggcggcaccctgggcaccccccagaccggcagcgagaacgacgccctgtacgagtacctgagacagagcgtgggcaacgaggccgagatctggctgggcctgaacgacatggccgccgagggcacctgggtggacatgaccggcgccagaatcgcctacaagaactgggagaccgagatcaccgcccagcccgacggcggcaagaccgagaactgcgccgtgctgagcggcgccgccaacggcaagtggttcgacaagagatgcagagaccagctgccctacatctgccagttcggcatcgtgtag

SEQ ID NO: 3684 - DNA, 1839 bp, Artificial Sequence
  Description of Artificial Sequence: Synthetic coding sequence
atgctggagggcctgggcagccccgccagccccagagccgccgccagcgccagcgtggccggcagcagcggccccgccgcctgcagcccccccagcagcagcgcccccagaagccccgagagccccgcccccagaagaggcggcgtgagagccagcgtgccccagaagctggccgagatgctgagcagccagtacggcctgatcgtgttcgtggccggcctgctgctgctgctggcctgggccgtgcacgccgccggcgtgagcaagagcgacctgctgtgcttcctgaccgccctgatgctgctgcagctgctgtggatgctgtggtacgtgggcagaagcagcgcccacagaagactgttcagactgaaggacacccacgccggcgccggctggctgagaggcagcatcaccctgttcgccgtgatcaccgtgatcctgggctgcctgaagatcggctacttcatcggcttcagcgagtgcctgagcgccaccgagggcgtgttccccgtgacccacagcgtgcacaccctgctgcaggtgtacttcctgtggggccacgccaaggacatcatccagagcttcaagaccctggagagattcggcgtgatccacagcgtgttcaccaacctgctgctgtgggccaacggcgtgctgaacgagagcaagcaccagctgaacgagcacaaggagagactgatcaccctgggcttcggcaacatcaccaccgtgctggacgaccacaccccccagtgcaactgcaccccccccaccctgtgcaccgccatcagccacggcatctactacctgtaccccttcaacatcgagtaccagatcctggccagcaccatgctgtacgtgctgtggaagaacatcggcagaaaggtggacagccaccagcaccagaagatgcagttcaagagcgacggcgtgatggtgggcgccgtgctgggcctgaccgtgctggccgccaccatcgccgtggtggtggtgtacctgatccacatcggcagaagcaagaccaagagcgagagcgccctgatcatgttctacctgtacgccatcaccctgctgatgctgatgggcgccgccggcctggccggcatcagaatctacagaatcgacgagaagagcctggacgagagcaagaaccccgccagaaagctggacagcgacctgctggtgggcaccgccagcggcagctggctgatcagctggggcagcatcctggccatcctgtgcgccgagggccaccccagatacacctggtacaacctgccctacagcatcctggccatcgtggagaagtacatccagaacctgttcatcttcgagagcatccacagagagcccgagaagctgagcgaggacatccagaccctgagagtggtgaccgtgtgcaacggcaacaccatgcccctggccagcagctgccccaagagcggcggcgtggccagagacgtggccccccagggcaaggacatgccccccgccgccaacggcaacgtgtgcatgagagagagccacgacaaggaggaggagaagcaggaggagagcagctggggcggcagccccagccccgtgagactgcccagattcctgcagggcaacgccaagagaaaggtgctgagaaacatcgccgccttcctgttcctgtgcaacatcagcctgtggatcccccccgccttcggctgcagacccgagtacgacaacggcctggaggagatcgtgttcggcttcgagccctggatcatcgtggtgaacctggccatgcccttcagcatcttctacagaatgcacgccgccgccagcctgttcgaggtgtactgcaagatctag

SEQ ID NO: 3685 - DNA, 786 bp, Artificial Sequence
  Description of Artificial Sequence: Synthetic coding sequence
atggagctgctgcaggtgaccatcctgttcctgctgcccagcatctgcagcagcaacagcaccggcgtgctggaggccgccaacaacagcctggtggtgaccaccaccaagcccagcatcaccacccccaacaccgagagcctgcagaagaacgtggtgacccccaccaccggcaccacccccaagggcaccatcaccaacgagctgctgaagatgagcctgatgagcaccgccaccttcctgaccagcaaggacgagggcctgaaggccaccaccaccgacgtgagaaagaacgacagcatcatcagcaacgtgaccgtgaccagcgtgaccctgcccaacgccgtgagcaccctgcagagcagcaagcccaagaccgagacccagagcagcatcaagaccaccgagatccccggcagcgtgctgcagcccgacgccagccccagcaagaccggcaccctgaccagcatccccgtgaccatccccgagaacaccagccagagccaggtgatcggcaccgagggcggcaagaacgccagcaccagcgccaccagcagaagctacagcagcatcatcctgcccgtggtgatcgccctgatcgtgatcaccctgagcgtgttcgtgctggtgggcctgtacagaatgtgctggaaggccgaccccggcacccccgagaacggcaacgaccagccccagagcgacaaggagagcgtgaagctgctgaccgtgaagaccatcagccacgagagcggcgagcacagcgcccagggcaagaccaagaactag

SEQ ID NO: 3686 - DNA, 6408 bp, Artificial Sequence
  Description of Artificial Sequence: Synthetic coding sequence
atgcccgccctgggccccgccctgctgcaggccctgtgggccggctgggtgctgaccctgcagcccctgccccccaccgccttcacccccaacggcacctacctgcagcacctggccagagaccccaccagcggcaccctgtacctgggcgccaccaacttcctgttccagctgagccccggcctgcagctggaggccaccgtgagcaccggccccgtgctggacagcagagactgcctgccccccgtgatgcccgacgagtgcccccaggcccagcccaccaacaaccccaaccagctgctgctggtgagccccggcgccctggtggtgtgcggcagcgtgcaccagggcgtgtgcgagcagagaagactgggccagctggagcagctgctgctgagacccgagagacccggcgacacccagtacgtggccgccaacgaccccgccgtgagcaccgtgggcctggtggcccagggcctggccggcgagcccctgctgttcgtgggcagaggctacaccagcagaggcgtgggcggcggcatcccccccatcaccaccagagccctgtggccccccgacccccaggccgccttcagctacgaggagaccgccaagctggccgtgggcagactgagcgagtacagccaccacttcgtgagcgccttcgccagaggcgccagcgcctacttcctgttcctgagaagagacctgcaggcccagagcagagccttcagagcctacgtgagcagagtgtgcctgagagaccagcactactacagctacgtggagctgcccctggcctgcgagggcggcagatacggcctgatccaggccgccgccgtggccaccagcagagaggtggcccacggcgaggtgctgttcgccgccttcagcagcgccgccccccccaccgtgggcagaccccccagcgccgccgccggcgccagcggcgccagcgccctgtgcgccttccccctggacgaggtggacagactggccaacagaaccagagacgcctgctacaccagagagggcagagccgaggacggcaccgaggtggcctacatcgagtacgacgtgaacagcgactgcgcccagctgcccgtggacaccctggacgcctacccctgcggcagcgaccacacccccagccccatggccagcagagtgcccctggaggccacccccatcctggagtggcccggcatccagctgaccgccgtggccgtgaccatggaggacggccacaccatcgccttcctgggcgacagccagggccagctgcacagagtgtacctgggccccggcagcgacggccacccctacagcacccagagcatccagcagggcagcgccgtgagcagagacctgaccttcgacggcaccttcgagcacctgtacgtgatgacccagagcaccctgctgaaggtgcccgtggccagctgcgcccagcacctggactgcgccagctgcctggcccacagagacccctactgcggctggtgcgtgctgctgggcagatgcagcagaagaagcgagtgcagcagaggccagggccccgagcagtggctgtggagcttccagcccgagctgggctgcctgcaggtggccgccatgagccccgccaacatcagcagagaggagaccagagaggtgttcctgagcgtgcccgacctgccccccctgtggcccggcgagagctacagctgccacttcggcgagcaccagagccccgccctgctgaccggcagcggcgtgatgtgccccagccccgaccccagcgaggcccccgtgctgcccagaggcgccgactacgtgagcgtgagcgtggagctgagattcggcgccgtggtgatcgccaagaccagcctgagcttctacgactgcgtggccgtgaccgagctgagacccagcgcccagtgccaggcctgcgtgagcagcagatggggctgcaactggtgcgtgtggcagcacctgtgcacccacaaggccagctgcgacgccggccccatggtggccagccaccagagccccctggtgagccccgacccccccgccagaggcggccccagccccagcccccccaccgcccccaaggccctggccacccccgcccccgacaccctgcccgtggagcccggcgcccccagcaccgccaccgccagcgacatcagccccggcgccagccccagcctgctgagcccctggggcccctgggccggcagcggcagcatcagcagccccggcagcaccggcagccccctgcacgaggagcccagcccccccagcccccagaacggccccggcaccgccgtgcccgcccccaccgacttcagacccagcgccacccccgaggacctgctggccagccccctgagccccagcgaggtggccgccgtgccccccgccgaccccggccccgaggccctgcaccccaccgtgcccctggacctgccccccgccaccgtgcccgccaccaccttccccggcgccatgggcagcgtgaagcccgccctggactggctgaccagagagggcggcgagctgcccgaggccgacgagtggaccggcggcgacgcccccgccttcagcaccagcaccctgctgagcggcgacggcgacagcgccgagctggagggcccccccgcccccctgatcctgcccagcagcctggactaccagtacgacacccccggcctgtgggagctggaggaggccaccctgggcgccagcagctgcccctgcgtggagagcgtgcagggcagcaccctgatgcccgtgcacgtggagagagagatcagactgctgggcagaaacctgcacctgttccaggacggccccggcgacaacgagtgcgtgatggagctggagggcctggaggtggtggtggaggccagagtggagtgcgagcccccccccgacacccagtgccacgtgacctgccagcagcaccagctgagctacgaggccctgcagcccgagctgagagtgggcctgttcctgagaagagccggcagactgagagtggacagcgccgagggcctgcacgtggtgctgtacgactgcagcgtgggccacggcgactgcagcagatgccagaccgccatgccccagtacggctgcgtgtggtgcgagggcgagagacccagatgcgtgaccagagaggcctgcggcgaggccgaggccgtggccacccagtgccccgcccccctgatccacagcgtggagcccctgaccggccccgtggacggcggcaccagagtgaccatcagaggcagcaacctgggccagcacgtgcaggacgtgctgggcatggtgaccgtggccggcgtgccctgcgccgtggacgcccaggagtacgaggtgagcagcagcctggtgtgcatcaccggcgccagcggcgaggaggtggccggcgccaccgccgtggaggtgcccggcagaggcagaggcgtgagcgagcacgacttcgcctaccaggaccccaaggtgcacagcatcttccccgccagaggccccagagccggcggcaccagactgaccctgaacggcagcaagctgctgaccggcagactggaggacatcagagtggtggtgggcgaccagccctgccacctgctgcccgagcagcagagcgagcagctgagatgcgagaccagccccagacccacccccgccaccctgcccgtggccgtgtggttcggcgccaccgagagaagactgcagagaggccagttcaagtacaccctggaccccaacatcaccagcgccggccccaccaagagcttcctgagcggcggcagagagatctgcgtgagaggccagaacctggacgtggtgcagacccccagaatcagagtgaccgtggtgagcagaatgctgcagcccagccagggcctgggcagaagaagaagagtggtgcccgagaccgcctgcagcctgggccccagctgcagcagccagcagttcgaggagccctgccacgtgaacagcagccagctgatcacctgcagaacccccgccctgcccggcctgcccgaggacccctgggtgagagtggagttcatcctggacaacctggtgttcgacttcgccaccctgaaccccacccccttcagctacgaggccgaccccaccctgcagcccctgaaccccgaggaccccaccatgcccttcagacacaagcccggcagcgtgttcagcgtggagggcgagaacctggacctggccatgagcaaggaggaggtggtggccatgatcggcgacggcccctgcgtggtgaagaccctgaccagacaccacctgtactgcgagccccccgtggagcagcccctgcccagacaccacgccctgagagaggcccccgacagcctgcccgagttcaccgtgcagatgggcaacctgagattcagcctgggccacgtgcagtacgacggcgagagccccggcgccttccccgtggccgcccaggtgggcctgggcgtgggcaccagcctgctggccctgggcgtgatcatcatcgtgctgatgtacagaagaaagagcaagcaggccctgagagactacaagaaggtgcagatccagctggagaacctggagagcagcgtgagagacagatgcaagaaggagttcaccgacctgatgaccgagatgaccgacctgaccagcgacctgctgggcagcggcatccccttcctggactacaaggtgtacgccgagagaatcttcttccccggccacagagagagccccctgcacagagacctgggcgtgcccgagagcagaagacccaccgtggagcagggcctgggccagctgagcaacctgctgaacagcaagctgttcctgaccaagttcatccacaccctggagagccagagaaccttcagcgccagagacagagcctacgtggccagcctgctgaccgtggccctgcacggcaagctggagtacttcaccgacatcctgagaaccctgctgagcgacctggtggcccagtacgtggccaagaaccccaagctgatgctgagaagaaccgagaccgtggtggagaagctgctgaccaactggatgagcatctgcctgtacaccttcgtgagagacagcgtgggcgagcccctgtacatgctgttcagaggcatcaagcaccaggtggacaagggccccgtggacagcgtgaccggcaaggccaagtacaccctgaacgacaacagactgctgagagaggacgtggagtacagacccctgaccctgaacgccctgctggccgtgggccccggcgccggcgaggcccagggcgtgcccgtgaaggtgctggactgcgacaccatcagccaggccaaggagaagatgctggaccagctgtacaagggcgtgcccctgacccagagacccgaccccagaaccctggacgtggagtggagaagcggcgtggccggccacctgatcctgagcgacgaggacgtgaccagcgaggtgcagggcctgtggagaagactgaacaccctgcagcactacaaggtgcccgacggcgccaccgtggccctggtgccctgcctgaccaagcacgtgctgagagagaaccaggactacgtgcccggcgagagaacccccatgctggaggacgtggacgagggcggcatcagaccctggcacctggtgaagcccagcgacgagcccgagccccccagacccagaagaggcagcctgagaggcggcgagagagagagagccaaggccatccccgagatctacctgaccagactgctgagcatgaagggcaccctgcagaagttcgtggacgacctgttccaggtgatcctgagcaccagcagacccgtgcccctggccgtgaagtacttcttcgacctgctggacgagcaggcccagcagcacggcatcagcgaccaggacaccatccacatctggaagaccaacagcctgcccctgagattctggatcaacatcatcaagaacccccagttcgtgttcgacgtgcagaccagcgacaacatggacgccgtgctgctggtgatcgcccagaccttcatggacgcctgcaccctggccgaccacaagctgggcagagacagccccatcaacaagctgctgtacgccagagacatccccagatacaagagaatggtggagagatactacgccgacatcagacagaccgtgcccgccagcgaccaggagatgaacagcgtgctggccgagctgagctggaactacagcggcgacctgggcgccagagtggccctgcacgagctgtacaagtacatcaacaagtactacgaccagatcatcaccgccctggaggaggacggcaccgcccagaagatgcagctgggctacagactgcagcagatcgccgccgccgtggagaacaaggtgaccgacctgtag

SEQ ID NO: 3687 - DNA, 297 bp, Artificial Sequence
  Description of Artificial Sequence: Synthetic coding sequence
atgaagctgatggtgctggtgttcaccatcggcctgaccctgctgctgggcgtgcaggccatgcccgccaacagactgagctgctacagaaagatcctgaaggaccacaactgccacaacctgcccgagggcgtggccgacctgacccagatcgacgtgaacgtgcaggaccacttctgggacggcaagggctgcgagatgatctgctactgcaacttcagcgagctgctgtgctgccccaaggacgtgttcttcggccccaagatcagcttcgtgatcccctgcaacaaccagtag

SEQ ID NO: 3688 - DNA, 1443 bp, Artificial Sequence
  Description of Artificial Sequence: Synthetic coding sequence
atgaagagaagcgtggccgtgtggctgctggtgggcctgagcctgggcgtgccccagttcggcaagggcgacatctgcgaccccaacccctgcgagaacggcggcatctgcctgcccggcctggccgacggcagcttcagctgcgagtgccccgacggcttcaccgaccccaactgcagcagcgtggtggaggtggccagcgacgaggaggagcccaccagcgccggcccctgcacccccaacccctgccacaacggcggcacctgcgagatcagcgaggcctacagaggcgacaccttcatcggctacgtgtgcaagtgccccagaggcttcaacggcatccactgccagcacaacatcaacgagtgcgaggtggagccctgcaagaacggcggcatctgcaccgacctggtggccaactacagctgcgagtgccccggcgagttcatgggcagaaactgccagtacaagtgcagcggccccctgggcatcgagggcggcatcatcagcaaccagcagatcaccgccagcagcacccacagagccctgttcggcctgcagaagtggtacccctactacgccagactgaacaagaagggcctgatcaacgcctggaccgccgccgagaacgacagatggccctggatccagatcaacctgcagagaaagatgagagtgaccggcgtgatcacccagggcgccaagagaatcggcagccccgagtacatcaagagctacaagatcgcctacagcaacgacggcaagacctgggccatgtacaaggtgaagggcaccaacgaggacatggtgttcagaggcaacatcgacaacaacaccccctacgccaacagcttcaccccccccatcaaggcccagtacgtgagactgtacccccaggtgtgcagaagacactgcaccctgagaatggagctgctgggctgcgagctgagcggctgcagcgagcccctgggcatgaagagcggccacatccaggactaccagatcaccgccagcagcatcttcagaaccctgaacatggacatgttcacctgggagcccagaaaggccagactggacaagcagggcaaggtgaacgcctggaccagcggccacaacgaccagagccagtggctgcaggtggacctgctggtgcccaccaaggtgaccggcatcatcacccagggcgccaaggacttcggccacgtgcagttcgtgggcagctacaagctggcctacagcaacgacggcgagcactggaccgtgtaccaggacgagaagcagagaaaggacaaggtgttccagggcaacttcgacaacgacacccacagaaagaacgtgatcgacccccccatctacgccagacacatcagaatcctgccctggagctggtacggcagaatcaccctgagaagcgagctgctgggctgcaccgaggaggagtag

SEQ ID NO: 3689 - DNA, 1323 bp, Artificial Sequence
  Description of Artificial Sequence: Synthetic coding sequence
atggccgtgaagctgggcaccctgctgctggccctggccctgggcctggcccagcccgccagcgccagaagaaagctgctggtgttcctgctggacggcttcagaagcgactacatcagcgacgaggccctggagagcctgcccggcttcaaggagatcgtgagcagaggcgtgaaggtggactacctgacccccgacttccccagcctgagctaccccaactactacaccctgatgaccggcagacactgcgaggtgcaccagatgatcggcaactacatgtgggaccccaccaccaacaagagcttcgacatcggcgtgaacaaggacagcctgatgcccctgtggtggaacggcagcgagcccctgtgggtgaccctgaccaaggccaagagaaaggtgtacatgtactactggcccggctgcgaggtggagatcctgggcgtgagacccacctactgcctggagtacaagaacgtgcccaccgacatcaacttcgccaacgccgtgagcgacgccctggacagcttcaagagcggcagagccgacctggccgccatctaccacgagagaatcgacgtggagggccaccactacggccccgccagcccccagagaaaggacgccctgaaggccgtggacaccgtgctgaagtacatgaccaagtggatccaggagagaggcctgcaggacagactgaacgtgatcatcttcagcgaccacggcatgaccgacatcttctggatggacaaggtgatcgagctgaacaagtacatcagcctgaacgacctgcagcaggtgaaggacagaggccccgtggtgagcctgtggcccgcccccggcaagcacagcgagatctacaacaagctgagcaccgtggagcacatgaccgtgtacgagaaggaggccatccccagcagattctactacaagaagggcaagttcgtgagccccctgaccctggtggccgacgagggctggttcatcaccgagaacagagagatgctgcccttctggatgaacagcaccggcagaagagagggctggcagagaggctggcacggctacgacaacgagctgatggacatgagaggcatcttcctggccttcggccccgacttcaagagcaacttcagagccgcccccatcagaagcgtggacgtgtacaacgtgatgtgcaacgtggtgggcatcacccccctgcccaacaacggcagctggagcagagtgatgtgcatgctgaagggcagagccagcaccgccccccccgtgtggcccagccactgcgccctggccctgatcctgctgttcctgctggcctag

SEQ ID NO: 3690 - DNA, 351 bp, Artificial Sequence
  Description of Artificial Sequence: Synthetic coding sequence
atggagagcagcagagtgagactgctgcccctgctgggcgccgccctgctgctgatgctgcccctgctgggcaccagagcccaggaggacgccgagctgcagcccagagccctggacatctacagcgccgtggacgacgccagccacgagaaggagctgatcgaggccctgcaggaggtgctgaagaagctgaagagcaagagagtgcccatctacgagaagaagtacggccaggtgcccatgtgcgacgccggcgagcagtgcgccgtgagaaagggcgccagaatcggcaagctgtgcgactgccccagaggcaccagctgcaacagcttcctgctgaagtgcctgtag

SEQ ID NO: 3691 - DNA, 1365 bp, Artificial Sequence
  Description of Artificial Sequence: Synthetic coding sequence
atggccagacccaacaagttcctgctgtggttctgctgcttcgcctggctgtgcttccccatcagcctgggcagccaggccagcggcggcgaggcccagatcgccgccagcgccgagctggagagcggcgccatgccctggagcctgctgcagcacatcgacgagagagacagagccggcctgctgcccgccctgttcaaggtgctgagcgtgggcagaggcggcagccccagactgcagcccgacagcagagccctgcactacatgaagaagctgtacaagacctacgccaccaaggagggcatccccaagagcaacagaagccacctgtacaacaccgtgagactgttcaccccctgcaccagacacaagcaggcccccggcgaccaggtgaccggcatcctgcccagcgtggagctgctgttcaacctggacagaatcaccaccgtggagcacctgctgaagagcgtgctgctgtacaacatcaacaacagcgtgagcttcagcagcgccgtgaagtgcgtgtgcaacctgatgatcaaggagcccaagagcagcagcagaaccctgggcagagccccctacagcttcaccttcaacagccagttcgagttcggcaagaagcacaagtggatccagatcgacgtgaccagcctgctgcagcccctggtggccagcaacaagagaagcatccacatgagcatcaacttcacctgcatgaaggaccagctggagcaccccagcgcccagaacggcctgttcaacatgaccctggtgagccccagcctgatcctgtacctgaacgacaccagcgcccaggcctaccacagctggtacagcctgcactacaagagaagacccagccagggccccgaccaggagagaagcctgagcgcctaccccgtgggcgaggaggccgccgaggacggcagaagcagccaccacagacacagaagaggccaggagaccgtgagcagcgagctgaagaagcccctgggccccgccagcttcaacctgagcgagtacttcagacagttcctgctgccccagaacgagtgcgagctgcacgacttcagactgagcttcagccagctgaagtgggacaactggatcgtggccccccacagatacaaccccagatactgcaagggcgactgccccagagccgtgggccacagatacggcagccccgtgcacaccatggtgcagaacatcatctacgagaagctggacagcagcgtgcccagacccagctgcgtgcccgccaagtacagccccctgagcgtgctgaccatcgagcccgacggcagcatcgcctacaaggagtacgaggacatgatcgccaccaagtgcacctgcagatag

SEQ ID NO: 3692 - DNA, 234 bp, Artificial Sequence
  Description of Artificial Sequence: Synthetic coding sequence
atgtggcacctgaagctgtgcgccgtgctgatgatcttcctgctgctgctgggccagatcgacggcagccccatccccgaggtgagcagcgccaagagaagacccagaagaatgacccccttctggagaggcgtgagcctgagacccatcggcgccagctgcagagacgacagcgagtgcatcaccagactgtgcagaaagagaagatgcagcctgagcgtggcccaggagtag

SEQ ID NO: 3693 - DNA, 912 bp, Artificial Sequence
  Description of Artificial Sequence: Synthetic coding sequence
atgagcgagccccagcccgacctggagcccccccagcacggcctgtacatgctgttcctgctggtgctggtgttcttcctgatgggcctggtgggcttcatgatctgccacgtgctgaagaagaagggctacagatgcagaaccagcagaggcagcgagcccgacgacgcccagctgcagccccccgaggacgacgacatgaacgaggacaccgtggagagaatcgtgagatgcatcatccagaacgaggccaacgccgaggccctgaaggagatgctgggcgacagcgagggcgagggcaccgtgcagctgagcagcgtggacgccaccagcagcctgcaggacggcgcccccagccaccaccacaccgtgcacctgggcagcgccgccccctgcctgcactgcagcagaagcaagagaccccccctggtgagacagggcagaagcaaggagggcaagagcagacccagaaccggcgagaccaccgtgttcagcgtgggcagattcagagtgacccacatcgagaagagatacggcctgcacgagcacagagacggcagccccaccgacagaagctggggcagcggcggcggccaggaccccggcggcggccagggcagcggcggcggccagcccaaggccggcatgcccgccatggagagactgccccccgagagaccccagccccaggtgctggccagcccccccgtgcagaacggcggcctgagagacagcagcctgacccccagagccctggagggcaaccccagagccagcgccgagcccaccctgagagccggcggcagaggccccagccccggcctgcccacccaggaggccaacggccagcccagcaagcccgacaccagcgaccaccaggtgagcctgccccagggcgccggcagcatgtag

SEQ ID NO: 3694 - DNA, 795 bp, Artificial Sequence
  Description of Artificial Sequence: Synthetic coding sequence
atgagaaccctgtggatggccctgtgcgccctgagcagactgtggcccggcgcccaggccggctgcgccgaggccggcagatgctgccccggcagagaccccgcctgcttcgccagaggctggagactggacagagtgtacggcacctgcttctgcgaccaggcctgcagattcaccggcgactgctgcttcgactacgacagagcctgccccgccagaccctgcttcgtgggcgagtggagcccctggagcggctgcgccgaccagtgcaagcccaccaccagagtgagaagaagaagcgtgcagcaggagccccagaacggcggcgccccctgcccccccctggaggagagagccggctgcctggagtacagcaccccccagggccaggactgcggccacacctacgtgcccgccttcatcaccaccagcgccttcaacaaggagagaaccagacaggccaccagcccccactggagcacccacaccgaggacgccggctactgcatggagttcaagaccgagagcctgaccccccactgcgccctggagaactggcccctgaccagatggatgcagtacctgagagagggctacaccgtgtgcgtggactgccagccccccgccatgaacagcgtgagcctgagatgcagcggcgacggcctggacagcgacggcaaccagaccctgcactggcaggccatcggcaaccccagatgccagggcacctggaagaaggtgagaagagtggaccagtgcagctgccccgccgtgcacagcttcatcttcatctag

SEQ ID NO: 3695 - DNA, 312 bp, Artificial Sequence
  Description of Artificial Sequence: Synthetic coding sequence
atgagacagagactgctgcccagcgtgaccagcctgctgctggtggccctgctgttccccggcagcagccaggccagacacgtgaaccacagcgccaccgaggccctgggcgagctgagagagagagcccccggccagggcaccaacggcttccagctgctgagacacgccgtgaagagagacctgctgccccccagaacccccccctaccaggtgcacatcagccacagagaggccagaggccccagcttcagaatctgcgtggacttcctgggccccagatgggccagaggctgcagcaccggcaactag

SEQ ID NO: 3696 - DNA, 3867 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacgcccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacagactggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagctacctggacctgaacttcgagatcagcttcggcggcatccccacccccggcagaagcagagccttcagaagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgagaagaggcagcggcagcttcgtgctgttcctgaaggacggcaagctgaagctgagcctgttccagcccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcggctgcctggacaacagcagcggcagcggctgcaagagccccctgggcggcttccagggctgcctgagactgatcaccatcggcgacaaggccgtggaccccatcctggtgcagcagggcgccctgggcagcttcagagacctgcagatcgacagctgcggcatcaccgacagatgcctgcccagctactgcgagcacggcggcgagtgcagccagagctgggacaccttcagctgcgactgcctgggcaccggctacaccggcgagacctgccacagcagcctgtacgagcagagctgcgaggcccacaagcacagaggcaaccccagcggcctgtactacatcgacgccgacggcagcggccccctgggccccttcctggtgtactgcaacatgaccgccgacgccgcctggaccgtggtgcagcacggcggccccgacgccgtgaccctgagaggcgcccccagcggccaccccagaagcgccgtgagcttcgcctacgccgccggcgccggccagctgagaagcgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggcagaaacgagtggaccagcgacaccatcgtgctgagccagaaggagcacctgcccgtgacccagatcgtgatgaccgacgccggcagaccccacagcgaggccgcctacaccctgggccccctgctgtgcagaggcgaccagagcttctggaacagcgccagcttcaacaccgagaccagctacctgcacttccccgccttccacggcgagctgaccgccgacgtgtgcttcttcttcaagaccaccgtgagcagcggcgtgttcatggagaacctgggcatcaccgacttcatcagaatcgagctgagagcccccaccgaggtgaccttcagcttcgacgtgggcaacggcccctgcgaggtgaccgtgcagagccccacccccttcaacgacaaccagtggcaccacgtgagagccgagagaaacgtgaagggcgccagcctgcaggtggaccagctgccccagaagatgcagcccgcccccgccgacggccacgtgagactgcagctgaacagccagctgttcatcggcggcaccgccaccagacagagaggcttcctgggctgcatcagaagcctgcagctgaacggcgtggccctggacctggaggagagagccaccgtgacccccggcgtggagcccggctgcgccggccactgcagcacctacggccacctgtgcagaaacggcggcagatgcagagagaagagaagaggcgtgacctgcgactgcgccttcagcgcctacgacggccccttctgcagcaacgagatcagcgcctacttcgccaccggcagcagcatgacctaccacttccaggagcactacaccctgagcgagaacagcagcagcctggtgagcagcctgcacagagacgtgaccctgaccagagagatgatcaccctgagcttcagaaccaccagaacccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgaaccagagcaccaagaagcaggtgatcctgagcagcggcaccgagttcaacgccgtgaagagcctgatcctgggcaaggtgctggaggccgccggcgccgaccccgacaccagaagagccgccaccagcggcttcaccggctgcctgagcgccgtgagattcggcagagccgcccccctgaaggccgccctgagacccagcggccccagcagagtgaccgtgagaggccacgtggcccccatggccagatgcgccgccggcgccgccagcggcagccccgccagagagctggcccccagactggccggcggcgccggcagaagcggccccgccgacgagggcgagcccctggtgaacgccgacagaagagacagcgccgtgatcggcggcgtgatcgccgtggtgatcttcatcctgctgtgcatcaccgccatcgccatcagaatctaccagcagagaaagctgagaaaggagaacgagagcaaggtgagcaagaaggaggagtgctag

SEQ ID NO: 3697 - DNA, 369 bp, Artificial Sequence
  Description of Artificial Sequence: Synthetic coding sequence
atggtgcccggcccccccgagagcgtggtgagattcttcctgtggttctgcttcctgctgccccccaccagaaaggccagctgcgaccccagagacctgaagagctgcaacagaccctgcgtgtggagcagactgctgaagcccaacagcagcctgagcaacctggagaccgcctacttcccccagatcctgagattcctgagaccctggtacttcagcagaagccacctgaactaccaccagaaggcccccgccagatgggagtggctgtacagcatctacagaaagggcaccaaggcccagagaagaaacgtgctgagaagcccctgcgcccccccccagcccagctggccctgcagcgtgatctag

SEQ ID NO: 3698 - DNA, 1887 bp, Artificial Sequence
  Description of Artificial Sequence: Synthetic coding sequence
atggcccccagcgccgaccccggcatgagcagaatgctgcccttcctgctgctgctgtggttcctgcccatcaccgagggcagccagagagccgagcccatgttcaccgccgtgaccaacagcgtgctgccccccgactacgacagcaaccccacccagctgaactacggcgtggccgtgaccgacgtggaccacgacggcgacttcgagatcgtggtggccggctacaacggccccaacctggtgctgaagtacgacagagcccagaagagactggtgaacatcgccgtggacgagagaagcagcccctactacgccctgagagacagacagggcaacgccatcggcgtgaccgcctgcgacatcgacggcgacggcagagaggagatctacttcctgaacaccaacaacgccttcagcggcgtggccacctacaccgacaagctgttcaagttcagaaacaacagatgggaggacatcctgagcgacgaggtgaacgtggccagaggcgtggccagcctgttcgccggcagaagcgtggcctgcgtggacagaaagggcagcggcagatacagcatctacatcgccaactacgcctacggcaacgtgggccccgacgccctgatcgagatggaccccgaggccagcgacctgagcagaggcatcctggccctgagagacgtggccgccgaggccggcgtgagcaagtacaccggcggcagaggcgtgagcgtgggccccatcctgagcagcagcgccagcgacatcttctgcgacaacgagaacggccccaacttcctgttccacaacagaggcgacggcaccttcgtggacgccgccgccagcgccggcgtggacgacccccaccagcacggcagaggcgtggccctggccgacttcaacagagacggcaaggtggacatcgtgtacggcaactggaacggcccccacagactgtacctgcagatgagcacccacggcaaggtgagattcagagacatcgccagccccaagttcagcatgcccagccccgtgagaaccgtgatcaccgccgacttcgacaacgaccaggagctggagatcttcttcaacaacatcgcctacagaagcagcagcgccaacagactgttcagagtgatcagaagagagcacggcgaccccctgatcgaggagctgaaccccggcgacgccctggagcccgagggcagaggcaccggcggcgtggtgaccgacttcgacggcgacggcatgctggacctgatcctgagccacggcgagagcatggcccagcccctgagcgtgttcagaggcaaccagggcttcaacaacaactggctgagagtggtgcccagaaccagattcggcgccttcgccagaggcgccaaggtggtgctgtacaccaagaagagcggcgcccacctgagaatcatcgacggcggcagcggctacctgtgcgagatggagcccgtggcccacttcggcctgggcaaggacgaggccagcagcgtggaggtgacctggcccgacggcaagatggtgagcagaaacgtggccagcggcgagatgaacagcgtgctggagatcctgtaccccagagacgaggacaccctgcaggaccccgcccccctggagacccccatgaacgccagcagcagccacagctgcgccctggagaccagcccctacgtgagcacccccatggaggccaccggcgccggccccaccagaagcgccgtgggcgccaccagccccaccagaatggcccagcccgcctggggcctgagcgccagccacagagcccccgcccccccccccccccccctgctgctgcccctgcccctgctgctgcccctgctggagctgcccctgctgcacagaagcagctag

SEQ ID NO: 3699 - DNA, 1008 bp, Artificial Sequence
  Description of Artificial Sequence: Synthetic coding sequence
atgcagggccagggcagaagaagaggcacctgcaaggacatcttctgcagcaagatggccagctacctgtacggcgtgctgttcgccgtgggcctgtgcgcccccatctactgcgtgagccccgccaacgcccccagcgcctaccccagacccagcagcaccaagagcacccccgccagccaggtgtacagcctgaacaccgacttcgccttcagactgtacagaagactggtgctggagacccccagccagaacatcttcttcagccccgccagaatcaacagccacgtgaagaagaagacccagggcaaggtggtggacatcatccagggcctggacctgctgaccgccatggtgctggtgaaccacatcttcttcaaggccaagtgggagaagcccttccaccccgagtacaccagaaagaacttccccttcctggtgggcgagcaggtgaccgtgcacgtgcccatgatgcaccagaaggagcagttcgccttcggcgtggacaccgagctgaactgcttcgtgctgcagatggactacaagggcgacgccgtggccttcttcgtgctgcccagcaagggcaagatgagacagctggagcaggccctgagcgccagaaccctgagaaagtggagccacagcctgcagaagagatggatcgaggtgttcatccccagattcagcatcagcgccagctacaacctggagaccatcctgcccaagatgggcatccagaacgtgttcgacaagaacgccgacttcagcggcatcgccaagagagacagcctgcaggtgagcaaggccacccacaaggccgtgctggacgtgagcgaggagggcaccgaggccaccgccgccaccaccaccaagttcatcgtgagaagcaaggacggccccagctacttcaccgtgagcttcaacagaaccttcctgatgatgatcaccaacaaggccaccgacggcatcctgttcctgggcaaggtggagaaccccaccaagagctag

SEQ ID NO: 3700 - DNA, 768 bp, Artificial Sequence
  Description of Artificial Sequence: Synthetic coding sequence
atggtgctgctgctggtgatcctgatccccgtgctggtgagcagcgccggcaccagcgcccactacgagatgctgggcacctgcagaatggtgtgcgacccctacggcggcaccaaggcccccagcaccgccgccacccccgacagaggcctgatgcagagcctgcccaccttcatccagggccccaagggcgaggccggcagacccggcaaggccggccccagaggcccccccggcgagcccggcccccccggccccatgggcccccccggcgagaagggcgagcccggcagacagggcctgcccggcccccccggcgcccccggcctgaacgccgccggcgccatcagcgccgccacctacagcaccgtgcccaagatcgccttctacgccggcctgaagagacagcacgagggctacgaggtgctgaagttcgacgacgtggtgaccaacctgggcaaccactacgaccccaccaccggcaagttcacctgcagcatccccggcatctacttcttcacctaccacgtgctgatgagaggcggcgacggcaccagcatgtgggccgacctgtgcaagaacaaccaggtgagagccagcgccatcgcccaggacgccgaccagaactacgactacgccagcaacagcgtggtgctgcacctggagcccggcgacgaggtgtacatcaagctggacggcggcaaggcccacggcggcaacaacaacaagtacagcaccttcagcggcttcatcatctacgccgactag

SEQ ID NO: 3701 - DNA, 1617 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgccctgggcctggccagagccaacaacgagctgctgaagagactgcaggaggaggtgggcgacctgagacagggcaaggtgagcatccccgacgaggacggcgagagcagagcccacagcagcccccccgaggagcccggccccctgaaggagagccccggcgaggccttcaaggccctgagcgccgtggaggaggagtgcgacagcgtgggcagcggcgtgcaggtggtgatcgaggagctgagacagctgggcgccgccagcgtgggccccggccccctgggcttccccgccacccagagagacatgagactgcccggctgcaccctggccgccagcgaggccgcccccctgctgaaccccctggtggacgactacgtggccagcgagggcgccgtgcagagagtgctggtgcccgcctacgccaagcagctgagccccgccacccagctggccatccagagagccacccccgagaccggccccgagaacggcaccaagctgcccccccccagacccgaggacatgctgaacgccgccgccgccctggacagcgccctggaggagagcggccccggcagcaccggcgagctgagacacagcctgggcctgaccgtgagcccctgcagaaccagaggcagcggccagaagaacagcagaagaaagagagacctggtgctgagcaagctggtgcacaacgtgcacaaccacatcaccaacgacaagagattcaacggcagcgagagcatcaagagcagctggaacatcagcgtggtgaagttcctgctggagaagctgaagcaggagctggtgaccagcccccacaactacaccgacaaggagctgaagggcgcctgcgtggcctacttcctgaccaagagaagagagtacagaaacagcctgaaccccttcaagggcctgaaggagaaggaggagaagaagctgagaagcagaagatacagactgttcgccaacagaagcagcatcatgagacacttcggccccgaggaccagagactgtggaacgacgtgaccgaggagctgatgagcgacgaggaggacagcctgaacgagcccggcgtgtgggtggccagaccccccagattcagagcccagagactgaccgagctgtgctaccacctggacgccaacagcaagcacggcaccaaggccaacagagtgtacggcccccccagcgacagactgcccagcgccgaggcccagctgctgccccccgagctgtacaaccccaacttccaggaggaggaggacgagggcggcgacgagaacgcccccggcagccccagcttcgaccagccccacaagacctgctgccccgacctgaacagcttcatcgagatcaaggtggagaaggacgagtag

SEQ ID NO: 3702 - DNA, 2853 bp, Artificial Sequence
  Description of Artificial Sequence: Synthetic coding sequence
atgctgctgctgggcatcctgaccctggccttcgccggcagaaccgccggcggcagcgagcccgagagagaggtggtggtgcccatcagactggaccccgacatcaacggcagaagatactactggagaggccccgaggacagcggcgaccagggcctgatcttccagatcaccgccttccaggaggacttctacctgcacctgacccccgacgcccagttcctggcccccgccttcagcaccgagcacctgggcgtgcccctgcagggcctgaccggcggcagcagcgacctgagaagatgcttctacagcggcgacgtgaacgccgagcccgacagcttcgccgccgtgagcctgtgcggcggcctgagaggcgccttcggctacagaggcgccgagtacgtgatcagccccctgcccaacgccagcgcccccgccgcccagagaaacagccagggcgcccacctgctgcagagaagaggcgtgcccggcggccccagcggcgaccccaccagcagatgcggcgtggccagcggctggaaccccgccatcctgagagccctggacccctacaagcccagaagagccggcttcggcgagagcagaagcagaagaagaagcggcagagccaagagattcgtgagcatccccagatacgtggagaccctggtggtggccgacgagagcatggtgaagttccacggcgccgacctggagcactacctgctgaccctgctggccaccgccgccagactgtacagacaccccagcatcctgaaccccatcaacatcgtggtggtgaaggtgctgctgctgagagacagagacagcggccccaaggtgaccggcaacgccgccctgaccctgagaaacttctgcgcctggcagaagaagctgaacaaggtgagcgacaagcaccccgagtactgggacaccgccatcctgttcaccagacaggacctgtgcggcgccaccacctgcgacaccctgggcatggccgacgtgggcaccatgtgcgaccccaagagaagctgcagcgtgatcgaggacgacggcctgcccagcgccttcaccaccgcccacgagctgggccacgtgttcaacatgccccacgacaacgtgaaggtgtgcgaggaggtgttcggcaagctgagagccaaccacatgatgagccccaccctgatccagatcgacagagccaacccctggagcgcctgcagcgccgccatcatcaccgacttcctggacagcggccacggcgactgcctgctggaccagcccagcaagcccatcagcctgcccgaggacctgcccggcgccagctacaccctgagccagcagtgcgagctggccttcggcgtgggcagcaagccctgcccctacatgcagtactgcaccaagctgtggtgcaccggcaaggccaagggccagatggtgtgccagaccagacacttcccctgggccgacggcaccagctgcggcgagggcaagctgtgcctgaagggcgcctgcgtggagagacacaacctgaacaagcacagagtggacggcagctgggccaagtgggacccctacggcccctgcagcagaacctgcggcggcggcgtgcagctggccagaagacagtgcaccaaccccacccccgccaacggcggcaagtactgcgagggcgtgagagtgaagtacagaagctgcaacctggagccctgccccagcagcgccagcggcaagagcttcagagaggagcagtgcgaggccttcaacggctacaaccacagcaccaacagactgaccctggccgtggcctgggtgcccaagtacagcggcgtgagccccagagacaagtgcaagctgatctgcagagccaacggcaccggctacttctacgtgctggcccccaaggtggtggacggcaccctgtgcagccccgacagcaccagcgtgtgcgtgcagggcaagtgcatcaaggccggctgcgacggcaacctgggcagcaagaagagattcgacaagtgcggcgtgtgcggcggcgacaacaagagctgcaagaaggtgaccggcctgttcaccaagcccatgcacggctacaacttcgtggtggccatccccgccggcgccagcagcatcgacatcagacagagaggctacaagggcctgatcggcgacgacaactacctggccctgaagaacagccagggcaagtacctgctgaacggccacttcgtggtgagcgccgtggagagagacctggtggtgaagggcagcctgctgagatacagcggcaccggcaccgccgtggagagcctgcaggccagcagacccatcctggagcccctgaccgtggaggtgctgagcgtgggcaagatgaccccccccagagtgagatacagcttctacctgcccaaggagcccagagaggacaagagcagccaccccaaggaccccagaggccccagcgtgctgcacaacagcgtgctgagcctgagcaaccaggtggagcagcccgacgacagaccccccgccagatgggtggccggcagctggggcccctgcagcgccagctgcggcagcggcctgcagaagagagccgtggactgcagaggcagcgccggccagagaaccgtgcccgcctgcgacgccgcccacagacccgtggagacccaggcctgcggcgagccctgccccacctgggagctgagcgcctggagcccctgcagcaagagctgcggcagaggcttccagagaagaagcctgaagtgcgtgggccacggcggcagactgctggccagagaccagtgcaacctgcacagaaagccccaggagctggacttctgcgtgctgagaccctgctag

SEQ ID NO: 3703 - DNA, 1521 bp, Artificial Sequence
  Description of Artificial Sequence: Synthetic coding sequence
atgaccagcaagccccacagcgactggatcccctacagcgtgctggacgacgagggcagaaacctgagacagcagaagctggacagacagagagccctgctggagcagaagcagaagaagaagagacaggagcccctgatggtgcaggccaacgccgacggcagacccagaagcagaagagccagacagagcgaggagcaggcccccctggtggagagctacctgagcagcagcggcagcaccagctaccaggtgcaggaggccgacagcctggccagcgtgcagctgggcgccaccagacccaccgcccccgccagcgccaagagaaccaaggccgccgccaccgccggcggccagggcggcgccgccagaaaggagaagaagggcaagcacaagggcaccagcggccccgccgccctggccgaggacaagagcgaggcccagggccccgtgcagatcctgaccgtgggccagagcgaccacgcccaggacgccggcgagaccgccgccggcggcggcgagagacccagcggccaggacctgagagccaccatgcagagaaagggcatcagcagcagcatgagcttcgacgaggacgaggaggacgaggaggagaacagcagcagcagcagccagctgaacagcaacaccagacccagcagcgccaccagcagaaagagcgtgagagaggccgccagcgcccccagccccaccgcccccgagcagcccgtggacgtggaggtgcaggacctggaggagttcgccctgagacccgccccccagggcatcaccatcaagtgcagaatcaccagagacaagaagggcatggacagaggcatgtaccccacctacttcctgcacctggacagagaggacggcaagaaggtgttcctgctggccggcagaaagagaaagaagagcaagaccagcaactacctgatcagcgtggaccccaccgacctgagcagaggcggcgacagctacatcggcaagctgagaagcaacctgatgggcaccaagttcaccgtgtacgacaacggcgtgaacccccagaaggccagcagcagcaccctggagagcggcaccctgagacaggagctggccgccgtgtgctacgagaccaacgtgctgggcttcaagggccccagaaagatgagcgtgatcgtgcccggcatgaacatggtgcacgagagagtgagcatcagacccagaaacgagcacgagaccctgctggccagatggcagaacaagaacaccgagagcatcatcgagctgcagaacaagacccccgtgtggaacgacgacacccagagctacgtgctgaacttccacggcagagtgacccaggccagcgtgaagaacttccagatcatccacggcaacgaccccgactacatcgtgatgcagttcggcagagtggccgaggacgtgttcaccatggactacaactaccccctgtgcgccctgcaggccttcgccatcgccctgagcagcttcgacagcaagctggcctgcgagtag

SEQ ID NO: 3704 - DNA, 594 bp, Artificial Sequence
  Description of Artificial Sequence: Synthetic coding sequence
atggccaagaacggcctggtgatctgcatcctggtgatcaccctgctgctggaccagaccaccagccacaccagcagactgaaggccagaaagcacagcaagagaagagtgagagacaaggacggcgacctgaagacccagatcgagaagctgtggaccgaggtgaacgccctgaaggagatccaggccctgcagaccgtgtgcctgagaggcaccaaggtgcacaagaagtgctacctggccagcgagggcctgaagcacttccacgaggccaacgaggactgcatcagcaagggcggcatcctggtgatccccagaaacagcgacgagatcaacgccctgcaggactacggcaagagaagcctgcccggcgtgaacgacttctggctgggcatcaacgacatggtgaccgagggcaagttcgtggacgtgaacggcatcgccatcagcttcctgaactgggacagagcccagcccaacggcggcaagagagagaactgcgtgctgttcagccagagcgcccagggcaagtggagcgacgaggcctgcagaagcagcaagagatacatctgcgagttcaccatcccccagtag

SEQ ID NO: 3705 - DNA, 2424 bp, Artificial Sequence
  Description of Artificial Sequence: Synthetic coding sequence
aagaagaagagaaagatcagcctgctgcccaagccccccaagcacgacgcccccctgaccatcgagttccccaacctggacaagaccagcgccgagtggctgaaggtgaacggcctgaaggccaagaagctgagcctgtaccaggtgctggcccccaacgccttcagccccgtggaggagttcgtgcccatcctgcagaagaccgtgagcagcaccatccacgagaaggccatgatccagttcgagtggcacgacggcaccgtgaagaacatccacgtggacccccccttcctgtacaagtaccagcagcagctgagcagagccatgagaatgtacgagagaagaatcgagtggctgagcctggccagcagaagaatctggggcaccgtgtgcgagaagagagtggtggtgctgctggacatcagcgccaccaacagcatgtacatcatccacatccagcacagcctgagactgctgctggaggagcagctgagcaacaaggactgcttcaacctgatcgccttcggcagcaccatcgagagctggagacccgagatggtgcccgtgagccacaacaacctgcagagcgcctggagatgggccctgaacctgagatgcagaggcagcagaaacgtgctgagcgccctgagaaaggccgtggaggtggacttcaaggacaaggacaagcaccagagccagggcatctacctgttcaccggcggcatccccgaccaggacatgcccaccctgagcgcctacatggccgaggcctgcggcggctgcgacctgcagctgaacgtgtgcctgttctacgtgggcgagcccaagatggacaccaccccccccgccagatacgccagccacaccgacaccgccgccgcctacaaggaggtgaccagagccgccggcggcagattccactggttcggcgacaccggcatctacgagagcgacgacatcaacagcatcatgagcgagatggagaaggccctgaactacagccagaagtgcgccttcctgatggccagcctgaagaaccacagcggcaaggtgctgggcagcagcgccctgcccaaggagaagcccaagaccctgcagctgagaagccagcccaagaagctgtgcccccccagacccaccgtgcccctgggcgccagaatgagcatcaaggacgaccccgacagagagaagagcccccccctgaagagcctgaagtggagacccctgagcagcagagtgggcatcagccccgccgccgcccagcccaccaaggagggcatgatggagctgagaagaaagaccaagagcagagaggccgagaccagcctgctgctgttctacaccgagaagggcaacgacgtgggcagcgtgtacaagaagtacccccagggcagaggcctgagaagaaccagcagcagcatcgacctgcccagaaaggacaccgtgtgcagcagccaggagtgggtggccaagtacggcctgaagaagctgaagctggagatcagcagatgcatgggccccaactgcacccaccagaagagcggccagagaagcgccagcgccaagcactgcagcatcttccccagcgtggagatccacggcgtggtgagacacatccagtggacccccagagagatggaggtgtacatcagacacctggagaaggtgctgagaagatacgtgcagagactgcagtggctgctgagcggcagcagaagactgttcggcaccgtgctggagagcaaggtgtgcatcctgctggacaccagcggcagcatgggcccctacctgcagcaggtgaagaccgagctggtgctgctgatctgggagcagctgagaaagtgctgcgacagcttcaacctgctgagcttcgccgagagcttccagagctggcaggacaccctggtggagaccaccgacgccgcctgccacgaggccatgcagtgggtgacccacctgcaggcccagggcagcaccagcatcctgcaggccctgctgaaggccttcagcttccacgacctggagggcctgtacctgctgaccgacggcaagcccgacaccagctgcagcctggtgctgaacgaggtgcagaagctgagagagaagagagacgtgaaggtgcacaccatcagcctgaactgcagcgacagagccgccgtggagttcctgagaaagctggccagcttcaccggcggcagataccactgccccgtgggcgaggacaccctgagcaagatccacagcctgctgaccaagggcttcatcaacgagaaggaccccaccctgccccccttcgagggcgacgacctgagaatcctggcccaggagatcaccaaggccagaagcttcctgtggcaggcccagagcttcagaagccagctgcagaagaagaacgacgccgagcccaaggtgaccctgagctag

SEQ ID NO: 3706 - DNA, 639 bp, Artificial Sequence
  Description of Artificial Sequence: Synthetic coding sequence
atggtgagcagaatggtgagcaccatgctgagcggcctgctgttctggctggccagcggctggacccccgccttcgcctacagccccagaacccccgacagagtgagcgaggccgacatccagagactgctgcacggcgtgatggagcagctgggcatcgccagacccagagtggagtaccccgcccaccaggccatgaacctggtgggcccccagagcatcgagggcggcgcccacgagggcctgcagcacctgggccccttcggcaacatccccaacatcgtggccgagctgaccggcgacaacatccccaaggacttcagcgaggaccagggctaccccgacccccccaacccctgccccgtgggcaagaccgccgacgacggctgcctggagaacacccccgacaccgccgagttcagcagagagttccagctgcaccagcacctgttcgaccccgagcacgactaccccggcctgggcaagtggaacaagaagctgctgtacgagaagatgaagggcggcgagagaagaaagagaagaagcgtgaacccctacctgcagggccagagactggacaacgtggtggccaagaagagcgtgccccacttcagcgacgaggacaaggaccccgagtag

SEQ ID NO: 3707 - DNA, 1524 bp, Artificial Sequence
  Description of Artificial Sequence: Synthetic coding sequence
atgtgcaccaagaccatccccgtgctgtggggctgcttcctgctgtggaacctgtacgtgagcagcagccagaccatctaccccggcatcaaggccagaatcacccagagagccctggactacggcgtgcaggccggcatgaagatgatcgagcagatgctgaaggagaagaagctgcccgacctgagcggcagcgagagcctggagttcctgaaggtggactacgtgaactacaacttcagcaacatcaagatcagcgccttcagcttccccaacaccagcctggccttcgtgcccggcgtgggcatcaaggccctgaccaaccacggcaccgccaacatcagcaccgactggggcttcgagagccccctgttccaggacaccggcggcgccgacctgttcctgagcggcgtgtacttcaccggcatcatcatcctgaccagaaacgacttcggccaccccaccctgaagctgcaggactgctacgcccagctgagccacgcccacgtgagcttcagcggcgagctgagcgtgctgtacaacagcttcgccgagcccatggagaagcccatcctgaagaacctgaacgagatgctgtgccccatcatcgccagcgaggtgaaggccctgaacgccaacctgagcaccctggaggtgctgaccaagatcgacaactacaccctgctggactacagcctgatcagcagccccgagatcaccgagaactacctggacctgaacctgaagggcgtgttctaccccctggagaacctgaccgacccccccttcagccccgtgcccttcgtgctgcccgagagaagcaacagcatgctgtacatcggcatcgccgagtacttcttcaagagcgccagcttcgcccacttcaccgccggcgtgttcaacgtgaccctgagcaccgaggagatcagcaaccacttcgtgcagaacagccagggcctgggcaacgtgctgagcagaatcgccgagatctacatcctgagccagcccttcatggtgagaatcatggccaccgagccccccatcatcaacctgcagcccggcaacttcaccctggacatccccgccagcatcatgatgctgacccagcccaagaacagcaccgtggagaccatcgtgagcatggacttcgtggccagcaccagcgtgggcctggtgatcctgggccagagactggtgtgcagcctgagcctgaacagattcagactggccctgcccgagagcaacagaagcaacatcgaggtgctgagattcgagaacatcctgagcagcatcctgcacttcggcgtgctgcccctggccaacgccaagctgcagcagggcttccccctgagcaacccccacaagttcctgttcgtgaacagcgacatcgaggtgctggagggcttcctgctgatcagcaccgacctgaagtacgagaccagcagcaagcagcagcccagcttccacgtgtgggagggcctgaacctgatcagcagacagtggagaggcaagagcgccccctag

SEQ ID NO: 3708 - DNA, 474 bp, Artificial Sequence
  Description of Artificial Sequence: Synthetic coding sequence
atgcacccctggctgggcagcgccctgggcttccccaagtgcagaggcatccacctgtgcgcctgcggcaacggctggacccccggcgagaccctgagccagaacaagaccgagatcaccaagaacaaggtgacctgctggagaccccacggctgcgagcccaacaccggcctgggctaccagggcagccacaccagcaagtacaccctgctgccctggaacctgctgaagaccaagcccctgccccccagccacggcaaggagggcggcaaggaggccaaggtgcccagcggcgacaacagcggcagaggcgaggtgcccagagcccaggagggccaggccgcctgcggcagagccgccagcggcgacagccaggagggcatgagaagaggctacgaggagagagccaccgcccagagacccgccgtgagaagcgccgagaccaccgcccacggcacctggatctacccctag

SEQ ID NO: 3709 - DNA, 213 bp, Artificial Sequence
  Description of Artificial Sequence: Synthetic coding sequence
atgagcaacaacatggccaagatcgccgaggccagaaagaccgtggagcagctgaagctggaggtgaacatcgacagaatgaaggtgagccaggccgccgccgagctgctggccttctgcgagacccacgccaaggacgaccccctggtgacccccgtgcccgccgccgagaaccccttcagagacaagagactgttctgcgtgctgctgtag

SEQ ID NO: 3710 - DNA, 645 bp, Artificial Sequence
  Description of Artificial Sequence: Synthetic coding sequence
atggccctgctgctgtgcctggtgtgcctgaccgccgccctggcccacggctgcctgcactgccacagcaacttcagcaagaagttcagcttctacagacaccacgtgaacttcaagagctggtgggtgggcgacatccccgtgagcggcgccctgctgaccgactggagcgacgacaccatgaaggagctgcacctggccatccccgccaagatcaccagagagaagctggaccaggtggccaccgccgtgtaccagatgatggaccagctgtaccagggcaagatgtacttccccggctacttccccaacgagctgagaaacatcttcagagagcaggtgcacctgatccagaacgccatcatcgagagcagaatcgactgccagcacagatgcggcatcttccagtacgagaccatcagctgcaacaactgcaccgacagccacgtggcctgcttcggctacaactgcgagagcagcgcccagtggaagagcgccgtgcagggcctgctgaactacatcaacaactggcacaagcaggacaccagcatgagcctggtgagccccgccctgagatgcctggagcccccccacctggccaacctgaccctggaggacgccgccgagtgcctgaagcagcactag

SEQ ID NO: 3711 - DNA, 459 bp, Artificial Sequence
  Description of Artificial Sequence: Synthetic coding sequence
atgagcccccacctgaccgccctgctgggcctggtgctgtgcctggcccagaccatccacacccaggagggcgccctgcccagacccagcatcagcgccgagcccggcaccgtgatcagccccggcagccacgtgaccttcatgtgcagaggccccgtgggcgtgcagaccttcagactggagagagaggacagagccaagtacaaggacagctacaacgtgttcagactgggccccagcgagagcgaggccagattccacatcgacagcgtgagcgagggcaacgccggcctgtacagatgcctgtactacaagccccccggctggagcgagcacagcgacttcctggagctgctggtgaaggagagcagcggcggccccgacagccccgacaccgagcccggcagcagcgccggcaccgtgcccggcaccgaggccagcggcttcgacgccccctag

SEQ ID NO: 3712 - DNA, 900 bp, Artificial Sequence
  Description of Artificial Sequence: Synthetic coding sequence
atggccccctggagccaccccagcgcccagctgcagcccgtgggcggcgacgccgtgagccccgccctgatggtgctgctgtgcctgggcctgagcctgggccccagaacccacgtgcaggccggcaacctgagcaaggccaccctgtgggccgagcccggcagcgtgatcagcagaggcaacagcgtgaccatcagatgccagggcaccctggaggcccaggagtacagactggtgaaggagggcagccccgagccctgggacacccagaaccccctggagcccaagaacaaggccagattcagcatccccagcatgaccgagcaccacgccggcagatacagatgctactactacagccccgccggctggagcgagcccagcgaccccctggagctggtggtgaccggcttctacaacaagcccaccctgagcgccctgcccagccccgtggtgaccagcggcgagaacgtgaccctgcagtgcggcagcagactgagattcgacagattcatcctgaccgaggagggcgaccacaagctgagctggaccctggacagccagctgacccccagcggccagttccaggccctgttccccgtgggccccgtgacccccagccacagatggatgctgagatgctacggcagcagaagacacatcctgcaggtgtggagcgagcccagcgacctgctggagatccccgtgagcggcgccgccgacaacctgagccccagccagaacaagagcgacagcggcaccgccagccacctgcaggactacgccgtggagaacctgatcagaatgggcatggccggcctgatcctggtggtgctgggcatcctgatcttccaggactggcacagccagagaagcccccaggccgccgccggcagatag

SEQ ID NO: 3713 - DNA, 618 bp, Artificial Sequence
  Description of Artificial Sequence: Synthetic coding sequence
atgaaggtgctgctgctgaccggcctgggcgccctgttcttcgcctactactgggacgacaacttcgaccccggcggcctggactacctggtgctgaaccacatcggcggcgcccccgccggcaccagagccagaagcccccaggccaccagatggctgatgcaggtgaacttcgtgagctacgtgcagctgaccagcagagccctgcccagcctgaccgacagcaagggcagcctggtggtggtgagcagcctgctgggcagagtgcccaccagcttcagcaccccctacagcgccgccaagttcgccctggacggcttcttcggcagcctgagaagagagctggacgtgcaggacgtgaacgtggccatcaccatgtgcgtgctgggcctgagagacagagccagcgccgccgaggccgtgagaggcgtgaccagagtgaaggccgcccccggccccaaggccgccctggccgtgatcagaggcggcgccaccagagccgccggcgtgttctacccctggagattcagactgctgtgcctgctgagaagatggctgcccagacccagagcctggttcatcagacaggagctgaacgtgaccgccgccgccgcctag

SEQ ID NO: 3714 - DNA, 795 bp, Artificial Sequence
  Description of Artificial Sequence: Synthetic coding sequence
atgctgagatgcggcggcagaggcctgctgctgggcctggccgtggccgccgccgccgtgatggccgccagactgatgggctggtggggccccagagccggcttcagactgttcatccccgaggagctgagcagatacagaggcggccccggcgaccccggcctgtacctggccctgctgggcagagtgtacgacgtgagcagcggcagaagacactacgagcccggcagccactacagcggcttcgccggcagagacgccagcagagccttcgtgaccggcgactgcagcgaggccggcctggtggacgacgtgagcgacctgagcgccgccgagatgctgaccctgcacaactggctgagcttctacgagaagaactacgtgtgcgtgggcagagtgaccggcagattctacggcgaggacggcctgcccacccccgccctgacccaggtggaggccgccatcaccagaggcctggaggccaacaagctgcagctgcaggagaagcagaccttccccccctgcaacgccgagtggagcagcgccagaggcagcagactgtggtgcagccagaagagcggcggcgtgagcagagactggatcggcgtgcccagaaagctgtacaagcccggcgccaaggagcccagatgcgtgtgcgtgagaaccaccggcccccccagcggccagatgcccgacaaccccccccacagaaacagaggcgacctggaccaccccaacctggccgagtacaccggctgcccccccctggccatcacctgcagcttccccctgtag

SEQ ID NO: 3715 - DNA, 468 bp, Artificial Sequence
  Description of Artificial Sequence: Synthetic coding sequence
atgagcaagagactgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggacagcagcagcagcaaggcccccccccccagcctgcccagccccagcagactgcccggcccctag

SEQ ID NO: 3716 - DNA, 498 bp, Artificial Sequence
  Description of Artificial Sequence: Synthetic coding sequence
atggagatgttccagggcctgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggacagcagcagcagcaaggcccccccccccagcctgcccagccccagcagactgcccggccccagcgacacccccatcctgccccagtag

SEQ ID NO: 3717 - DNA, 990 bp, Artificial Sequence
  Description of Artificial Sequence: Synthetic coding sequence
atgctgcccctgctgctgggcctgctgggccccgccgcctgctgggccctgggccccacccccggccccggcagcagcgagctgagaagcgccttcagcgccgccagaaccacccccctggagggcaccagcgagatggccgtgaccttcgacaaggtgtacgtgaacatcggcggcgacttcgacgtggccaccggccagttcagatgcagagtgcccggcgcctacttcttcagcttcaccgccggcaaggccccccacaagagcctgagcgtgatgctggtgagaaacagagacgaggtgcaggccctggccttcgacgagcagagaagacccggcgccagaagagccgccagccagagcgccatgctgcagctggactacggcgacaccgtgtggctgagactgcacggcgccccccagtacgccctgggcgcccccggcgccaccttcagcggctacctggtgtacgccgacgccgacgccgacgcccccgccagaggcccccccgccccccccgagcccagaagcgccttcagcgccgccagaaccagaagcctggtgggcagcgacgccggccccggccccagacaccagcccctggccttcgacaccgagttcgtgaacatcggcggcgacttcgacgccgccgccggcgtgttcagatgcagactgcccggcgcctacttcttcagcttcaccctgggcaagctgcccagaaagaccctgagcgtgaagctgatgaagaacagagacgaggtgcaggccatgatctacgacgacggcgccagcagaagaagagagatgcagagccagagcgtgatgctggccctgagaagaggcgacgccgtgtggctgctgagccacgaccacgacggctacggcgcctacagcaaccacggcaagtacatcaccttcagcggcttcctggtgtaccccgacctggcccccgccgccccccccggcctgggcgccagcgagctgctgtag

SEQ ID NO: 3718 - DNA, 873 bp, Artificial Sequence
  Description of Artificial Sequence: Synthetic coding sequence
atgagaagacccgccgccgtgcccctgctgctgctgctgtgcttcggcagccagagagccaaggccgccaccgcctgcggcagacccagaatgctgaacagaatggtgggcggccaggacacccaggagggcgagtggccctggcaggtgagcatccagagaaacggcagccacttctgcggcggcagcctgatcgccgagcagtgggtgctgaccgccgcccactgcttcagaaacaccagcgagaccagcctgtaccaggtgctgctgggcgccagacagctggtgcagcccggcccccacgccatgtacgccagagtgagacaggtggagagcaaccccctgtaccagggcaccgccagcagcgccgacgtggccctggtggagctggaggcccccgtgcccttcaccaactacatcctgcccgtgtgcctgcccgaccccagcgtgatcttcgagaccggcatgaactgctgggtgaccggctggggcagccccagcgaggaggacctgctgcccgagcccagaatcctgcagaagctggccgtgcccatcatcgacacccccaagtgcaacctgctgtacagcaaggacaccgagttcggctaccagcccaagaccatcaagaacgacatgctgtgcgccggcttcgaggagggcaagaaggacgcctgcaagggcgacagcggcggccccctggtgtgcctggtgggccagagctggctgcaggccggcgtgatcagctggggcgagggctgcgccagacagaacagacccggcgtgtacatcagagtgaccgcccaccacaactggatccacagaatcatccccaagctgcagttccagcccgccagactgggcggccagaagtag

SEQ ID NO: 3719 - DNA, 792 bp, Artificial Sequence
  Description of Artificial Sequence: Synthetic coding sequence
atggccttcctgtggctgctgagctgctgggccctgctgggcaccaccttcggctgcggcgtgcccgccatccaccccgtgctgagcggcctgagcagaatcgtgaacggcgaggacgccgtgcccggcagctggccctggcaggtgagcctgcaggacaagaccggcttccacttctgcggcggcagcctgatcagcgaggactgggtggtgaccgccgcccactgcggcgtgagaaccagcgacgtggtggtggccggcgagttcgaccagggcagcgacgaggagaacatccaggtgctgaagatcgccaaggtgttcaagaaccccaagttcagcatcctgaccgtgaacaacgacatcaccctgctgaagctggccacccccgccagattcagccagaccgtgagcgccgtgtgcctgcccagcgccgacgacgacttccccgccggcaccctgtgcgccaccaccggctggggcaagaccaagtacaacgccaacaagacccccgacaagctgcagcaggccgccctgcccctgctgagcaacgccgagtgcaagaagagctggggcagaagaatcaccgacgtgatgatctgcgccggcgccagcggcgtgagcagctgcatgggcgacagcggcggccccctggtgtgccagaaggacggcgcctggaccctggtgggcatcgtgagctggggcagcagaacctgcagcaccaccacccccgccgtgtacgccagagtggccaagctgatcccctgggtgcagaagatcctggccgccaactag

SEQ ID NO: 3720 - DNA, 228 bp, Artificial Sequence
  Description of Artificial Sequence: Synthetic coding sequence
atgggcgccgccatcagccagggcgccctgatcgccatcgtgtgcaacggcctggtgggcttcctgctgctgctgctgtgggtgatcctgtgctgggcctgccacagcagaagcgccgacgtggacagcctgagcgagagcagaacccaggagagcgcctgcctggagctggaccccgccgcccagagcctggccagcctggcccccatcggcgcccagtggccctag

SEQ ID NO: 3721 - DNA, 762 bp, Artificial Sequence
  Description of Artificial Sequence: Synthetic coding sequence
atggccagaagcctgctgctgcccctgcagatcctgctgctgagcctggccctggagaccgccggcgaggaggcccagggcgacaagatcatcgacggcgccccctgcgccagaggcagccacccctggcaggtggccctgctgagcggcaaccagctgcactgcggcggcgtgctggtgaacgagagatgggtgctgaccgccgcccactgcaagatgaacgagtacaccgtgcacctgggcagcgacaccctgggcgacagaagagcccagagaatcaaggccagcaagagcttcagacaccccggctacagcacccagacccacgtgaacgacctgatgctggtgaagctgaacagccaggccagactgagcagcatggtgaagaaggtgagactgcccagcagatgcgagccccccggcaccacctgcaccgtgagcggctggggcaccaccaccagccccgacgtgaccttccccagcgacctgatgtgcgtggacgtgaagctgatcagcccccaggactgcaccaaggtgtacaaggacctgctggagaacagcatgctgtgcgccggcatccccgacagcaagaagaacgcctgcaacggcgacagcggcggccccctggtgtgcagaggcaccctgcagggcctggtgagctggggcaccttcccctgcggccagcccaacgaccccggcgtgtacacccaggtgtgcaagttcaccaagtggatcaacgacaccatgaagaagcacagatag

SEQ ID NO: 3722 - DNA, 480 bp, Artificial Sequence
  Description of Artificial Sequence: Synthetic coding sequence
atgaaggcctggggcaccgtggtggtgaccctggccaccctgatggtggtgaccgtggacgccaagatctacgagagatgcgagctggccgccagactggagagagccggcctgaacggctacaagggctacggcgtgggcgactggctgtgcatggcccactacgagagcggcttcgacaccgccttcgtggaccacaaccccgacggcagcagcgagtacggcatcttccagctgaacagcgcctggtggtgcgacaacggcatcacccccaccaagaacctgtgccacatggactgccacgacctgctgaacagacacatcctggacgacatcagatgcgccaagcagatcgtgagcagccagaacggcctgagcgcctggaccagctggagactgcactgcagcggccacgacctgagcgagtggctgaagggctgcgacatgcacgtgaagatcgaccccaagatccacccctag

SEQ ID NO: 3723 - DNA, 501 bp, Artificial Sequence
  Description of Artificial Sequence: Synthetic coding sequence
atggcccagaccaacagcttcttcatgctgatcagcagcctgatgttcctgagcctgagccagggccaggagagccagaccgagctgcccaaccccagaatcagctgccccgagggcaccaacgcctacagaagctactgctactacttcaacgaggaccccgagacctgggtggacgccgacctgtactgccagaacatgaacagcggcaacctggtgagcgtgctgacccaggccgagggcgccttcgtggccagcctgatcaaggagagcagcaccgacgacagcaacgtgtggatcggcctgcacgaccccaagaagaacagaagatggcactggagcagcggcagcctggtgagctacaagagctgggacaccggcagccccagcagcgccaacgccggctactgcgccagcctgaccagctgcagcggcttcaagaagtggaaggacgagagctgcgagaagaagttcagcttcgtgtgcaagttcaagaactag

SEQ ID NO: 3724 - DNA, 528 bp, Artificial Sequence
  Description of Artificial Sequence: Synthetic coding sequence
atgctgccccccatggccctgcccagcgtgagctggatgctgctgagctgcctgatgctgctgagccaggtgcagggcgaggagccccagagagagctgcccagcgccagaatcagatgccccaagggcagcaaggcctacggcagccactgctacgccctgttcctgagccccaagagctggaccgacgccgacctggcctgccagaagagacccagcggcaacctggtgagcgtgctgagcggcgccgagggcagcttcgtgagcagcctggtgaagagcatcggcaacagctacagctacgtgtggatcggcctgcacgaccccacccagggcaccgagcccaacggcgagggctgggagtggagcagcagcgacgtgatgaactacttcgcctgggagagaaaccccagcaccatcagcagccccggccactgcgccagcctgagcagaagcaccgccttcctgagatggaaggactacaactgcaacgtgagactgccctacgtgtgcaagttcaccgactag

SEQ ID NO: 3725 - DNA, 1686 bp, Artificial Sequence
  Description of Artificial Sequence: Synthetic coding sequence
atgggcgccagaacccccctgcccagcttctgggtgagcttcttcgccgagaccggcatcctgttccccggcggcaccccctggcccatgggcagccagcacagcaagcagcacagaaagcccggccccctgaagagaggccacagaagagacagaagaaccaccagaagaaagtactggaaggagggcagagagatcgccagagtgctggacgacgagggcagaaacctgagacagcagaagctggacagacagagagccctgctggagcagaagcagaagaagaagagacaggagcccctgatggtgcaggccaacgccgacggcagacccagaagcagaagagccagacagagcgaggagcaggcccccctggtggagagctacctgagcagcagcggcagcaccagctaccaggtgcaggaggccgacagcctggccagcgtgcagctgggcgccaccagacccaccgcccccgccagcgccaagagaaccaaggccgccgccaccgccggcggccagggcggcgccgccagaaaggagaagaagggcaagcacaagggcaccagcggccccgccgccctggccgaggacaagagcgaggcccagggccccgtgcagatcctgaccgtgggccagagcgaccacgcccaggacgccggcgagaccgccgccggcggcggcgagagacccagcggccaggacctgagagccaccatgcagagaaagggcatcagcagcagcatgagcttcgacgaggacgaggaggacgaggaggagaacagcagcagcagcagccagctgaacagcaacaccagacccagcagcgccaccagcagaaagagcgtgagagaggccgccagcgcccccagccccaccgcccccgagcagcccgtggacgtggaggtgcaggacctggaggagttcgccctgagacccgccccccagggcatcaccatcaagtgcagaatcaccagagacaagaagggcatggacagaggcatgtaccccacctacttcctgcacctggacagagaggacggcaagaaggtgttcctgctggccggcagaaagagaaagaagagcaagaccagcaactacctgatcagcgtggaccccaccgacctgagcagaggcggcgacagctacatcggcaagctgagaagcaacctgatgggcaccaagttcaccgtgtacgacaacggcgtgaacccccagaaggccagcagcagcaccctggagagcggcaccctgagacaggagctggccgccgtgtgctacgagaccaacgtgctgggcttcaagggccccagaaagatgagcgtgatcgtgcccggcatgaacatggtgcacgagagagtgagcatcagacccagaaacgagcacgagaccctgctggccagatggcagaacaagaacaccgagagcatcatcgagctgcagaacaagacccccgtgtggaacgacgacacccagagctacgtgctgaacttccacggcagagtgacccaggccagcgtgaagaacttccagatcatccacggcaacgaccccgactacatcgtgatgcagttcggcagagtggccgaggacgtgttcaccatggactacaactaccccctgtgcgccctgcaggccttcgccatcgccctgagcagcttcgacagcaagctggcctgcgagtag

SEQ ID NO: 3726 - DNA, 1272 bp, Artificial Sequence
  Description of Artificial Sequence: Synthetic coding sequence
atgatgtacagacccgacgtggtgagagccagaaagagagtgtgctgggagccctgggtgatcggcctggtgatcttcatcagcctgatcgtgctggccgtgtgcatcggcctgaccgtgcactacgtgagatacaaccagaagaagacctacaactactacagcaccctgagcttcaccaccgacaagctgtacgccgagttcggcagagaggccagcaacaacttcaccgagatgagccagagactggagagcatggtgaagaacgccttctacaagagccccctgagagaggagttcgtgaagagccaggtgatcaagttcagccagcagaagcacggcgtgctggcccacatgctgctgatctgcagattccacagcaccgaggaccccgagaccgtggacaagatcgtgcagctggtgctgcacgagaagctgcaggacgccgtgggcccccccaaggtggacccccacagcgtgaagatcaagaagatcaacaagaccgagaccgacagctacctgaaccactgctgcggcaccagaagaagcaagaccctgggccagagcctgagaatcgtgggcggcaccgaggtggaggagggcgagtggccctggcaggccagcctgcagtgggacggcagccacagatgcggcgccaccctgatcaacgccacctggctggtgagcgccgcccactgcttcaccacctacaagaaccccgccagatggaccgccagcttcggcgtgaccatcaagcccagcaagatgaagagaggcctgagaagaatcatcgtgcacgagaagtacaagcaccccagccacgactacgacatcagcctggccgagctgagcagccccgtgccctacaccaacgccgtgcacagagtgtgcctgcccgacgccagctacgagttccagcccggcgacgtgatgttcgtgaccggcttcggcgccctgaagaacgacggctacagccagaaccacctgagacaggcccaggtgaccctgatcgacgccaccacctgcaacgagccccaggcctacaacgacgccatcacccccagaatgctgtgcgccggcagcctggagggcaagaccgacgcctgccagggcgacagcggcggccccctggtgagcagcgacgccagagacatctggtacctggccggcatcgtgagctggggcgacgagtgcgccaagcccaacaagcccggcgtgtacaccagagtgaccgccctgagagactggatcaccagcaagaccggcatctag

SEQ ID NO: 3727 - DNA, 282 bp, Artificial Sequence
  Description of Artificial Sequence: Synthetic coding sequence
atgaagcccgtgctgcccctgcagttcctggtggtgttctgcctggccctgcagctggtgcccggcagccccaagcagagagtgctgaagtacatcctggagccccccccctgcatcagcgcccccgagaactgcacccacctgtgcaccatgcaggaggactgcgagaagggcttccagtgctgcagcagcttctgcggcatcgtgtgcagcagcgagaccttccagaagagaaacagaatcaagcacaagggcagcgaggtgatcatgcccgccaactag

SEQ ID NO: 3728 - DNA, 1530 bp, Artificial Sequence
  Description of Artificial Sequence: Synthetic coding sequence
atggacttcctgctggccctggtgctggtgagcagcctgtacctgcaggccgccgccgagttcgacggcagatggcccagacagatcgtgagcagcatcggcctgtgcagatacggcggcagaatcgactgctgctggggctgggccagacagagctggggccagtgccagcccgtgtgccagcccagatgcaagcacggcgagtgcatcggccccaacaagtgcaagtgccaccccggctacgccggcaagacctgcaaccaggacctgaacgagtgcggcctgaagcccagaccctgcaagcacagatgcatgaacacctacggcagctacaagtgctactgcctgaacggctacatgctgatgcccgacggcagctgcagcagcgccctgacctgcagcatggccaactgccagtacggctgcgacgtggtgaagggccagatcagatgccagtgccccagccccggcctgcagctggcccccgacggcagaacctgcgtggacgtggacgagtgcgccaccggcagagccagctgccccagattcagacagtgcgtgaacaccttcggcagctacatctgcaagtgccacaagggcttcgacctgatgtacatcggcggcaagtaccagtgccacgacatcgacgagtgcagcctgggccagtaccagtgcagcagcttcgccagatgctacaacatcagaggcagctacaagtgcaagtgcaaggagggctaccagggcgacggcctgacctgcgtgtacatccccaaggtgatgatcgagcccagcggccccatccacgtgcccaagggcaacggcaccatcctgaagggcgacaccggcaacaacaactggatccccgacgtgggcagcacctggtggccccccaagaccccctacatcccccccatcatcaccaacagacccaccagcaagcccaccaccagacccacccccaagcccacccccatccccaccccccccccccccccccccctgcccaccgagctgagaacccccctgccccccaccacccccgagagacccaccaccggcctgaccaccatcgcccccgccgccagcaccccccccggcggcatcaccgtggacaacagagtgcagaccgacccccagaagcccagaggcgacgtgttcagcgtgctggtgcacagctgcaacttcgaccacggcctgtgcggctggatcagagagaaggacaacgacctgcactgggagcccatcagagaccccgccggcggccagtacctgaccgtgagcgccgccaaggcccccggcggcaaggccgccagactggtgctgcccctgggcagactgatgcacagcggcgacctgtgcctgagcttcagacacaaggtgaccggcctgcacagcggcaccctgcaggtgttcgtgagaaagcacggcgcccacggcgccgccctgtggggcagaaacggcggccacggctggagacagacccagatcaccctgagaggcgccgacatcaagagcgagagccagagatag

SEQ ID NO: 3729 - DNA, 381 bp, Artificial Sequence
  Description of Artificial Sequence: Synthetic coding sequence
atggacaagagcctgctgctggagctgcccatcctgctgtgctgcttcagagccctgagcggcagcctgagcatgagaaacgacgccgtgaacgagatcgtggccgtgaagaacaacttccccgtgatcgagatcgtgcagtgcagaatgtgccacctgcagttccccggcgagaagtgcagcagaggcagaggcatctgcaccgccaccaccgaggaggcctgcatggtgggcagaatgttcaagagagacggcaacccctggctgaccttcatgggctgcctgaagaactgcgccgacgtgaagggcatcagatggagcgtgtacctggtgaacttcagatgctgcagaagccacgacctgtgcaacgaggacctgtag

SEQ ID NO: 3730 - DNA, 537 bp, Artificial Sequence
  Description of Artificial Sequence: Synthetic coding sequence
atggagctgctgcaggtgaccatcctgttcctgctgcccagcatctgcagcagcaacagcaccggcgtgctggaggccgccaacaacagcctggtggtgaccaccaccaagcccagcatcaccacccccaacaccgagagcctgcagaagaacgtggtgacccccaccaccggcaccacccccaagggcaccatcaccaacgagctgctgaagatgagcctgatgagcaccgccaccttcctgaccagcaaggacgagggcctgaaggccaccaccaccgacgtgagaaagaacgacagcatcatcagcaacgtgaccgtgaccagcgtgaccctgcccaacgccgtgagcaccctgcagagcagcaagcccaagaccgagacccagagcagcatcaagaccaccgagatccccggcacccccgagaacggcaacgaccagccccagagcgacaaggagagcgtgaagctgctgaccgtgaagaccatcagccacgagagcggcgagcacagcgcccagggcaagaccaagaactag

SEQ ID NO: 3731 - DNA, 2544 bp, Artificial Sequence
  Description of Artificial Sequence: Synthetic coding sequence
atgttcaagtgctggagcgtggtgctggtgctgggcttcatcttcctggagagcgagggcagacccaccaaggagggcggctacggcctgaagagctaccagcccctgatgagactgagacacaagcaggagaagaaccaggagagcagcagagtgaagggcttcatgatccaggacggccccttcggcagctgcgagaacaagtactgcggcctgggcagacactgcgtgaccagcagagagaccggccaggccgagtgcgcctgcatggacctgtgcaagagacactacaagcccgtgtgcggcagcgacggcgagttctacgagaaccactgcgaggtgcacagagccgcctgcctgaagaagcagaagatcaccatcgtgcacaacgaggactgcttcttcaagggcgacaagtgcaagaccaccgagtacagcaagatgaagaacatgctgctggacctgcagaaccagaagtacatcatgcaggagaacgagaaccccaacggcgacgacatcagcagaaagaagctgctggtggaccagatgttcaagtacttcgacgccgacagcaacggcctggtggacatcaacgagctgacccaggtgatcaagcaggaggagctgggcaaggacctgttcgactgcaccctgtacgtgctgctgaagtacgacgacttcaacgccgacaagcacctggccctggaggagttctacagagccttccaggtgatccagctgagcctgcccgaggaccagaagctgagcatcaccgccgccaccgtgggccagagcgccgtgctgagctgcgccatccagggcaccctgagaccccccatcatctggaagagaaacaacatcatcctgaacaacctggacctggaggacatcaacgacttcggcgacgacggcagcctgtacatcaccaaggtgaccaccacccacgtgggcaactacacctgctacgccgacggctacgagcaggtgtaccagacccacatcttccaggtgaacgtgccccccgtgatcagagtgtaccccgagagccaggccagagagcccggcgtgaccgccagcctgagatgccacgccgagggcatccccaagccccagctgggctggctgaagaacggcatcgacatcacccccaagctgagcaagcagctgaccctgcaggccaacggcagcgaggtgcacatcagcaacgtgagatacgaggacaccggcgcctacacctgcatcgccaagaacgaggccggcgtggacgaggacatcagcagcctgttcgtggaggacagcgccagaaagaccctggccaacatcctgtggagagaggagggcctgggcatcggcaacatgttctacgtgttctacgaggacggcatcaaggtgatccagcccatcgagtgcgagttccagagacacatcaagcccagcgagaagctgctgggcttccaggacgaggtgtgccccaaggccgagggcgacgaggtgcagagatgcgtgtgggccagcgccgtgaacgtgaaggacaagttcatctacgtggcccagcccaccctggacagagtgctgatcgtggacgtgcagagccagaaggtggtgcaggccgtgagcaccgaccccgtgcccgtgaagctgcactacgacaagagccacgaccaggtgtgggtgctgagctggggcaccctggagaagaccagccccaccctgcaggtgatcaccctggccagcggcaacgtgccccaccacaccatccacacccagcccgtgggcaagcagttcgacagagtggacgacttcttcatccccaccaccaccctgatcatcacccacatgagattcggcttcatcctgcacaaggacgaggccgccctgcagaagatcgacctggagaccatgagctacatcaagaccatcaacctgaaggactacaagtgcgtgccccagagcctggcctacacccacctgggcggctactacttcatcggctgcaagcccgacagcaccggcgccgtgagcccccaggtgatggtggacggcgtgaccgacagcgtgatcggcttcaacagcgacgtgaccggcaccccctacgtgagccccgacggccactacctggtgagcatcaacgacgtgaagggcctggtgagagtgcagtacatcaccatcagaggcgagatccaggaggccttcgacatctacaccaacctgcacatcagcgacctggccttccagcccagcttcaccgaggcccaccagtacaacatctacggcagcagcagcacccagaccgacgtgctgttcgtggagctgagcagcggcaaggtgaagatgatcaagagcctgaaggagcccctgaaggccgaggagtggccctggaacagaaagaacagacagatccaggacagcggcctgttcggccagtacctgatgacccccagcaaggacagcctgttcatcctggacggcagactgaacaagctgaactgcgagatcaccgaggtggagaagggcaacaccgtgatctgggtgggcgacgcctag

SEQ ID NO: 3732 - DNA, 273 bp, Artificial Sequence
  Description of Artificial Sequence: Synthetic coding sequence
atgagactgagcgtgtgcctgctgctgctgaccctggccctgtgctgctacagagccaacgccgtggtgtgccaggccctgggcagcgagatcaccggcttcctgctggccggcaagcccgtgttcaagttccagctggccaagttcaaggcccccctggaggccgtggccgccaagatggaggtgaagaagtgcgtggacaccatggcctacgagaagagagtgctgatcaccaagaccctgggcaagatcgccgagaagtgcgacagatag

SEQ ID NO: 3733 - DNA, 1044 bp, Artificial Sequence
  Description of Artificial Sequence: Synthetic coding sequence
atgagcagctggagcagacagagacccaagagccccggcggcatccagccccacgtgagcagaaccctgttcctgctgctgctgctggccgccagcgcctggggcgtgaccctgagccccaaggactgccaggtgttcagaagcgaccacggcagcagcatcagctgccagccccccgccgagatccccggctacctgcccgccgacaccgtgcacctggccgtggagttcttcaacctgacccacctgcccgccaacctgctgcagggcgccagcaagctgcaggagctgcacctgagcagcaacggcctggagagcctgagccccgagttcctgagacccgtgccccagctgagagtgctggacctgaccagaaacgccctgaccggcctgccccccggcctgttccaggccagcgccaccctggacaccctggtgctgaaggagaaccagctggaggtgctggaggtgagctggctgcacggcctgaaggccctgggccacctggacctgagcggcaacagactgagaaagctgccccccggcctgctggccaacttcaccctgctgagaaccctggacctgggcgagaaccagctggagaccctgccccccgacctgctgagaggccccctgcagctggagagactgcacctggagggcaacaagctgcaggtgctgggcaaggacctgctgctgccccagcccgacctgagatacctgttcctgaacggcaacaagctggccagagtggccgccggcgccttccagggcctgagacagctggacatgctggacctgagcaacaacagcctggccagcgtgcccgagggcctgtgggccagcctgggccagcccaactgggacatgagagacggcttcgacatcagcggcaacccctggatctgcgaccagaacctgagcgacctgtacagatggctgcaggcccagaaggacaagatgttcagccagaacgacaccagatgcgccggccccgaggccgtgaagggccagaccctgctggccgtggccaagagccagtag

SEQ ID NO: 3734 - DNA, 1407 bp, Artificial Sequence
  Description of Artificial Sequence: Synthetic coding sequence
atgcccccctggggcgccgccctggccctgatcctggccgtgctggccctgctgggcctgctgggccccagactgagaggcccctggggcagagccgtgggcgagagaaccctgcccggcgcccaggacagagacgacggcgaggaggccgacggcggcggccccgccgaccagttcagcgacggcagagagcccctgcccggcggctgcagcctggtgtgcaagcccagcgccctggcccagtgcctgctgagagccctgagaagaagcgaggccctggaggccggccccagaagctggttcagcggcccccacctgcagaccctgtgccacttcgtgctgcccgtggcccccggccccgagctggccagagagtacctgcagctggccgacgacggcctggtggccctggactgggtggtgggcccctgcgtgagaggcagaagaatcaccagcgccggcggcctgcccgccgtgctgctggtgatccccaacgcctggggcagactgaccagaaacgtgctgggcctgtgcctgctggccctggagagaggctactaccccgtgatcttccacagaagaggccaccacggctgccccctggtgagccccagactgcagcccttcggcgaccccagcgacctgaaggaggccgtgacctacatcagattcagacaccccgccgcccccctgttcgccgtgagcgagggcagcggcagcgccctgctgctgagctacctgggcgagtgcggcagcagcagctacgtgaccggcgccgcctgcatcagccccgtgctgagatgcagagagtggttcgaggccggcctgccctggccctacgagagaggcttcctgctgcaccagaagatcgccctgagcagatacgccaccgccctggaggacaccgtggacaccagcagactgttcagaagcagaagcctgagagagttcgaggaggccctgttctgccacaccaagagcttccccatcagctgggacacctactgggacagaaacgaccccctgagagacgtggacgaggccgccgtgcccgtgctgtgcatctgcagcgccgacgaccccgtgtgcggcccccccgaccacaccctgaccaccgagctgttccacagcaacccctacttcttcctgctgctgagcagacacggcggccactgcggcttcctgagacaggagcccctgcccgcctggagccacgaggtgatcctggagagcttcagagccctgaccgagttcttcagaaccgaggagagaatcaagggcctgagcagacacagagccagcttcctgggcggcagaagaagaggcggcgccctgcagagaagagaggtgagcagcagcagcaacctggaggagatcttcaactggaagagaagctacaccagatag

SEQ ID NO: 3735 - DNA, 423 bp, Artificial Sequence
  Description of Artificial Sequence: Synthetic coding sequence
atgttcttcaccatcagcagaaagaacatgagccagaagctgagcctgctgctgctggtgttcggcctgatctggggcctgatgctgctgcactacaccttccagcagcccagacaccagagcagcgtgaagctgagagagcagatcctggacctgagcaagagatacgtgaaggccctggccgaggagaacaagaacaccgtggacgtggagaacggcgccagcatggccggctacgccgacctgaagagaaccatcgccgtgctgctggacgacatcctgcagagactggtgaagctggagaacaaggtggactacatcgtggtgaacggcagcgccgccaacaccaccaacggcaccagcggcaacctggtgcccgtgaccaccaacaagagaaccaacgtgagcggcagcatcagatag

SEQ ID NO: 3736 - DNA, 993 bp, Artificial Sequence
  Description of Artificial Sequence: Synthetic coding sequence
agaggcgccctggtgggcgcccccagaagcgccagagccagctgcctgagaggcagaagacccggcagaagacagccctgcggcagatgccccgacccccccagaagcggccccggccaggccggcagagccagatgcgccagagacgtggccgcccagaccgccctggcccccagagccctggccctgggcgccggcgccgccggccccggctggagaggcgccgtgcccagaagacccgccgccagagtgagcagagccgcccagagacaggagcaggagctggtgagactgcacagagagcaggagtgcgagctgcagcccgagcccgccccccccagacccagcggccccgccaccgccgaggaccccggcagaagacccgtgctgccccagagaccccccgaggagagacccccccagccccccggcagcaccggcgtgatcgccgagaccggccaggccggcccccccgccggcgccggcgtgagcggctaccccaagagcccccccgtggccagccccggcgcccccgtgcccagcctggtgagcttcagcgccggcctgacccagaagcccttccccagcgacggcggcgtggtgctgttcaacaaggtgctggtgaacgacggcgacgtgtacaaccccagcaccggcgtgttcaccgccccctacgacggcagatacctgatcaccgccaccctgacccccgagagagacgcctacgtggaggccgtgctgagcgtgagcaacgccagcgtggcccagctgcacaccgccggctacagaagagagttcctggagtaccacagaccccccggcgccctgcacacctgcggcggccccggcgccttccacctgatcgtgcacctgaaggccggcgacgccgtgaacgtggtggtgaccggcggcaagctggcccacaccgacttcgacgagatgtacagcaccttcagcggcgtgttcctgtaccccttcctgagccacctgtag

SEQ ID NO: 3737 - DNA, 585 bp, Artificial Sequence
  Description of Artificial Sequence: Synthetic coding sequence
atgagcgccctgtggctgctgctgggcctgctggccctgatggacctgagcgagagcagcaactggggctgctacggcaacatccagagcctggacacccccggcgccagctgcggcatcggcagaagacacggcctgaactactgcggcgtgagagccagcgagagactggccgagatcgacatgccctacctgctgaagtaccagcccatgatgcagaccatcggccagaagtactgcatggaccccgccgtgatcgccggcgtgctgagcagaaagagccccggcgacaagatcctggtgaacatgggcgacagaaccagcatggtgcaggaccccggcagccaggcccccaccagctggatcagcgagagccaggtgagccagaccaccgaggtgctgaccaccagaatcaaggagatccagagaagattccccacctggacccccgaccagtacctgagaggcggcctgtgcgcctacagcggcggcgccggctacgtgagaagcagccaggacctgagctgcgacttctgcaacgacgtgctggccagagccaagtacctgaagagacacggcttctag

SEQ ID NO: 3738 - DNA, 273 bp, Artificial Sequence
  Description of Artificial Sequence: Synthetic coding sequence
atgaagttcctggccgtgctggtgctgctgggcgtgagcatcttcctggtgagcgcccagaaccccaccaccgccgcccccgccgacacctaccccgccaccggccccgccgacgacgaggcccccgacgccgagaccaccgccgccgccaccaccgccaccaccgccgcccccaccaccgccaccaccgccgccagcaccaccgccagaaaggacatccccgtgctgcccaagtgggtgggcgacctgcccaacggcagagtgtgcccctag

SEQ ID NO: 3739 - DNA, 1914 bp, Artificial Sequence
  Description of Artificial Sequence: Synthetic coding sequence
atgagcagaatgctgcccttcctgctgctgctgtggttcctgcccatcaccgagggcagccagagagccgagcccatgttcaccgccgtgaccaacagcgtgctgccccccgactacgacagcaaccccacccagctgaactacggcgtggccgtgaccgacgtggaccacgacggcgacttcgagatcgtggtggccggctacaacggccccaacctggtgctgaagtacgacagagcccagaagagactggtgaacatcgccgtggacgagagaagcagcccctactacgccctgagagacagacagggcaacgccatcggcgtgaccgcctgcgacatcgacggcgacggcagagaggagatctacttcctgaacaccaacaacgccttcagcggcgtggccacctacaccgacaagctgttcaagttcagaaacaacagatgggaggacatcctgagcgacgaggtgaacgtggccagaggcgtggccagcctgttcgccggcagaagcgtggcctgcgtggacagaaagggcagcggcagatacagcatctacatcgccaactacgcctacggcaacgtgggccccgacgccctgatcgagatggaccccgaggccagcgacctgagcagaggcatcctggccctgagagacgtggccgccgaggccggcgtgagcaagtacaccggcggcagaggcgtgagcgtgggccccatcctgagcagcagcgccagcgacatcttctgcgacaacgagaacggccccaacttcctgttccacaacagaggcgacggcaccttcgtggacgccgccgccagcgccggcgtggacgacccccaccagcacggcagaggcgtggccctggccgacttcaacagagacggcaaggtggacatcgtgtacggcaactggaacggcccccacagactgtacctgcagatgagcacccacggcaaggtgagattcagagacatcgccagccccaagttcagcatgcccagccccgtgagaaccgtgatcaccgccgacttcgacaacgaccaggagctggagatcttcttcaacaacatcgcctacagaagcagcagcgccaacagactgttcagagtgatcagaagagagcacggcgaccccctgatcgaggagctgaaccccggcgacgccctggagcccgagggcagaggcaccggcggcgtggtgaccgacttcgacggcgacggcatgctggacctgatcctgagccacggcgagagcatggcccagcccctgagcgtgttcagaggcaaccagggcttcaacaacaactggctgagagtggtgcccagaaccagattcggcgccttcgccagaggcgccaaggtggtgctgtacaccaagaagagcggcgcccacctgagaatcatcgacggcggcagcggctacctgtgcgagatggagcccgtggcccacttcggcctgggcaaggacgaggccagcagcgtggaggtgacctggcccgacggcaagatggtgagcagaaacgtggccagcggcgagatgaacagcgtgctggagatcctgtaccccagagacgaggacaccctgcaggaccccgcccccctggagtgcggccagggcttcagccagcaggagaacggccactgcatggacaccaacgagtgcatccagttccccttcgtgtgccccagagacaagcccgtgtgcgtgaacacctacggcagctacagatgcagaaccaacaagaagtgcagcagaggctacgagcccaacgaggacggcaccgcctgcgtggcccaggtggccttcctgggcggctacagcagcgccgccagcagaatcagcgagcccctgagcagagccagctacctgagcctgggcctgggcctgtgcctgcagctgtacgccctgtag

SEQ ID NO: 3740 - DNA, 600 bp, Artificial Sequence
  Description of Artificial Sequence: Synthetic coding sequence
atggccctgaacggcgccgaggtggacgacttcagctgggagccccccaccgaggccgagaccaaggtgctgcaggccagaagagagagacaggacagaatcagcagactgatgggcgactacctgctgagaggctacagaatgctgggcgagacctgcgccgactgcggcaccatcctgctgcaggacaagcagagaaagatctactgcgtggcctgccaggagctggacagcgacgtggacaaggacaaccccgccctgaacgcccaggccgccctgagccaggccagagagcaccagctggccagcgccagcgagctgcccctgggcagcagacccgccccccagccccccgtgcccagacccgagcactgcgagggcgccgccgccggcctgaaggccgcccagggcccccccgcccccgccgtgccccccaacaccgacgtgatggcctgcacccagaccgccctgctgcagaagctgacctgggccagcgccgagctgggcagcagcaccagcctggagaccagcatccagctgtgcggcctgatcagagcctgcgccgaggccctgagaagcctgcagcagctgcagcactag

SEQ ID NO: 3741 - DNA, 813 bp, Artificial Sequence
  Description of Artificial Sequence: Synthetic coding sequence
atgaagctgggctgcgtgctgatggcctgggccctgtacctgagcctgggcgtgctgtgggtggcccagatgctgctggccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacgagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 3742 - DNA, 2421 bp, Artificial Sequence
  Description of Artificial Sequence: Synthetic coding sequence
atgagactgagccccgcccccctgaagctgagcagaacccccgccctgctggccctggccctgcccctggccgccgccctggccttcagcgacgagaccctggacaaggtgcccaagagcgagggctactgcagcagaatcctgagagcccagggcaccagaagagagggctacaccgagttcagcctgagagtggagggcgaccccgacttctacaagcccggcaccagctacagagtgaccctgagcgccgccccccccagctacttcagaggcttcaccctgatcgccctgagagagaacagagagggcgacaaggaggaggaccacgccggcaccttccagatcatcgacgaggaggagacccagttcatgagcaactgccccgtggccgtgaccgagagcacccccagaagaagaaccagaatccaggtgttctggatcgccccccccgccggcaccggctgcgtgatcctgaaggccagcatcgtgcagaagagaatcatctacttccaggacgagggcagcctgaccaagaagctgtgcgagcaggacagcaccttcgacggcgtgaccgacaagcccatcctggactgctgctgcggcaccgccaagtacagactgaccttctacggcaactggagcgagaagacccaccccaaggactaccccagaagagccaaccactggagcgccatcatcggcggcagccacagcaagaactacgtgctgtgggagtacggcggctacgccagcgagggcgtgaagcaggtggccgagctgggcagccccgtgaagatggaggaggagatcagacagcagagcgacgaggtgctgaccgtgatcaaggccaaggcccagtggcccgcctggcagcccctgaacgtgagagccgcccccagcgccgagttcagcgtggacagaaccagacacctgatgagcttcctgaccatgatgggccccagccccgactggaacgtgggcctgagcgccgaggacctgtgcaccaaggagtgcggctgggtgcagaaggtggtgcaggacctgatcccctgggacgccggcaccgacagcggcgtgacctacgagagccccaacaagcccaccatcccccaggagaagatcagacccctgaccagcctggaccacccccagagccccttctacgaccccgagggcggcagcatcacccaggtggccagagtggtgatcgagagaatcgccagaaagggcgagcagtgcaacatcgtgcccgacaacgtggacgacatcgtggccgacctggcccccgaggagaaggacgaggacgacacccccgagacctgcatctacagcaactggagcccctggagcgcctgcagcagcagcacctgcgacaagggcaagagaatgagacagagaatgctgaaggcccagctggacctgagcgtgccctgccccgacacccaggacttccagccctgcatgggccccggctgcagcgacgaggacggcagcacctgcaccatgagcgagtggatcacctggagcccctgcagcatcagctgcggcatgggcatgagaagcagagagagatacgtgaagcagttccccgaggacggcagcgtgtgcaccctgcccaccgaggagaccgagaagtgcaccgtgaacgaggagtgcagccccagcagctgcctgatgaccgagtggggcgagtgggacgagtgcagcgccacctgcggcatgggcatgaagaagagacacagaatgatcaagatgaaccccgccgacggcagcatgtgcaaggccgagaccagccaggccgagaagtgcatgatgcccgagtgccacaccatcccctgcctgctgagcccctggagcgagtggagcgactgcagcgtgacctgcggcaagggcatgagaaccagacagagaatgctgaagagcctggccgagctgggcgactgcaacgaggacctggagcaggtggagaagtgcatgctgcccgagtgccccatcgactgcgagctgaccgagtggagccagtggagcgagtgcaacaagagctgcggcaagggccacgtgatcagaaccagaatgatccagatggagccccagttcggcggcgccccctgccccgagaccgtgcagagaaagaagtgcagaatcagaaagtgcctgagaaaccccagcatccagaagctgagatggagagaggccagagagagcagaagaagcgagcagctgaaggaggagagcgagggcgagcagttccccggctgcagaatgagaccctggaccgcctggagcgagtgcaccaagctgtgcggcggcggcatccaggagagatacatgaccgtgaagaagagattcaagagcagccagttcaccagctgcaaggacaagaaggagatcagagcctgcaacgtgcacccctgctag

SEQ ID NO: 3743 - DNA, 4242 bp, Artificial Sequence
  Description of Artificial Sequence: Synthetic coding sequence
atgagacacggcgtggcctgggccctgctggtggccgccgccctgggcctgggcgccagaggcgtgagaggcgccgtggccctggccgacttctaccccttcggcgccgagagaggcgacgccgtgacccccaagcaggacgacggcggcagcggcctgagacccctgagcgtgcccttccccttcttcggcgccgagcacagcggcctgtacgtgaacaacaacggcatcatcagcttcctgaaggaggtgagccagttcacccccgtggccttccccatcgccaaggacagatgcgtggtggccgccttctgggccgacgtggacaacagaagagccggcgacgtgtactacagagaggccaccgaccccgccatgctgagaagagccaccgaggacgtgagacactacttccccgagctgctggacttcaacgccacctgggtgttcgtggccacctggtacagagtgaccttcttcggcggcagcagcagcagccccgtgaacaccttccagaccgtgctgatcaccgacggcaagctgagcttcaccatcttcaactacgagagcatcgtgtggaccaccggcacccacgccagcagcggcggcaacgccaccggcctgggcggcatcgccgcccaggccggcttcaacgccggcgacggccagagatacttcagcatccccggcagcagaaccgccgacatggccgaggtggagaccaccaccaacgtgggcgtgcccggcagatgggccttcagaatcgacgacgcccaggtgagagtgggcggctgcggccacaccaccagcgtgtgcctggccctgagaccctgcctgaacggcggcaagtgcatcgacgactgcgtgaccggcaaccccagctacacctgcagctgcctgagcggcttcaccggcagaagatgccacctggacgtgaacgagtgcgccagccagccctgccagaacggcggcacctgcacccacggcatcaacagcttcagatgccagtgccccgccggcttcggcggccccacctgcgagaccgcccagagcccctgcgacaccaaggagtgccagcacggcggccagtgccaggtggagaacggcagcgccgtgtgcgtgtgccaggccggctacaccggcgccgcctgcgagatggacgtggacgactgcagccccgacccctgcctgaacggcggcagctgcgtggacctggtgggcaactacacctgcctgtgcgccgagcccttcaagggcctgagatgcgagaccggcgaccaccccgtgcccgacgcctgcctgagcgccccctgccacaacggcggcacctgcgtggacgccgaccagggctacgtgtgcgagtgccccgagggcttcatgggcctggactgcagagagagagtgcccgacgactgcgagtgcagaaacggcggcagatgcctgggcgccaacaccaccctgtgccagtgccccctgggcttcttcggcctgctgtgcgagttcgagatcaccgccatgccctgcaacatgaacacccagtgccccgacggcggctactgcatggagcacggcggcagctacctgtgcgtgtgccacaccgaccacaacgccagccacagcctgcccagcccctgcgacagcgacccctgcttcaacggcggcagctgcgacgcccacgacgacagctacacctgcgagtgccccagaggcttccacggcaagcactgcgagaaggccagaccccacctgtgcagcagcggcccctgcagaaacggcggcacctgcaaggaggccggcggcgagtaccactgcagctgcccctacagattcaccggcagacactgcgagatcggcaagcccgacagctgcgccagcggcccctgccacaacggcggcacctgcttccactacatcggcaagtacaagtgcgactgcccccccggcttcagcggcagacactgcgagatcgcccccagcccctgcttcagaagcccctgcgtgaacggcggcacctgcgaggacagagacaccgacttcttctgccactgccaggccggctacatgggcagaagatgccaggccgaggtggactgcggcccccccgaggaggtgaagcacgccaccctgagattcaacggcaccagactgggcgccgtggccctgtacgcctgcgacagaggctacagcctgagcgcccccagcagaatcagagtgtgccagccccacggcgtgtggagcgagcccccccagtgcctggagatcgacgagtgcagaagccagccctgcctgcacggcggcagctgccaggacagagtggccggctacctgtgcctgtgcagcaccggctacgagggcgcccactgcgagctggagagagacgagtgcagagcccacccctgcagaaacggcggcagctgcagaaacctgcccggcgcctacgtgtgcagatgccccgccggcttcgtgggcgtgcactgcgagaccgaggtggacgcctgcgacagcagcccctgccagcacggcggcagatgcgagagcggcggcggcgcctacctgtgcgtgtgccccgagagcttcttcggctaccactgcgagaccgtgagcgacccctgcttcagcagcccctgcggcggcagaggctactgcctggccagcaacggcagccacagctgcacctgcaaggtgggctacaccggcgaggactgcgccaaggagctgttcccccccaccgccctgaagatggagagagtggaggagagcggcgtgagcatcagctggaacccccccaacggccccgccgccagacagatgctggacggctacgccgtgacctacgtgagcagcgacggcagctacagaagaaccgacttcgtggacagaaccagaagcagccaccagctgcaggccctggccgccggcagagcctacaacatcagcgtgttcagcgtgaagagaaacagcaacaacaagaacgacatcagcagacccgccgtgctgctggccagaaccagacccagacccgtggagggcttcgaggtgaccaacgtgaccgccagcaccatcagcgtgcagtgggccctgcacagaatcagacacgccaccgtgagcggcgtgagagtgagcatcagacaccccgaggccctgagagaccaggccaccgacgtggacagaagcgtggacagattcaccttcagagccctgctgcccggcaagagatacaccatccagctgaccaccctgagcggcctgagaggcgaggagcaccccaccgagagcctggccaccgcccccacccacgtgtggaccagacccctgccccccgccaacctgaccgccgccagagtgaccgccaccagcgcccacgtggtgtgggacgcccccacccccggcagcctgctggaggcctacgtgatcaacgtgaccaccagccagagcaccaagagcagatacgtgcccaacggcaagctggccagctacaccgtgagagacctgctgcccggcagaagataccagctgagcgtgatcgccgtgcagagcaccgagctgggcccccagcacagcgagcccgcccacctgtacatcatcaccagccccagagacggcgccgacagaagatggcaccagggcggccaccaccccagagtgctgaagaacagacccccccccgccagactgcccgagctgagactgctgaacgaccacagcgcccccgagacccccacccagccccccagattcagcgagctggtggacggcagaggcagagtgagcgccagattcggcggcagccccagcaaggccgccaccgtgagaagccagcccaccgccagcgcccagctggagaacatggaggaggcccccaagagagtgagcctggccctgcagctgcccgagcacggcagcaaggacatcggcaacgtgcccggcaactgcagcgagaacccctgccagaacggcggcacctgcgtgcccggcgccgacgcccacagctgcgactgcggccccggcttcaagggcagaagatgcgagctggcctgcatcaaggtgagcagaccctgcaccagactgttcagcgagaccaaggccttccccgtgtgggagggcggcgtgtgccaccacgtgtacaagagagtgtacagagtgcaccaggacatctgcttcaaggagagctgcgagagcaccagcctgaagaagacccccaacagaaagcagagcaagagccagaccctggagaagagctag

SEQ ID NO: 3744 - DNA, 1008 bp, Artificial Sequence
  Description of Artificial Sequence: Synthetic coding sequence
atgttcctggccaccctgagcttcctgctgcccttcgcccaccccttcggcaccgtgagctgcgagtacatgctgggcagccccctgagcagcctggcccaggtgaacctgagccccttcagccaccccaaggtgcacatggaccccaactactgccaccccagcaccagcctgcacctgtgcagcctggcctggagcttcaccagactgctgcacccccccctgagccccggcatcagccaggtggtgaaggaccacgtgaccaagcccaccgccatggcccagggcagagtggcccacctgatcgagtggaagggctggagcaagcccagcgacagccccgccgccctggagagcgccttcagcagctacagcgacctgagcgagggcgagcaggaggccagattcgccgccggcgtggccgagcagttcgccatcgccgaggccaagctgagagcctggagcagcgtggacggcgaggacagcaccgacgacagctacgacgaggacttcgccggcggcatggacaccgacatggccggccagctgcccctgggcccccacctgcaggacctgttcaccggccacagattcagcagacccgtgagacagggcagcgtggagcccgagagcgactgcagccagaccgtgagccccgacaccctgtgcagcagcctgtgcagcctggaggacggcctgctgggcagccccgccagactggccagccagctgctgggcgacgagctgctgctggccaagctgccccccagcagagagagcgccttcagaagcctgggccccctggaggcccaggacagcctgtacaacagccccctgaccgagagctgcctgagccccgccgaggaggagcccgccccctgcaaggactgccagcccctgtgcccccccctgaccggcagctgggagagacagagacaggccagcgacctggccagcagcggcgtggtgagcctggacgaggacgaggccgagcccgaggagcagtag

SEQ ID NO: 3745 - DNA, 828 bp, Artificial Sequence
  Description of Artificial Sequence: Synthetic coding sequence
atgcagccccccggccccagagaccccctgatcagactgtgcttcttcagagaggagggcaccaacgtggtgcagaagatctgcttcagcacccagatcatcagacacttcgagagcaagctgagcgacaccatcgaggtgtaccaggagagaatccagtggctgaccgagaacagcaagaaggccttcggcctgatcaagggcgccagagtgagcatcctgatcgacgtgagcgccatcagcagcggcccccagaaggaggagttccagaaggacctgatgagcctgatcgacgagcagctgagccacaaggagaagctgttcgtgctgagcttcggcaccaacgccggcagcctgtggcccgaccccatggaggtgagcgccagcaccctgcaggagctgaagctgtgggtgaagaccctgcagcccgacggcggcagcaacctgctgcaggccctgaagaagatcttcaccctgaagggcctggacagcctggtggccatcatgagaagctgccccgaccagcccagcgagatcctgagcgactacatccagcagagcaccatgggcagagacctgatcatccacttcatcacctacagatgcgacgaccagatgccccccgccgtgctgaagaacctggccgaggccgtgagaggctactaccactgctacagccccaagatggagcactacaccagcagagacatggacgagctgctggccgagatccagaaggcccagagcctgctgagccacgtgcaggccctgcagcacagcagcccctgcgaggccctgacctgcaccatggaggagcccagaaactag

SEQ ID NO: 3746 - DNA, 438 bp, Artificial Sequence
  Description of Artificial Sequence: Synthetic coding sequence
atgctgaccagactggtgctgagcgcccacctgagcagcaccaccagccccccctggacccacgccgccatcagctgggagctggacaacgtgctgatgcccagccccagaatctggccccaggtgacccccaccggcagaagcgccagcgtgagaagcgagggcaacaccagcagcctgtggaacttcagcgccggccaggacgtgcacgccatcgtgaccagaacctgcgagagcgtgctgagcagcgccgtgtacacccacggctgcggctgcgtgagaagcgccaccaacatcacctgccagagcagcggccagcagagacaggccgccagacaggaggaggagaacagcatctgcaaggcccacgacagcagagagggcagactgggctaccccctgagcgcccaccagcccggcagcggcggccccaactag

SEQ ID NO: 3747 - DNA, 777 bp, Artificial Sequence
  Description of Artificial Sequence: Synthetic coding sequence
atgaccccccccaagctgagagccagcctgagccccagcctgctgctgctgctgagcggctgcctgctggccgccgccagaagagagaagggcgccgccagcaacgtggccgagcccgtgcccggccccaccggcggcagcagcggcagattcctgagccccgagcagcacgcctgcagctggcagctgctgctgcccgcccccgaggccgccgccggcagcgagctggccctgagatgccagagccccgacggcgccagacaccagtgcgcctacagaggccaccccgagagatgcgccgcctacgccgccagaagagcccacttctggaagcaggtgctgggcggcctgagaaagaagagaagaccctgccacgaccccgcccccctgcaggccagactgtgcgccggcaagaagggccacggcgccgagctgagactggtgcccagagccagcccccccgccagacccaccgtggccggcttcgccggcgagagcaagcccagagccagaaacagaggcagaaccagagagagagccagcggccccgccgccggcaccccccccccccagagcgccccccccaaggagaaccccagcgagagaaagaccaacgagggcaagagaaaggccgccctggtgcccaacgaggagagacccatgggcaccggccccgaccccgacggcctggacggcaacgccgagctgaccgagacctactgcgccgagaagtggcacagcctgtgcaacttcttcgtgaacttctggaacggctag

SEQ ID NO: 3748 - DNA, 393 bp, Artificial Sequence
  Description of Artificial Sequence: Synthetic coding sequence
atggccagaagacactgcttcagctactggctgctggtgtgctggctggtggtgaccgtggccgagggccaggaggaggtgttcaccccccccggcgacagccagaacaacgccgacgccaccgactgccagatcttcaccctgacccccccccccgcccccagaagccccgtgaccagagcccagcccatcaccaagacccccagatgccccttccacttcttccccagaagacccagaatccacttcagattccccaacagacccttcgtgcccagcagatgcaaccacagattccccttccagcccttctactggccccacagatacctgacctacagatacttccccagaagaagactgcagagaggcagcagcagcgaggagagctag

SEQ ID NO: 3749 - DNA, 600 bp, Artificial Sequence
  Description of Artificial Sequence: Synthetic coding sequence
atgtaccccgccaccgccgtgccccagatcaacatcaccatcctgaagggcgagaagggcgacagaggcgacagaggcctgcagggcaagtacggcaagaccggcagcgccggcgccagaggccacaccggccccaagggccagaagggcagcatgggcgcccccggcgagagatgcaagagccactacgccgccttcagcgtgggcagaaagaagcccatgcacagcaaccactactaccagaccgtgatcttcgacaccgagttcgtgaacctgtacgaccacttcaacatgttcaccggcaagttctactgctacgtgcccggcctgtacttcttcagcctgaacgtgcacacctggaaccagaaggagacctacctgcacatcatgaagaacgaggaggaggtggtgatcctgttcgcccaggtgggcgacagaagcatcatgcagagccagagcctgatgctggagctgagagagcaggaccaggtgtgggtgagactgtacaagggcgagagagagaacgccatcttcagcgaggagctggacacctacatcaccttcagcggctacctggtgaagcacgccaccgagccctag

SEQ ID NO: 3750 - DNA, 702 bp, Artificial Sequence
  Description of Artificial Sequence: Synthetic coding sequence
atggccctgaagaacaagttcagctgcctgtggatcctgggcctgtgcctggtggccaccaccagcagcaagatccccagcatcaccgacccccacttcatcgacaactgcatcgaggcccacaacgagtggagaggcaaggtgaacccccccgccgccgacatgaagtacatgatctgggacaagggcctggccaagatggccaaggcctgggccaaccagtgcaagttcgagcacaacgactgcctggacaagagctacaagtgctacgccgccttcgagtacgtgggcgagaacatctggctgggcggcatcaagagcttcacccccagacacgccatcaccgcctggtacaacgagacccagttctacgacttcgacagcctgagctgcagcagagtgtgcggccactacacccagctggtgtgggccaacagcttctacgtgggctgcgccgtggccatgtgccccaacctgggcggcgccagcaccgccatcttcgtgtgcaactacggccccgccggcaacttcgccaacatgcccccctacgtgagaggcgagagctgcagcctgtgcagcaaggaggagaagtgcgtgaagaacctgtgcaagaaccccttcctgaagcccaccggcagagccccccagcagaccgccttcaaccccttcagcctgggcttcctgctgctgagaatcttctag

SEQ ID NO: 3751 - DNA, 669 bp, Artificial Sequence
  Description of Artificial Sequence: Synthetic coding sequence
atggccctgcacatccacgaggcctgcatcctgctgctggtgatccccggcctggtgaccagcgccgccatcagccacgaggactaccccgccgacgagggcgaccagatcagcagcaacgacaacctgatcttcgacgactacagaggcaagggctgcgtggacgacagcggcttcgtgtacaagctgggcgagagattcttccccggccacagcaactgcccctgcgtgtgcgccctggacggccccgtgtgcgaccagcccgagtgccccaagatccaccccaagtgcaccaaggtggagcacaacggctgctgccccgagtgcaaggaggtgaagaacttctgcgagtaccacggcaagaactacaagatcctggaggagttcaagcccagcccctgcgagtggtgcagatgcgagcccagcaacgaggtgcactgcgtggtggccgactgcgccgtgcccgagtgcgtgaaccccgtgtacgagcccgagcagtgctgccccgtgtgcaagaacggccccaactgcttcgccggcaccaccatcatccccgccggcatcgaggtgaaggtggacgagtgcaacatctgccactgccacaacggcgactggtggaagcccgcccagtgcagcaagagagagtgccagggcaagcagaccgtgtag

SEQ ID NO: 3752 - DNA, 957 bp, Artificial Sequence
  Description of Artificial Sequence: Synthetic coding sequence
atgctgcccctgaccatgaccgtgctgatcctgctgctgctgcccaccggccaggccgcccccaaggacggcgtgaccagacccgacagcgaggtgcagcaccagctgctgcccaaccccttccagcccggccaggagcagctgggcctgctgcagagctacctgaagggcctgggcagaaccgaggtgcagctggagcacctgagcagagagcaggtgctgctgtacctgttcgccctgcacgactacgaccagagcggccagctggacggcctggagctgctgagcatgctgaccgccgccctggcccccggcgccgccaacagccccaccaccaaccccgtgatcctgatcgtggacaaggtgctggagacccaggacctgaacggcgacggcctgatgacccccgccgagctgatcaacttccccggcgtggccctgagacacgtggagcccggcgagcccctggcccccagcccccaggagccccaggccgtgggcagacagagcctgctggccaagagccccctgagacaggagacccaggaggcccccggccccagagaggaggccaagggccaggtggaggccagaagagagagcctggaccccgtgcaggagcccggcggccaggccgaggccgacggcgacgtgcccggccccagaggcgaggccgagggccaggccgaggccaagggcgacgcccccggccccagaggcgaggccggcggccaggccgaggccgagggcgacgcccccggccccagaggcgaggccggcggccaggccgaggccgagggcgacgcccccggccccagaggcgaggccggcggccaggccgaggccagagagaacggcgaggaggccaaggagctgcccggcgagaccctggagagcaagaacacccagaacgacttcgaggtgcacatcgtgcaggtggagaacgacgagatctag

SEQ ID NO: 3753 - DNA, 393 bp, Artificial Sequence
  Description of Artificial Sequence: Synthetic coding sequence
atgctggcccccctgttcctgtgctgcctgagaaacctgttcagaaagctgatcagcttccagcccccccagctgggcagaaccaacatgcactacagcaagctgcccagaaccgccatcgagaccgagttcaagcagaacgtgggccccccccccaaggacctgaccgccgaggtgtacttccccagcatcaagagcagaagccacctgcccgccgtgttctacaaccagtacttcaagcaccccaagtgcgtgggcgagtacggccccaagaacggcgccgagagacagatcgaggagagaaaggtgctgcccaccaccatgatgttcagcatgctggccgactgcgtgctgaagagcacccccatccccatcctgggcgtggccatgtag

SEQ ID NO: 3754 - DNA, 4362 bp, Artificial Sequence
  Description of Artificial Sequence: Synthetic coding sequence
atgatgctgccccagaacagctggcacatcgacttcggcagatgctgctgccaccagaacctgttcagcgccgtggtgacctgcatcctgctgctgaacagctgcttcctgatcagcagcttcaacggcaccgacctggagctgagactggtgaacggcgacggcccctgcagcggcaccgtggaggtgaagttccagggccagtggggcaccgtgtgcgacgacggctggaacaccaccgccagcaccgtggtgtgcaagcagctgggctgccccttcagcttcgccatgttcagattcggccaggccgtgaccagacacggcaagatctggctggacgacgtgagctgctacggcaacgagagcgccctgtgggagtgccagcacagagagtggggcagccacaactgctaccacggcgaggacgtgggcgtgaactgctacggcgaggccaacctgggcctgagactggtggacggcaacaacagctgcagcggcagagtggaggtgaagttccaggagagatggggcaccatctgcgacgacggctggaacctgaacaccgccgccgtggtgtgcagacagctgggctgccccagcagcttcatcagcagcggcgtggtgaacagccccgccgtgctgagacccatctggctggacgacatcctgtgccagggcaacgagctggccctgtggaactgcagacacagaggctggggcaaccacgactgcagccacaacgaggacgtgaccctgacctgctacgacagcagcgacctggagctgagactggtgggcggcaccaacagatgcatgggcagagtggagctgaagatccagggcagatggggcaccgtgtgccaccacaagtggaacaacgccgccgccgacgtggtgtgcaagcagctgggctgcggcaccgccctgcacttcgccggcctgccccacctgcagagcggcagcgacgtggtgtggctggacggcgtgagctgcagcggcaacgagagcttcctgtgggactgcagacacagcggcaccgtgaacttcgactgcctgcaccagaacgacgtgagcgtgatctgcagcgacggcgccgacctggagctgagactggccgacggcagcaacaactgcagcggcagagtggaggtgagaatccacgagcagtggtggaccatctgcgaccagaactggaagaacgagcaggccctggtggtgtgcaagcagctgggctgccccttcagcgtgttcggcagcagaagagccaagcccagcaacgaggccagagacatctggatcaacagcatcagctgcaccggcaacgagagcgccctgtgggactgcacctacgacggcaaggccaagagaacctgcttcagaagaagcgacgccggcgtgatctgcagcgacaaggccgacctggacctgagactggtgggcgcccacagcccctgctacggcagactggaggtgaagtaccagggcgagtggggcaccgtgtgccacgacagatggagcaccagaaacgccgccgtggtgtgcaagcagctgggctgcggcaagcccctgcacgtgttcggcatgacctacttcaaggaggccagcggccccatctggctggacgacgtgagctgcatcggcaacgagagcaacatctgggactgcgagcacagcggctggggcaagcacaactgcgtgcacagagaggacgtgatcgtgacctgcagcggcgacgccacctggggcctgagactggtgggcggcagcaacagatgcagcggcagactggaggtgtacttccagggcagatggggcaccgtgtgcgacgacggctggaacagcaaggccgccgccgtggtgtgcagccagctggactgccccagcagcatcatcggcatgggcctgggcaacgccagcaccggctacggcaagatctggctggacgacgtgagctgcgacggcgacgagagcgacctgtggagctgcagaaacagcggctggggcaacaacgactgcagccacagcgaggacgtgggcgtgatctgcagcgacgccagcgacatggagctgagactggtgggcggcagcagcagatgcgccggcaaggtggaggtgaacgtgcagggcgccgtgggcatcctgtgcgccaacggctggggcatgaacatcgccgaggtggtgtgcagacagctggagtgcggcagcgccatcagagtgagcagagagccccacttcaccgagagaaccctgcacatcctgatgagcaacagcggctgcaccggcggcgaggccagcctgtgggactgcatcagatgggagtggaagcagaccgcctgccacctgaacatggaggccagcctgatctgcagcgcccacagacagcccagactggtgggcgccgacatgccctgcagcggcagagtggaggtgaagcacgccgacacctggagaagcgtgtgcgacagcgacttcagcctgcacgccgccaacgtgctgtgcagagagctgaactgcggcgacgccatcagcctgagcgtgggcgaccacttcggcaagggcaacggcctgacctgggccgagaagttccagtgcgagggcagcgagacccacctggccctgtgccccatcgtgcagcaccccgaggacacctgcatccacagcagagaggtgggcgtggtgtgcagcagatacaccgacgtgagactggtgaacggcaagagccagtgcgacggccaggtggagatcaacgtgctgggccactggggcagcctgtgcgacacccactgggaccccgaggacgccagagtgctgtgcagacagctgagctgcggcaccgccctgagcaccaccggcggcaagtacatcggcgagagaagcgtgagagtgtggggccacagattccactgcctgggcaacgagagcctgctggacaactgccagatgaccgtgctgggcgcccccccctgcatccacggcaacaccgtgagcgtgatctgcaccggcagcctgacccagcccctgttcccctgcctggccaacgtgagcgacccctacctgagcgccgtgcccgagggcagcgccctgatctgcctggaggacaagagactgagactggtggacggcgacagcagatgcgccggcagagtggagatctaccacgacggcttctggggcaccatctgcgacgacggctgggacctgagcgacgcccacgtggtgtgccagaagctgggctgcggcgtggccttcaacgccaccgtgagcgcccacttcggcgagggcagcggccccatctggctggacgacctgaactgcaccggcatggagagccacctgtggcagtgccccagcagaggctggggccagcacgactgcagacacaaggaggacgccggcgtgatctgcagcgagttcaccgccctgagactgtacagcgagaccgagaccgagagctgcgccggcagactggaggtgttctacaacggcacctggggcagcgtgggcagaagaaacatcaccaccgccatcgccggcatcgtgtgcagacagctgggctgcggcgagaacggcgtggtgagcctggcccccctgagcaagaccggcagcggcttcatgtgggtggacgacatccagtgccccaagacccacatcagcatctggcagtgcctgagcgccccctgggagagaagaatcagcagccccgccgaggagacctggatcacctgcgaggacagaatcagagtgagaggcggcgacaccgagtgcagcggcagagtggagatctggcacgccggcagctggggcaccgtgtgcgacgacagctgggacctggccgaggccgaggtggtgtgccagcagctgggctgcggcagcgccctggccgccctgagagacgccagcttcggccagggcaccggcaccatctggctggacgacatgagatgcaagggcaacgagagcttcctgtgggactgccacgccaagccctggggccagagcgactgcggccacaaggaggacgccggcgtgagatgcagcggccagagcctgaagagcctgaacgccagcagcggccacctggccctgatcctgagcagcatcttcggcctgctgctgctggtgctgttcatcctgttcctgacctggtgcagagtgcagaagcagaagcacctgcccctgagagtgagcaccagaagaagaggcagcctggaggagaacctgttccacgagatggagacctgcctgaagagagaggacccccacggcaccagaaccagcgacgacacccccaaccacggctgcgaggacgccagcgacaccagcctgctgggcgtgctgcccgccagcgaggccaccaagtag

SEQ ID NO: 3755 - DNA, 759 bp, Artificial Sequence
  Description of Artificial Sequence: Synthetic coding sequence
atgctgcccccccccagacccgccgccgccctggccctgcccgtgctgctgctgctgctggtggtgctgacccccccccccaccggcgccagacccagccccggccccgactacctgagaagaggctggatgagactgctggccgagggcgagggctgcgccccctgcagacccgaggagtgcgccgcccccagaggctgcctggccggcagagtgagagacgcctgcggctgctgctgggagtgcgccaacctggagggccagctgtgcgacctggaccccagcgcccacttctacggccactgcggcgagcagctggagtgcagactggacaccggcggcgacctgagcagaggcgaggtgcccgagcccctgtgcgcctgcagaagccagagccccctgtgcggcagcgacggccacacctacagccagatctgcagactgcaggaggccgccagagccagacccgacgccaacctgaccgtggcccaccccggcccctgcgagagcggcccccagatcgtgagccacccctacgacacctggagaggccccagactgcagaccctgggcaccgaggacaccctgaccaccctggtgggcgccggcggcatggccagagccgtggcctgcggcgaggcccccggcgagcacctggccctgcaggtgctgtgcctgagcggcaagagaagacacctgtggcaggtgggcagcaccggcagcagcgagggcgtgcccagcggcggcagcttctggtag

SEQ ID NO: 3756 - DNA, 1323 bp, Artificial Sequence
  Description of Artificial Sequence: Synthetic coding sequence
atgaagctggccctgctgctgccctgggcctgctgctgcctgtgcggcagcgccctggccaccggcttcctgtaccccttcagcgccgccgccctgcagcagcacggctaccccgagcccggcgccggcagccccggcagcggctacgccagcagaagacactggtgccaccacaccgtgaccagaaccgtgagctgccaggtgcagaacggcagcgagaccgtggtgcagagagtgtaccagagctgcagatggcccggcccctgcgccaacctggtgagctacagaaccctgatcagacccacctacagagtgagctacagaaccgtgaccgtgctggagtggagatgctgccccggcttcaccggcagcaactgcgacgaggagtgcatgaactgcaccagactgagcgacatgagcgagagactgaccaccctggaggccaaggtgctgctgctggaggccgccgagagacccagcagccccgacaacgacctgcccgcccccgagagcaccccccccacctggaacgaggacttcctgcccgacgccatccccctggcccaccccgtgcccagacagagaagacccaccggccccgccggcccccccggccagaccggcccccccggccccgccggcccccccggcagcaagggcgacagaggccagaccggcgagaagggccccgccggcccccccggcctgctgggcccccccggccccagaggcctgcccggcgagatgggcagacccggcccccccggcccccccggccccgccggcaaccccggccccagccccaacagcccccagggcgccctgtacagcctgcagccccccaccgacaaggacaacggcgacagcagactggccagcgccatcgtggacaccgtgctggccggcgtgcccggccccagaggcccccccggcccccccggcccccccggccccagaggcccccccggcccccccggcacccccggcagccagggcctggccggcgagagaggcaccgtgggccccagcggcgagcccggcgtgaagggcgaggagggcgagaaggccgccaccgccgagggcgagggcgtgcagcagctgagagaggccctgaagatcctggccgagagagtgctgatcctggagcacatgatcggcatccacgaccccctggccagccccgagggcagcggccaggacgccgccctgagagccaacctgaagatgaagagaggcggcgcccagcccgacggcgtgctggccgccctgctgggccccgaccccggccagaagagcgtggaccaggccagcagcagaaagtag

SEQ ID NO: 3757 - DNA, 1341 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcatccccacccccagcctggccagcggcctgtggagaaccctgcaggtgggctggaacatgcagctgctgcccgccggcctggccagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcggcgcccagtgcgccaccaaggtgcacttccccttccacacctgcgacctgagaatcgacggcgactgcttcatggtgagcagcgaggccgacacctactacagagccagaatgaagtgccagagaaagggcggcgtgctggcccagatcaagagccagaaggtgcaggacatcctggccttctacctgggcagactggagaccaccaacgaggtgatcgacagcgacttcgagaccagaaacttctggatcggcctgacctacaagaccgccaaggacagcttcagatgggccaccggcgagcaccaggccttcaccagcttcgccttcggccagcccgacaaccacggcttcggcaactgcgtggagctgcaggccagcgccgccttcaactggaacaaccagagatgcaagaccagaaacagatacatctgccagttcgcccaggagcacatcagcagatggggccccggcagctag

SEQ ID NO: 3758 - DNA, 219 bp, Artificial Sequence
  Description of Artificial Sequence: Synthetic coding sequence
atgcagagactggtgctgctgctggccatcagcctgctgctgtaccaggacctgcccgtgagaagcgagttcgagctggacagaatctgcggctacggcaccgccagatgcagaaagaagtgcagaagccaggagtacagaatcggcagatgccccaacacctacgcctgctgcctgagaaagtgggacgagagcctgctgaacagaaccaagccctag

SEQ ID NO: 3759 - DNA, 2349 bp, Artificial Sequence
  Description of Artificial Sequence: Synthetic coding sequence
ctgtggctgctgctgtgggccgccgcctggagactgggcgccagcgcctgccccgccctgtgcacctgcaccggcaccaccgtggactgccacggcaccggcctgcaggccatccccaagaacatccccagaaacaccgagagactggagctgaacggcaacaacatcaccagaatccacaagaacgacttcgccggcctgaagcagctgagagtgctgcagctgatggagaaccagatcggcgccgtggagagaggcgccttcgacgacatgaaggagctggagagactgagactgaacagaaaccagctgcacatgctgcccgagctgctgttccagaacaaccaggccctgagcagactggacctgagcgagaacgccatccaggccatccccagaaaggccttcagaggcgccaccgacctgaagaacctgcagctggacaagaaccagatcagctgcatcgaggagggcgccttcagagccctgagaggcctggaggtgctgaccctgaacaacaacaacatcaccaccatccccgtgagcagcttcaaccacatgcccaagctgagaaccttcagactgcacagcaaccacctgttctgcgactgccacctggcctggctgagccagtggctgagacagagacccaccatcggcctgttcacccagtgcagcggccccgccagcctgagaggcctgaacgtggccgaggtgcagaagagcgagttcagctgcagcggccagggcgaggccggcagagtgcccacctgcaccctgagcagcggcagctgccccgccatgtgcacctgcagcaacggcatcgtggactgcagaggcaagggcctgaccgccatccccgccaacctgcccgagaccatgaccgagatcagactggagctgaacggcatcaagagcatcccccccggcgccttcagcccctacagaaagctgagaagaatctgccccctgagcttctgcagcccctgcagagacctgagcaacaaccagatcgccgagatcgcccccgacgccttccagggcctgagaagcctgaacagcctggtgctgtacggcaacaagatcaccgacctgcccagaggcgtgttcggcggcctgtacaccctgcagctgctgctgctgaacgccaacaagatcaactgcatcagacccgacgccttccaggacctgcagaacctgagcctgctgagcctgtacgacaacaagatccagagcctggccaagggcaccttcaccagcctgagagccatccagaccctgcacctggcccagaaccccttcatctgcgactgcaacctgaagtggctggccgacttcctgagaaccaaccccatcgagaccagcggcgccagatgcgccagccccagaagactggccaacaagagaatcggccagatcaagagcaagaagttcagatgcagcgccaaggagcagtacttcatccccggcaccgaggactaccagctgaacagcgagtgcaacagcgacgtggtgtgcccccacaagtgcagatgcgaggccaacgtggtggagtgcagcagcctgaagctgaccaagatccccgagagaatcccccagagcaccgccgagctgagactgaacaacaacgagatcagcatcctggaggccaccggcatgttcaagaagctgacccacctgaagaagatcaacctgagcaacaacaaggtgagcgagatcgaggacggcgccttcgagggcgccgccagcgtgagcgagctgcacctgaccgccaaccagctggagagcatcagaagcggcatgttcagaggcctggacggcctgagaaccctgatgctgagaaacaacagaatcagctgcatccacaacgacagcttcaccggcctgagaaacgtgagactgctgagcctgtacgacaaccagatcaccaccgtgagccccggcgccttcgacaccctgcagagcctgagcaccctgaacctgctggccaaccccttcaactgcaactgccagctggcctggctgggcggctggctgagaaagagaaagatcgtgaccggcaaccccagatgccagaaccccgacttcctgagacagatccccctgcaggacgtggccttccccgacttcagatgcgaggagggccaggaggagggcggctgcctgcccagaccccagtgcccccaggagtgcgcctgcctggacaccgtggtgagatgcagcaacaagcacctgagagccctgcccaagggcatccccaagaacgtgaccgagctgtacctggacggcaaccagttcaccctggtgcccggccagctgagcaccttcaagtacctgcagctggtgtag

SEQ ID NO: 3760 - DNA, 411 bp, Artificial Sequence
  Description of Artificial Sequence: Synthetic coding sequence
atgagcaacgtgccccacaagagcagcctgcccgagggcatcagacccggcaccgtgctgagaatcagaggcctggtgccccccaacgccagcagattccacgtgaacctgctgtgcggcgaggagcagggcagcgacgccgccctgcacttcaaccccagactggacaccagcgaggtggtgttcaacagcaaggagcagggcagctggggcagagaggagagaggccccggcgtgcccttccagagaggccagcccttcgaggtgctgatcatcgccagcgacgacggcttcaaggccgtggtgggcgacgcccagtaccaccacttcagacacagactgcccctggccagagtgagactggtggaggtgggcggcgacgtgcagctggacagcgtgagaatcttctag

SEQ ID NO: 3761 - DNA, 1926 bp, Artificial Sequence
  Description of Artificial Sequence: Synthetic coding sequence
atgcccccccccctgcccctgctgctgctgaccgtgctggtggtggccgccgccagacccggctgcgagttcgagagaaaccccgccgccacctgcgtggacctgcagctgagaacctgcagcgacgccgcctacaaccacaccaccttccccaacctgctgcagcacagaagctgggaggtggtggaggccagcagcgagtacatcctgctgagcgtgctgcaccagctgctggagggccagtgcaaccccgacctgagactgctgggctgcgccgtgctggcccccagatgcgagggcggctgggtgagaagaccctgcagacacatctgcgagggcctgagagaggtgtgccagcccgccttcgacgccatcgacatggcctggccctacttcctggactgccacagatacttcaccagagaggacgagggctgctacgaccccctggagaagctgagaggcggcctggaggccgacgaggccctgcccagcggcctgccccccaccttcatcagattcagccaccacagctacgcccagatggtgagagtgctgagaagaaccgccagcagatgcgcccacgtggccagaacctacagcatcggcagaagcttcgacggcagagagctgctggtgatcgagttcagcagcagacccggccagcacgagctgatggagcccgaggtgaagctgatcggcaacatccacggcaacgaggtggccggcagagagatgctgatctacctggcccagtacctgtgcagcgagtacctgctgggcaaccccagaatccagagactgctgaacaccaccagaatccacctgctgcccagcatgaaccccgacggctacgaggtggccgccgccgagggcgccggctacaacggctggaccagcggcagacagaacgcccagaacctggacctgaacagaaacttccccgacctgaccagcgagtactacagactggccgagaccagaggcgccagaagcgaccacatccccatcccccagcactactggtggggcaaggtggcccccgagaccaaggccatcatgaagtggatgcagaccatccccttcgtgctgagcgccagcctgcacggcggcgacctggtggtgagctaccccttcgacttcagcaagcacccccaggaggagaagatgttcagccccacccccgacgagaagatgttcaagctgctgagcagagcctacgccgacgtgcaccccatgatgatggacagaagcgagaacagatgcggcggcaacttcctgaagagaggcagcatcatcaacggcgccgactggtacagcttcaccggcggcatgagcgacttcaactacctgcacaccaactgcttcgagatcaccgtggagctgggctgcgtgaagttcccccccgaggaggccctgtacatcctgtggcagcacaacaaggagagcctgctgaacttcgtggagaccgtgcacagaggcatcaagggcgtggtgaccgacaagttcggcaagcccgtgaagaacgccagaatcagcgtgaagggcatcagacacgacatcaccaccgcccccgacggcgactactggagactgctgccccccggcatccacatcgtgatcgcccaggcccccggctacgccaaggtgatcaagaaggtgatcatccccgccagaatgaagagagccggcagagtggacttcatcctgcagcccctgggcatgggccccaagaacttcatccacggcctgagaagaaccggcccccacgaccccctgggcggcgccagcagcctgggcgaggccaccgagcccgaccccctgagagccagaagacagcccagcgccgacggcagcaagccctggtggtggagctacttcaccagcctgagcacccacagacccagatggctgctgaagtactag

SEQ ID NO: 3762 - DNA, 1305 bp, Artificial Sequence
  Description of Artificial Sequence: Synthetic coding sequence
atggccagcctgggcctgctgctgctgctgctgctgaccgccctgccccccctgtggagcagcagcctgcccggcctggacaccgccgagagcaaggccaccatcgccgacctgatcctgagcgccctggagagagccaccgtgttcctggagcagagactgcccgagatcaacctggacggcatggtgggcgtgagagtgctggaggagcagctgaagagcgtgagagagaagtgggcccaggagcccctgctgcagcccctgagcctgagagtgggcatgctgggcgagaagctggaggccgccatccagagaagcctgcactacctgaagctgagcgaccccaagtacctgagagagttccagctgaccctgcagcccggcttctggaagctgccccacgcctggatccacaccgacgccagcctggtgtaccccaccttcggcccccaggacagcttcagcgaggagagaagcgacgtgtgcctggtgcagctgctgggcaccggcaccgacagcagcgagccctgcggcctgagcgacctgtgcagaagcctgatgaccaagcccggctgcagcggctactgcctgagccaccagctgctgttcttcctgtgggccagaatgagaggctgcacccagggccccctgcagcagagccaggactacatcaacctgttctgcgccaacatgatggacctgaacagaagagccgaggccatcggctacgcctaccccaccagagacatcttcatggagaacaacgtgaccggccaccccgtgttctacctgcccctgtgcgacagcttcctgccccccaaggccgcccccgtgaccgagctgtacaccgacggccccgtgatgttctgcggcatgggcggcttcagcgacttctacaagctgagatggctggaggccatcctgagctggcagaagcagcaggagggctgcttcggcgagcccgacgccgaggacgaggagctgagcaaggccatccagtaccagcagcacttcagcagaagagtgaagagaagagagaagcagttccccgacagcagaagcgtggcccaggccggcgtgcagtggagaaacctgggcagcctgcagcccctgccccccggcttcaagcagttcagctgcctgatcctgcccagcagctgggactacagaagcgtgcccccctacctggccaacttctacatcttcctggtggagaccggcttccaccacgtggcccacgccggcctggagctgctgatcagcagagacccccccaccagcggcagccagagcgtgggcctgtag

SEQ ID NO: 3763 - DNA, 555 bp, Artificial Sequence
  Description of Artificial Sequence: Synthetic coding sequence
atgatgagcttcctgctgggcgccatcctgaccctgctgtgggcccccaccgcccaggccgaggtgctgctgcagcccgacttcaacgccgagaagttcagcggcctgtggtacgtggtgagcatggccagcgactgcagagtgttcctgggcaagaaggaccacctgagcatgagcaccagagccatcagacccaccgaggagggcggcctgcacgtgcacatggagttccccggcgccgacggctgcaaccaggtggacgccgagtacctgaaggtgggcagcgagggccacttcagagtgcccgccctgggctacctggacgtgagaatcgtggacaccgactacagcagcttcgccgtgctgtacatctacaaggagctggagggcgccctgagcaccatggtgcagctgtacagcagaacccaggacgtgagcccccaggccctgaagagcttccaggacttctaccccaccctgggcctgcccaaggacatgatggtgatgctgccccagagcgacgcctgcaaccccgagagcaaggaggccccctag

SEQ ID NO: 3764 - DNA, 219 bp, Artificial Sequence; identical to SEQ ID NO: 3758
  Description of Artificial Sequence: Synthetic coding sequence

SEQ ID NO: 3765 - DNA, 2247 bp, Artificial Sequence
  Description of Artificial Sequence: Synthetic coding sequence
atgggcagagccggcgccgccgccgtgatccccggcctggccctgctgtgggccgtgggcctgggcagcgccgcccccccccccagactgagactgagcttccaggagctgcaggcctggcacggcctgcagaccttcagcctggagagaacctgctgctaccaggccctgctggtggacgaggagagaggcagactgttcgtgggcgccgagaaccacgtggccagcctgaacctggacaacatcagcaagagagccaagaagctggcctggcccgcccccgtggagtggagagaggagtgcaactgggccggcaaggacatcggcaccgagtgcatgaacttcgtgaagctgctgcacgcctacaacagaacccacctgctggcctgcggcaccggcgccttccaccccacctgcgccttcgtggaggtgggccacagagccgaggagcccgtgctgagactggaccccggcagaatcgaggacggcaagggcaagagcccctacgaccccagacacagagccgccagcgtgctggtgggcgaggagctgtacagcggcgtggccgccgacctgatgggcagagacttcaccatcttcagaagcctgggccagagacccagcctgagaaccgagccccacgacagcagatggctgaacgagcccaagttcgtgaaggtgttctggatccccgagagcgagaaccccgacgacgacaagatctacttcttcttcagagagaccgccgtggaggccgcccccgccctgggcagactgagcgtgagcagagtgggccagatctgcagaaacgacgtgggcggccagagaagcctggtgaacaagtggaccaccttcctgaaggccagactggtgtgcagcgtgcccggcgtggagggcgacacccacttcgaccagctgcaggacgtgttcctgctgagcagcagagaccacagaacccccctgctgtacgccgtgttcagcaccagcagcagcatcttccagggcagcgccgtgtgcgtgtacagcatgaacgacgtgagaagagccttcctgggccccttcgcccacaaggagggccccatgcaccagtgggtgagctaccagggcagagtgccctaccccagacccggcatgtgccccagcaagaccttcggcaccttcagcagcaccaaggacttccccgacgacgtgatccagttcgccagaaaccaccccctgatgtacaacagcgtgctgcccaccggcggcagacccctgttcctgcaggtgggcgccaactacaccttcacccagatcgccgccgacagagtggccgccgccgacggccactacgacgtgctgttcatcggcaccgacgtgggcaccgtgctgaaggtgatcagcgtgcccaagggcagcagacccagcgccgagggcctgctgctggaggagctgcacgtgttcgaggacagcgccgccgtgaccagcatgcagatcagcagcaagagacaccagctgtacgtggccagcagaagcgccgtggcccagatcgccctgcacagatgcgccgcccacggcagagtgtgcaccgagtgctgcctggccagagacccctactgcgcctgggacggcgtggcctgcaccagattccagcccagcgccaagagaagattcagaagacaggacgtgagaaacggcgaccccagcaccctgtgcagcggcgacagcagcagacccgccctgctggagcacaaggtgttcggcgtggagggcagcagcgccttcctggagtgcgagcccagaagcctgcaggccagagtggagtggaccttccagagagccggcgtgaccgcccacacccaggtgctggccgaggagagaaccgagagaaccgccagaggcctgctgctgagaagactgagaagaagagacagcggcgtgtacctgtgcgccgccgtggagcagggcttcacccagcccctgagaagactgagcctgcacgtgctgagcgccacccaggccgagagactggccagagccgaggaggccgcccccgccgccccccccggccccaagctgtggtacagagacttcctgcagctggtggagcccggcggcggcggcagcgccaacagcctgagaatgtgcagaccccagcccgccctgcagagcctgcccctggagagcagaagaaagggcagaaacagaagaacccacgcccccgagcccagagccgagagaggccccagaagcgccacccactggtag

SEQ ID NO: 3766 - DNA, 369 bp, Artificial Sequence
  Description of Artificial Sequence: Synthetic coding sequence
atggtgctgctgtgcctgttcctggccagcctggccgccacccccagagccggcgtgaccggcgcctggcccaccagcggcctgagcatcctggcccagctgcagcccagctgcgagctgagatggacccagctgagcagaagcagctggagagacctggtgatgaccaccagcctgtggagcctggcctacttccagcacttcagccaggagaccaccacccaggagcagctggacgagatggaggagatccccagagagagccagtgcggcagacaggacttccacgccctgagctgccccaccgccagccccagagacagagtgctgctgtgctgccccggctggagagccatggtgcccagctag

SEQ ID NO: 3767 - DNA, 570 bp, Artificial Sequence
  Description of Artificial Sequence: Synthetic coding sequence
atgctgctgggccagctgagcaccctgctgtgcctgctgagcggcgccctgcccaccggcagcggcagacccgagccccagagccccagaccccagagctgggccgccgccaaccagacctgggccctgggccccggcgccctgccccccctggtgcccgccagcgccctgggcagctggaaggccttcctgggcctgcagaaggccagacagctgggcatgggcagactgcagagaggccaggacgaggtggccgccgtgaccctgcccctgaacccccaggaggtgatccagggcatgtgcaaggccgtgcccttcgtgcaggtgttcagcagacccggctgcagcgccatcagactgagaaaccacctgtgcttcggccactgcagcagcctgtacatccccggcagcgaccccacccccctggtgctgtgcaacagctgcatgcccgccagaaagagatgggcccccgtggtgctgtggtgcctgaccggcagcagcgccagcagaagaagagtgaagatcagcaccatgctgatcgagggctgccactgcagccccaaggcctag

SEQ ID NO: 3768 - DNA, 2505 bp, Artificial Sequence
  Description of Artificial Sequence: Synthetic coding sequence
atgaagcacaccctggccctgctggcccccctgctgggcctgggcctgggcctggccctgagccagctggccgccggcgccaccgactgcaagttcctgggccccgccgagcacctgaccttcacccccgccgccagagccagatggctggcccccagagtgagagcccccggcctgctggacagcctgtacggcaccgtgagaagattcctgagcgtggtgcagctgaaccccttccccagcgagctggtgaaggccctgctgaacgagctggccagcgtgaaggtgaacgaggtggtgagatacgaggccggctacgtggtgtgcgccgtgatcgccggcctgtacctgctgctggtgcccaccgccggcctgtgcttctgctgctgcagatgccacagaagatgcggcggcagagtgaagaccgagcacaaggccctggcctgcgagagagccgccctgatggtgttcctgctgctgaccaccctgctgctgctgatcggcgtggtgtgcgccttcgtgaccaaccagagaacccacgagcagatgggccccagcatcgaggccatgcccgagaccctgctgagcctgtggggcctggtgagcgacgtgccccaggagctgcaggccgtggcccagcagttcagcctgccccaggagcaggtgagcgaggagctggacggcgtgggcgtgagcatcggcagcgccatccacacccagctgagaagcagcgtgtaccccctgctggccgccgtgggcagcctgggccaggtgctgcaggtgagcgtgcaccacctgcagaccctgaacgccaccgtggtggagctgcaggccggccagcaggacctggagcccgccatcagagagcacagagacagactgctggagctgctgcaggaggccagatgccagggcgactgcgccggcgccctgagctgggccagaaccctggagctgggcgccgacttcagccaggtgcccagcgtggaccacgtgctgcaccagctgaagggcgtgcccgaggccaacttcagcagcatggtgcaggaggagaacagcaccttcaacgccctgcccgccctggccgccatgcagaccagcagcgtggtgcaggagctgaagaaggccgtggcccagcagcccgagggcgtgagaaccctggccgagggcttccccggcctggaggccgccagcagatgggcccaggccctgcaggaggtggaggagagcagcagaccctacctgcaggaggtgcagagatacgagacctacagatggatcgtgggctgcgtgctgtgcagcgtggtgctgttcgtggtgctgtgcaacctgctgggcctgaacctgggcatctggggcctgagcgccagagacgaccccagccaccccgaggccaagggcgaggccggcgccagattcctgatggccggcgtgggcctgagcttcctgttcgccgcccccctgatcctgctggtgttcgccaccttcctggtgggcggcaacgtgcagaccctggtgtgccagagctgggagaacggcgagctgttcgagttcgccgacacccccggcaacctgccccccagcatgaacctgagccagctgctgggcctgagaaagaacatcagcatccaccaggcctaccagcagtgcaaggagggcgccgccctgtggaccgtgctgcagctgaacgacagctacgacctggaggagcacctggacatcaaccagtacaccaacaagctgagacaggagctgcagagcctgaaggtggacacccagagcctggacctgctgagcagcgccgccagaagagacctggaggccctgcagagcagcggcctgcagagaatccactaccccgacttcctggtgcagatccagagacccgtggtgaagaccagcatggagcagctggcccaggagctgcagggcctggcccaggcccaggacaacagcgtgctgggccagagactgcaggaggaggcccagggcctgagaaacctgcaccaggagaaggtggtgccccagcagagcctggtggccaagctgaacctgagcgtgagagccctggagagcagcgcccccaacctgcagctggagaccagcgacgtgctggccaacgtgacctacctgaagggcgagctgcccgcctgggccgccagaatcctgagaaacgtgagcgagtgcttcctggccagagagatgggctacttcagccagtacgtggcctgggtgagagaggaggtgacccagagaatcgccacctgccagcccctgagcggcgccctggacaacagcagagtgatcctgtgcgacatgatggccgacccctggaacgccttctggttctgcctggcctggtgcaccttcttcctgatccccagcatcatcttcgccgtgaagaccagcaagtacttcagacccatcagaaagagactgagcagcaccagcagcgaggagacccagctgttccacatccccagagtgaccagcctgaagctgtag

SEQ ID NO: 3769 - DNA, 2505 bp, Artificial Sequence; identical to SEQ ID NO: 3768
  Description of Artificial Sequence: Synthetic coding sequence

SEQ ID NO: 3770 - DNA, 216 bp, Artificial Sequence
  Description of Artificial Sequence: Synthetic coding sequence
atgacccagctgctgctgttcctggtggccctgctggtgctgggccacgtgcccagcggcagaagcgagttcaagagatgctggaagggccagggcgcctgccagacctactgcaccagacaggagacctacatgcacctgtgccccgacgccagcctgtgctgcctgagctacgccctgaagcccccccccgtgcccaagcacgagtacgagtag

SEQ ID NO: 3771 - DNA, 1377 bp, Artificial Sequence
  Description of Artificial Sequence: Synthetic coding sequence
atggaggccaccggcaccgacgaggtggacaagctgaagaccaagttcatcagcgcctggaacaacatgaagtacagctgggtgctgaagaccaagacctacttcagcagaaacagccccgtgctgctgctgggcaagtgctaccacttcaagtacgaggacgaggacaagaccctgcccgccgagagcggctgcaccatcgaggaccacgtgatcgccggcaacgtggaggagttcagaaaggacttcatcagcagaatctggctgacctacagagaggagttcccccagatcgagggcagcgccctgaccaccgactgcggctggggctgcaccctgagaaccggccagatgctgctggcccagggcctgatcctgcacttcctgggcagagcctggacctggcccgacgccctgaacatcgagaacagcgacagcgagagctggaccagccacaccgtgaagaagttcaccgccagcttcgaggccagcctgagcggcgagagagagttcaagacccccaccatcagcctgaaggagaccatcggcaagtacagcgacgaccacgagatgagaaacgaggtgtaccacagaaagatcatcagctggttcggcgacagccccctggccctgttcggcctgcaccagctgatcgagtacggcaagaagagcggcaagaaggccggcgactggtacggccccgccgtggtggcccacatcctgagaaaggccgtggaggaggccagacaccccgacctgcagggcatcaccatctacgtggcccaggactgcaccgtgtacaacagcgacgtgatcgacaagcagagcgccagcatgaccagcgacaacgccgacgacaaggccgtgatcatcctggtgcccgtgagactgggcggcgagagaaccaacaccgactacctggagttcgtgaagggcatcctgagcctggagtactgcgtgggcatcatcggcggcaagcccaagcagagctactacttcgccggcttccaggacgacagcctgatctacatggacccccactactgccagagcttcgtggacgtgagcatcaaggacttccccctggagaccttccactgccccagccccaagaagatgagcttcagaaagatggaccccagctgcaccatcggcttctactgcagaaacgtgcaggacttcaagagagccagcgaggagatcaccaagatgctgaagttcagcagcaaggagaagtaccccctgttcaccttcgtgaacggccacagcagagactacgacttcaccagcaccaccaccaacgaggaggacctgttcagcgaggacgagaagaagcagctgaagagattcagcaccgaggagttcgtgctgctgtag

SEQ ID NO: 3772 - DNA, 342 bp, Artificial Sequence
  Description of Artificial Sequence: Synthetic coding sequence
atgagacagagactgctgcccagcgtgaccagcctgctgctggtggccctgctgttccccggcagcagccaggccagacacgtgaaccacagcgccaccgaggccctgggcgagctgagagagagagcccccggccagggcaccaacggcttccagctgctgagacacgccgtgaagagagacctgctgccccccagaacccccccctaccaggagcccgccagcgacctgaaggtggtggactgcagaagaagcgagggcttctgccaggagtactgcaactacatggagacccaggtgggctactgcagcaagaagaaggacgcctgctgcctgcactag

SEQ ID NO: 3773 - DNA, 258 bp, Artificial Sequence
  Description of Artificial Sequence: Synthetic coding sequence
atgaagaaggtgctgctgctgatcaccgccatcctggccgtggccgtgggcttccccgtgagccaggaccaggagagagagaagagaagcatcagcgacagcgacgagctggccagcggcttcttcgtgttcccctacccctaccccttcagacccctgccccccatccccttccccagattcccctggttcagaagaaacttccccatccccatccccgagagcgcccccaccacccccctgcccagcgagaagtag

SEQ ID NO: 3774 - DNA, 264 bp, Artificial Sequence
  Description of Artificial Sequence: Synthetic coding sequence
atggccgtgagcgtgctgagactgaccgtggtgctgggcctgctggtgctgttcctgacctgctacgccgacgacaagcccgacaagcccgacgacaagcccgacgacagcggcaaggaccccaagcccgacttccccaagttcctgagcctgctgggcaccgagatcatcgagaacgccgtggagttcatcctgagaagcatgagcagaagcaccggcttcatggagttcgacgacaacgagggcaagcacagcagcaagtag

SEQ ID NO: 3775 - DNA, 945 bp, Artificial Sequence
  Description of Artificial Sequence: Synthetic coding sequence
atgagcagcgaggccgagacccagcagccccccgccgccccccccgccgcccccgccctgagcgccgccgacaccaagcccggcaccaccggcgcccagggcgccgtggccagagcccacatcggcggcgccggcggcgacaagaaggtgatcgccaccaaggtgctgggcaccgtgaagtggttcaacgtgagaaacggctacggcttcatcaacagaaacgacaccaaggaggacgtgttcgtgcaccagaccgccatcaagaagaacaaccccagaaagtacctgagaagcgtgggcgacggcgagaccgtggagttcgacgtggtggagggcgagaagggcgccgaggccgccaacgtgaccggccccggcggcgtgcccgtgcagggcagcaagtacgccgccgacagaaaccactacagaagataccccagaagaagaggcccccccagaaactaccagcagaactaccagaacagcgagagcggcgagaagaacgagggcagcgagagcgcccccgagagacccaacaacgccggcccccaggccaaggtgcccaccctgctgcacgccgagtacggcagaagaccccagtacagcaacccccccgtgcagggcgaggtgatggagggcgccgacaaccagggcgccggcgagcagggcagacccgtgagacagtgcatcggcgacatcgaccacgacagcgccggcgccctgctggccagacagcccagagaggacggcaacgaggaggacaaggagaaccagggcgacgagacccagggccagcagcccccccagagaagatacagaagaaacttcaactacagaagaagaagacccgagaaccccaagccccaggacggcaaggagaccaaggccgccgacccccccgccgagaacagcagcgcccccgaggccgagcagggcggcgccgagtag

SEQ ID NO: 3776 - DNA, 636 bp, Artificial Sequence
  Description of Artificial Sequence: Synthetic coding sequence
atggtgttcctgaagttcttctgcatgagcttcttctgccacctgtgccagggctacttcgacggccccctgtaccccgagatgagcaacggcaccctgcaccactacttcgtgcccgacggcgactacgaggagaacgacgaccccgagaagtgccagctgctgttcagagtgagcgaccacagaagatgcagccagggcgagggcagccaggtgggcagcctgctgagcctgaccctgagagaggagttcaccgtgctgggcagacaggtggaggacgccggcagagtgctggagggcatcagcaagagcatcagctacgacctggacggcgaggagagctacggcaagtacctgagaagagagagccaccagatcggcgacgcctacagcaacagcgacaagagcctgaccgagctggagagcaagttcaagcagggccaggagcaggacagcagacaggagagcagactgaacgaggacttcctgggcatgctggtgcacaccagaagcctgctgaaggagaccctggacatcagcgtgggcctgagagacaagtacgagctgctggccctgaccatcagaagccacggcaccagactgggcagactgaagaacgactacctgaaggtgtag

SEQ ID NO: 3777 - DNA, 1566 bp, Artificial Sequence
  Description of Artificial Sequence: Synthetic coding sequence
atgctgtgcgccctgctgctgctgcccagcctgctgggcgccaccagagccagccccaccagcggcccccaggagtgcgccaagggcagcaccgtgtggtgccaggacctgcagaccgccgccagatgcggcgccgtgggctactgccagggcgccgtgtggaacaagcccaccgccaagagcctgccctgcgacgtgtgccaggacatcgccgccgccgccggcaacggcctgaaccccgacgccaccgagagcgacatcctggccctggtgatgaagacctgcgagtggctgcccagccaggagagcagcgccggctgcaagtggatggtggacgcccacagcagcgccatcctgagcatgctgagaggcgcccccgacagcgcccccgcccaggtgtgcaccgccctgagcctgtgcgagcccctgcagagacacctggccaccctgagacccctgagcaaggaggacaccttcgaggccgtggcccccttcatggccaacggccccctgaccttccaccccagacaggcccccgagggcgccctgtgccaggactgcgtgagacaggtgagcagactgcaggaggccgtgagaagcaacctgaccctggccgacctgaacatccaggagcagtgcgagagcctgggccccggcctggccgtgctgtgcaagaactacctgttccagttcttcgtgcccgccgaccaggccctgagactgctgcccccccaggagctgtgcagaaagggcggcttctgcgaggagctgggcgcccccgccagactgacccaggtggtggccatggacggcgtgcccagcctggagctgggcctgcccagaaagcagagcgagatgcagatgaaggccggcgtgacctgcgaggtgtgcatgaacgtggtgcagaagctggaccactggctgatgagcaacagcagcgagctgatgatcacccacgccctggagagagtgtgcagcgtgatgcccgccagcatcaccaaggagtgcatcatcctggtggacacctacagccccagcctggtgcagctggtggccaagatcacccccgagaaggtgtgcaagttcatcagactgtgcggcaacagaagaagagccagagccgtgcacgacgcctacgccatcgtgcccagccccgagtgggacgccgagaaccagggcagcttctgcaacggctgcaagagactgctgaccgtgagcagccacaacctggagagcaagagcaccaagagagacatcctggtggccttcaagggcggctgcagcatcctgcccctgccctacatgatccagtgcaagcacttcgtgacccagtacgagcccgtgctgatcgagagcctgaaggacatgatggaccccgtggccgtgtgcaagaaggtgggcgcctgccacggccccagaacccccctgctgggcaccgaccagtgcgccctgggccccagcttctggtgcagaagccaggaggccgccaagctgtgcaacgccgtgcagcactgccagaagcacgtgtggaaggagatgcacctgcacgccggcgagcacgcctag

SEQ ID NO: 3778 - DNA, 2127 bp, Artificial Sequence
  Description of Artificial Sequence: Synthetic coding sequence
atggccgccgccgccgtggccgccgccgccgccgccgccgccgccgccagcctgcaggtgctggagatggagagcatggagaccgccgccgccggcagcgccggcctggccgccgaggtgagaggcagcggcaccgtggacttcggccccggccccggcatcagcgccatggaggccagcggcggcgaccccggccccgaggccgaggacttcgagtgcagcagccactgcagcgagctgagctggagacagaacgagcagagaagacagggcctgttctgcgacatcaccctgtgcttcggcggcgccggcggcagagagttcagagcccacagaagcgtgctggccgccgccaccgagtacttcacccccctgctgagcggccagttcagcgagagcagaagcggcagagtggagatgagaaagtggagcagcgagcccggccccgagcccgacaccgtggaggccgtgatcgagtacatgtacaccggcagaatcagagtgagcaccggcagcgtgcacgaggtgctggagctggccgacagattcctgctgatcagactgaaggagttctgcggcgagttcctgaagaagaagctgcacctgagcaactgcgtggccatccacagcctggcccacatgtacaccctgagccagctggccctgaaggccgccgacatgatcagaagaaacttccacaaggtgatccaggacgaggagttctacaccctgcccttccacctgatcagagactggctgagcgacctggagatcaccgtggacagcgaggaggtgctgttcgagaccgtgctgaagtgggtgcagagaaacgccgaggagagagagagatacttcgaggagctgttcaagctgctgagactgagccagatgaagcccacctacctgaccagacacgtgaagcccgagagactggtggccaacaacgaggtgtgcgtgaagctggtggccgacgccgtggagagacacgccctgagagccgagaacatccagagcggcacctgccagcaccccaccagccacgtgagcctgctgcccagatacggccagaacatggacgtgatcatggtgatcggcggcgtgagcgagggcggcgactacctgagcgagtgcgtgggctacttcgtggacgaggacagatgggtgaacctgccccacatccacaaccacctggacggccacgccgtggccgtgaccgagagctacgtgtacgtggccggcagcatggagcccggcttcgccaagaccgtggagagatacaaccccaacctgaacacctgggagcacgtgtgcagcctgatgaccagaaagcacagcttcggcctgaccgaggtgaagggcaagctgtacagcatcggcggccacggcaacttcagccccggcttcaaggacgtgaccgtgtacaaccccgagctggacaagtggcacaacctggagagcgcccccaagatcctgagagacgtgaaggccctggccatcgaggacagattcgtgtacatcgccgccagaacccccgtggacagagacaccgaggacggcctgaaggccgtgatcacctgctacgacaccgagaccagacagtggcaggacgtggagagcctgcccctgatcgacaactactgcttcttccagatgagcgtggtgaacagcaacttctaccagaccgccagctgctgccccaagagctactgcctggagaacgaggaggccgtgagaaagatcgccagccaggtgagcgacgagatcctggagagcctgccccccgaggtgctgagcatcgagggcgccgccatctgctactacaaggacgacgtgttcatcatcggcggctggaagaacagcgacgacatcgacaagcagtacagaaaggaggcctacagatactgcgccgagagaaagagatggatgctgctgccccccatgccccagcccagatgcagagccaccgcctgccacgtgagaatcccctacagatacctgcacggcacccagagataccccatgccccagaacctgatgtggcagaaggacagaatcagacagatgcaggagatccacagacacgccctgaacatgagaagagtgcccagcagccagatcgagtgctag

SEQ ID NO: 3779 - DNA, 1578 bp, Artificial Sequence
  Description of Artificial Sequence: Synthetic coding sequence
atgagcggcaactgggtgcaccccggccagatcctgatctgggccatctgggtgctggccgcccccaccaagggccccagcgccgagggcccccagagaaacaccagactgggctggatccagggcaagcaggtgaccgtgctgggcagccccgtgcccgtgaacgtgttcctgggcgtgcccttcgccgccccccccctgggcagcctgagattcaccaacccccagcccgccagcccctgggacaacctgagagaggccaccagctaccccaacctgtgcctgcagaacagcgagtggctgctgctggaccagcacatgctgaaggtgcactaccccaagttcggcgtgagcgaggactgcctgtacctgaacatctacgcccccgcccacgccgacaccggcagcaagctgcccgtgctggtgtggttccccggcggcgccttcaagaccggcagcgccagcatcttcgacggcagcgccctggccgcctacgaggacgtgctggtggtggtggtgcagtacagactgggcatcttcggcttcttcaccacctgggaccagcacgcccccggcaactgggccttcaaggaccaggtggccgccctgagctgggtgcagaagaacatcgagttcttcggcggcgaccccagcagcgtgaccatcttcggcgagagcgccggcgccatcagcgtgagcagcctgatcctgagccccatggccaagggcctgttccacaaggccatcatggagagcggcgtggccatcatcccctacctggaggcccacgactacgagaagagcgaggacctgcaggtggtggcccacttctgcggcaacaacgccagcgacagcgaggccctgctgagatgcctgagaaccaagcccagcaaggagctgctgaccctgagccagaagaccaagagcttcaccagagtggtggacggcgccttcttccccaacgagcccctggacctgctgagccagaaggccttcaaggccatccccagcatcatcggcgtgaacaaccacgagtgcggcttcctgctgcccatgaaggaggcccccgagatcctgagcggcagcaacaagagcctggccctgcacctgatccagaacatcctgcacatccccccccagtacctgcacctggtggccaacgagtacttccacgacaagcacagcctgaccgagatcagagacagcctgctggacctgctgggcgacgtgttcttcgtggtgcccgccctgatcaccgccagataccacagagagggcgccaccgaggaggagaagctgctgagcagaaagatgatgaagtactgggccaccttcgccagaaccggcaaccccaacggcaacgacctgagcctgtggcccgcctacaacctgaccgagcagtacctgcagctggacctgaacatgagcctgggccagagactgaaggagcccagagtggacttctggaccagcaccatccccctgatcctgagcgccagcgacatgctgcacagccccctgagcagcctgaccttcctgagcctgctgcagcccttcttcttcttctgcgccccctag

SEQ ID NO: 3780 - DNA, 900 bp, Artificial Sequence
  Description of Artificial Sequence: Synthetic coding sequence
atggtgagatgcctgggccccgccctgctgctgctgctgctgctgggcagcgccagcagcgtgggcggcaacagatgcgtggacgccgccgaggcctgcaccgccgacgccagatgccagagactgagaagcgagtacgtggcccagtgcctgggcagagccgcccagggcggctgccccagagccagatgcagaagagccctgagaagattcttcgccagaggcccccccgccctgacccacgccctgctgttctgcccctgcgccggccccgcctgcgccgagagaagaagacagaccttcgtgcccagctgcgccttcagcggccccggccccgccccccccagctgcctggagcccctgaacttctgcgagagaagcagagtgtgcagatgcgccagagccgccgccggcccctggagaggctggggcagaggcctgagccccgcccacagaccccccgccgcccaggccagcccccccggcctgagcggcctggtgcaccccagcgcccagagacccagaagactgcccgccggccccggcagacccctgcccgccagactgagaggccccagaggcgtgcccgccggcaccgccgtgacccccaactacgtggacaacgtgagcgccagagtggccccctggtgcgactgcggcgccagcggcaacagaagagaggactgcgaggccttcagaggcctgttcaccagaaacagatgcctggacggcgccatccaggccttcgccagcggctggccccccgtgctgctggaccagctgaacccccagggcgaccccgagcacagcctgctgcaggtgagcagcaccggcagagccctggagagaagaagcctgctgagcatcctgcccgtgctggccctgcccgccctgctgtag

SEQ ID NO: 3781 - DNA, 270 bp, Artificial Sequence
  Description of Artificial Sequence: Synthetic coding sequence
atgcaggcctgcatggtgcccggcctggccctgtgcctgctgctgggccccctggccggcgccaagcccgtgcaggaggagggcgacccctacgccgagctgcccgccatgccctactggcccttcagcaccagcgacttctggaactacgtgcagcacttccaggccctgggcgcctacccccagatcgaggacatggccagaaccttcttcgcccacttccccctgggcagcaccctgggcttccacgtgccctaccaggaggactag

SEQ ID NO: 3782 - DNA, 663 bp, Artificial Sequence
  Description of Artificial Sequence: Synthetic coding sequence
atggccagcgagagactgcccaacagacccgcctgcctgctggtggccagcggcgccgccgagggcgtgagcgcccagagcttcctgcactgcttcaccatggccagcaccgccttcaacctgcaggtggccacccccggcggcaaggccatggagttcgtggacgtgaccgagagcaacgccagatgggtgcaggacttcagactgaaggcctacgccagccccgccaagctggagagcatcgacggcgccagataccacgccctgctgatccccagctgccccggcgccctgaccgacctggccagcagcggcagcctggccagaatcctgcagcacttccacagcgagagcaagcccatctgcgccgtgggccacggcgtggccgccctgtgctgcgccaccaacgaggacagaagctgggtgttcgacagctacagcctgaccggccccagcgtgtgcgagctggtgagagcccccggcttcgccagactgcccctggtggtggaggacttcgtgaaggacagcggcgcctgcttcagcgccagcgagcccgacgccgtgcacgtggtgctggacagacacctggtgaccggccagaacgccagcagcaccgtgcccgccgtgcagaacctgctgttcctgtgcggcagcagaaagtag

SEQ ID NO: 3783 - DNA, 1158 bp, Artificial Sequence
  Description of Artificial Sequence: Synthetic coding sequence
atgtggggcttcagactgctgagaagcccccccctgctgctgctgctgccccagctgggcatcggcaacgccagcagctgcagccaggccagaaccatgaaccccggcggcagcggcggcgccagatgcagcctgagcgccgaggtgagaagaagacagtgcctgcagctgagcaccgtgcccggcgccgacccccagagaagcaacgagctgctgctgctggccgccgccggcgagggcctggagagacaggacctgcccggcgaccccgccaaggaggagccccagccccccccccagcaccacgtgctgtacttccccggcgacgtgcagaactaccacgagatcatgaccagacaccccgagaactaccagtgggagaactggagcctggagaacgtggccaccatcctggcccacagattccccaacagctacatctgggtgatcaagtgcagcagaatgcacctgcacaagttcagctgctacgacaacttcgtgaagagcaacatgttcggcgcccccgagcacaacaccgacttcggcgccttcaagcacctgtacatgctgctggtgaacgccttcaacctgagccagaacagcctgagcaagaagagcctgaacgtgtggaacaaggacagcatcgccagcaactgcagaagcagccccagccacaccaccaacggctgccagggcgagaaggtgagaacctgcgagaagagcgacgagagcgccatgagcttctacccccccagcctgaacgacgccagcttcaccctgatcggcttcagcaagggctgcgtggtgctgaaccagctgctgttcgagctgaaggaggccaagaaggacaagaacatcgacgccttcatcaagagcatcagaaccatgtactggctggacggcggccacagcggcggcagcaacacctgggtgacctaccccgaggtgctgaaggagttcgcccagaccggcatcatcgtgcacacccacgtgaccccctaccaggtgagagaccccatgagaagctggatcggcaaggagcacaagaagttcgtgcagatcctgggcgacctgggcatgcaggtgaccagccagatccacttcaccaaggaggcccccagcatcgagaaccacttcagagtgcacgaggtgttctag

SEQ ID NO: 3784 - DNA, 936 bp, Artificial Sequence
  Description of Artificial Sequence: Synthetic coding sequence
atgagaggcgccgccagagccgcctggggcagagccggccagccctggcccagaccccccgcccccggccccccccccccccccctgcccctgctgctgctgctgctggccggcctgctgggcggcgccggcgcccagtacagcagcgacagatgcagctggaagggcagcggcctgacccacgaggcccacagaaaggaggtggagcaggtgtacctgagatgcgccgccggcgccgtggagtggatgtaccccaccggcgccctgatcgtgaacctgagacccaacaccttcagccccgccagacacctgaccgtgtgcatcagaagcttcaccgacagcagcggcgccaacatctacctggagaagaccggcgagctgagactgctggtgcccgacggcgacggcagacccggcagagtgcagtgcttcggcctggagcagggcggcctgttcgtggaggccaccccccagcaggacatcggcagaagaaccaccggcttccagtacgagctggtgagaagacacagagccagcgacctgcacgagctgagcgccccctgcagaccctgcagcgacaccgaggtgctgctggccgtgtgcaccagcgacttcgccgtgagaggcagcatccagcaggtgacccacgagcccgagagacaggacagcgccatccacctgagagtgagcagactgtacagacagaagagcagagtgttcgagcccgtgcccgagggcgacggccactggcagggcagagtgagaaccctgctggagtgcggcgtgagacccggccacggcgacttcctgttcaccggccacatgcacttcggcgaggccagactgggctgcgcccccagattcaaggacttccagagaatgtacagagacgcccaggagagaggcctgaacccctgcgaggtgggcaccgactag

SEQ ID NO: 3785 - DNA, 1221 bp, Artificial Sequence
  Description of Artificial Sequence: Synthetic coding sequence
atgggccccagcacccccctgctgatcctgttcctgctgagctggagcggccccctgcagggccagcagcaccacctggtggagtacatggagagaagactggccgccctggaggagagactggcccagtgccaggaccagagcagcagacacgccgccgagctgagagacttcaagaacaagatgctgcccctgctggaggtggccgagaaggagagagaggccctgagaaccgaggccgacaccatcagcggcagagtggacagactggagagagaggtggactacctggagacccagaaccccgccctgccctgcgtggagttcgacgagaaggtgaccggcggccccggcaccaagggcaagggcagaagaaacgagaagtacgacatggtgaccgactgcggctacaccatcagccaggtgagaagcatgaagatcctgaagagattcggcggccccgccggcctgtggaccaaggaccccctgggccagaccgagaagatctacgtgctggacggcacccagaacgacaccgccttcgtgttccccagactgagagacttcaccctggccatggccgccagaaaggccagcagagtgagagtgcccttcccctgggtgggcaccggccagctggtgtacggcggcttcctgtacttcgccagaagaccccccggcagacccggcggcggcggcgagatggagaacaccctgcagctgatcaagttccacctggccaacagaaccgtggtggacagcagcgtgttccccgccgagggcctgatccccccctacggcctgaccgccgacacctacatcgacctggccgccgacgaggagggcctgtgggccgtgtacgccaccagagaggacgacagacacctgtgcctggccaagctggacccccagaccctggacaccgagcagcagtgggacaccccctgccccagagagaacgccgaggccgccttcgtgatctgcggcaccctgtacgtggtgtacaacaccagacccgccagcagagccagaatccagtgcagcttcgacgccagcggcaccctgacccccgagagagccgccctgccctacttccccagaagatacggcgcccacgccagcctgagatacaaccccagagagagacagctgtacgcctgggacgacggctaccagatcgtgtacaagctggagatgagaaagaaggaggaggaggtgtag

SEQ ID NO: 3786 - DNA, 900 bp, Artificial Sequence
  Description of Artificial Sequence: Synthetic coding sequence
atgggcggccccagagccctgctggccgccctgtgggccctggaggccgccggcaccgccgccctgagaatcggcgccttcaacatccagagcttcggcgacagcaaggtgagcgaccccgcctgcggcagcatcatcgccaagatcctggccggctacgacctggccctggtgcaggaggtgagagaccccgacctgagcgccgtgagcgccctgatggagcagatcaacagcgtgagcgagcacgagtacagcttcgtgagcagccagcccctgggcagagaccagtacaaggagatgtacctgttcgtgtacagaaaggacgccgtgagcgtggtggacacctacctgtaccccgaccccgaggacgtgttcagcagagagcccttcgtggtgaagttcagcgcccccggcaccggcgagagagccccccccctgcccagcagaagagccctgacccccccccccctgcccgccgccgcccagaacctggtgctgatccccctgcacgccgccccccaccaggccgtggccgagatcgacgccctgtacgacgtgtacctggacgtgatcgacaagtggggcaccgacgacatgctgttcctgggcgacttcaacgccgactgcagctacgtgagagcccaggactgggccgccatcagactgagaagcagcgaggtgttcaagtggctgatccccgacagcgccgacaccaccgtgggcaacagcgactgcgcctacgacagaatcgtggcctgcggcgccagactgagaagaagcctgaagccccagagcgccaccgtgcacgacttccaggaggagttcggcctggaccagacccaggccctggccatcagcgaccacttccccgtggaggtgaccctgaagttccacagatag

SEQ ID NO: 3787 - DNA, 1617 bp, Artificial Sequence
  Description of Artificial Sequence: Synthetic coding sequence
atgggctgcctgtggggcctggccctgcccctgttcttcttctgctgggaggtgggcgtgagcggcagcagcgccggccccagcaccagaagagccgacaccgccatgaccaccgacgacaccgaggtgcccgccatgaccctggcccccggccacgccgccctggagacccagaccctgagcgccgagaccagcagcagagccagcacccccgccggccccatccccgaggccgagaccagaggcgccaagagaatcagccccgccagagagaccagaagcttcaccaagaccagccccaacttcatggtgctgatcgccaccagcgtggagaccagcgccgccagcggcagccccgagggcgccggcatgaccaccgtgcagaccatcaccggcagcgaccccagagaggccatcttcgacaccctgtgcaccgacgacagcagcgaggaggccaagaccctgaccatggacatcctgaccctggcccacaccagcaccgaggccaagggcctgagcagcgagagcagcgccagcagcgacagcccccaccccgtgatcacccccagcagagccagcgagagcagcgccagcagcgacggcccccaccccgtgatcacccccagcagagccagcgagagcagcgccagcagcgacggcccccaccccgtgatcacccccagctggagccccggcagcgacgtgaccctgctggccgaggccctggtgaccgtgaccaacatcgaggtgatcaactgcagcatcaccgagatcgagaccaccaccagcagcatccccggcgccagcgacaccgacctgatccccaccgagggcgtgaaggccagcagcaccagcgacccccccgccctgcccgacagcaccgaggccaagccccacatcaccgaggtgaccgccagcgccgagaccctgagcaccgccggcaccaccgagagcgccgcccccgacgccaccgtgggcacccccctgcccaccaacagcgccaccgagagagaggtgaccgcccccggcgccaccaccctgagcggcgccctggtgaccgtgagcagaaaccccctggaggagaccagcgccctgagcgtggagacccccagctacgtgaaggtgagcggcgccgcccccgtgagcatcgaggccggcagcgccgtgggcaagaccaccagcttcgccggcagcagcgccagcagctacagccccagcgaggccgccctgaagaacttcacccccagcgagacccccaccatggacatcgccaccaagggccccttccccaccagcagagaccccctgcccagcgtgccccccaccaccaccaacagcagcagaggcaccaacagcaccctggccaagatcaccaccagcgccaagaccaccatgaagccccccaccgccacccccaccaccgccagaaccagacccaccaccgacgtgagcgccggcgagaacggcggcttcctgctgctgagactgagcgtggccagccccgaggacctgaccgaccccagagtggccgagagactgatgcagcagctgcacagagagctgcacgcccacgccccccacttccaggtgagcctgctgagagtgagaagaggctag

SEQ ID NO: 3788 - DNA, 975 bp, Artificial Sequence
  Description of Artificial Sequence: Synthetic coding sequence
atgagcagcgaggccgagacccagcagccccccgccgccccccccgccgcccccgccctgagcgccgccgacaccaagcccggcaccaccggcagcggcgccggcagcggcggccccggcggcctgaccagcgccgcccccgccggcggcgacaagaaggtgatcgccaccaaggtgctgggcaccgtgaagtggttcaacgtgagaaacggctacggcttcatcaacagaaacgacaccaaggaggacgtgttcgtgcaccagaccgccatcaagaagaacaaccccagaaagtacctgagaagcgtgggcgacggcgagaccgtggagttcgacgtggtggagggcgagaagggcgccgaggccgccaacgtgaccggccccggcggcgtgcccgtgcagggcagcaagtacgccgccgacagaaaccactacagaagataccccagaagaagaggcccccccagaaactaccagcagaactaccagaacagcgagagcggcgagaagaacgagggcagcgagagcgcccccgagggccaggcccagcagagaagaccctacagaagaagaagattccccccctactacatgagaagaccctacggcagaagaccccagtacagcaacccccccgtgcagggcgaggtgatggagggcgccgacaaccagggcgccggcgagcagggcagacccgtgagacagaacatgtacagaggctacagacccagattcagaagaggcccccccagacagagacagcccagagaggacggcaacgaggaggacaaggagaaccagggcgacgagacccagggccagcagcccccccagagaagatacagaagaaacttcaactacagaagaagaagacccgagaaccccaagccccaggacggcaaggagaccaaggccgccgacccccccgccgagaacagcagcgcccccgaggccgagcagggcggcgccgagtag

SEQ ID NO: 3789 - DNA, 210 bp, Artificial Sequence
  Description of Artificial Sequence: Synthetic coding sequence
atgagaatcttctactacctgcacttcctgtgctacgtgaccttcatcctgcccgccacctgcaccctggtgaacgccgacagatgcaccaagagatacggcagatgcaagagagactgcctggagagcgagaagcagatcgacatctgcagcctgcccagaaagatctgctgcaccgagaagctgtacgaggaggacgacatgttctag

SEQ ID NO: 3790 - DNA, 342 bp, Artificial Sequence
  Description of Artificial Sequence: Synthetic coding sequence
atgaagctgctgaccaccatctgcagactgaagctggagaagatgtacagcaagaccaacaccagcagcaccatcttcgagaaggccagacacggcaccgagaagatcagcaccgccagaagcgagggccaccacatcaccttcagcagatggaagagctgcaccgccatcggcggcagatgcaagaaccagtgcgacgacagcgagttcagaatcagctactgcgccagacccaccacccactgctgcgtgaccgagtgcgaccccaccgaccccaacaactggatccccaaggacagcgtgggcacccaggagtggtaccccaaggacagcagacactag

SEQ ID NO: 3791 - DNA, 3030 bp, Artificial Sequence
  Description of Artificial Sequence: Synthetic coding sequence
atggacctgatcagaggcgtgctgctgagactgctgctgctggccagcagcctgggccccggcgccgtgagcctgagagccgccatcagaaagcccggcaaggtgggcccccccctggacatcaagctgggcgccctgaactgcaccgccttcagcatccagtggaagatgcccagacaccccggcagccccatcctgggctacaccgtgttctacagcgaggtgggcgccgacaagagcctgcaggagcagctgcacagcgtgcccctgagcagagacatccccaccaccgaggaggtgatcggcgacctgaagcccggcaccgagtacagagtgagcatcgccgcctacagccaggccggcaagggcagactgagcagccccagacacgtgaccaccctgagccaggacagctgcctgccccccgccgccccccagcagccccacgtgatcgtggtgagcgacagcgaggtggccctgagctggaagcccggcgccagcgagggcagcgcccccatccagtactacagcgtggagttcatcagacccgacttcgacaagaagtggaccagcatccacgagagaatccagatggacagcatggtgatcaagggcctggaccccgacaccaactaccagttcgccgtgagagccatgaacagccacggccccagccccagaagctggcccagcgacatcatcagaaccctgtgccccgaggaggccggcagcggcagatacggccccagatacatcaccgacatgggcgccggcgaggacgacgagggcttcgaggacgacctggacctggacatcagcttcgaggaggtgaagcccctgcccgccaccaagggcggcaacaagaagttcctggtggagagcaagaagatgagcatcagcaaccccaagaccatcagcagactgatcccccccaccagcgccagcctgcccgtgaccaccgtggccccccagcccatccccatccagagaaagggcaagaacggcgtggccatcatgagcagactgttcgacatgccctgcgacgagaccctgtgcagcgccgacagcttctgcgtgaacgactacacctggggcggcagcagatgccagtgcaccctgggcaagggcggcgagagctgcagcgaggacatcgtgatccagtacccccagttcttcggccacagctacgtgaccttcgagcccctgaagaacagctaccaggccttccagatcaccctggagttcagagccgaggccgaggacggcctgctgctgtactgcggcgagaacgagcacggcagaggcgacttcatgagcctggccatcatcagaagaagcctgcagttcagattcaactgcggcaccggcgtggccatcatcgtgagcgagaccaagatcaagctgggcggctggcacaccgtgatgctgtacagagacggcctgaacggcctgctgcagctgaacaacggcacccccgtgaccggccagagccagggccagtacagcaagatcaccttcagaacccccctgtacctgggcggcgcccccagcgcctactggctggtgagagccaccggcaccaacagaggcttccagggctgcgtgcagagcctggccgtgaacggcagaagaatcgacatgagaccctggcccctgggcaaggccctgagcggcgccgacgtgggcgagtgcagcagcggcatctgcgacgaggccagctgcatccacggcggcacctgcaccgccatcaaggccgacagctacatctgcctgtgccccctgggcttcaagggcagacactgcgaggacgccttcaccctgaccatcccccagttcagagagagcctgagaagctacgccgccaccccctggcccctggagccccagcactacctgagcttcatggagttcgagatcaccttcagacccgacagcggcgacggcgtgctgctgtacagctacgacaccggcagcaaggacttcctgagcatcaacctggccggcggccacgtggagttcagattcgactgcggcagcggcaccggcgtgctgagaagcgaggaccccctgaccctgggcaactggcacgagctgagagtgagcagaaccgccaagaacggcatcctgcaggtggacaagcagaagatcgtggagggcatggccgagggcggcttcacccagatcaagtgcaacaccgacatcttcatcggcggcgtgcccaactacgacgacgtgaagaagaacagcggcgtgctgaagcccttcagcggcagcatccagaagatcatcctgaacgacagaaccatccacgtgaagcacgacttcaccagcggcgtgaacgtggagaacgccgcccacccctgcgtgagagccccctgcgcccacggcggcagctgcagacccagaaaggagggctacgactgcgactgccccctgggcttcgagggcctgcactgccagaaggccatcatcgaggccatcgagatcccccagttcatcggcagaagctacctgacctacgacaaccccgacatcctgaagagagtgagcggcagcagaagcaacgtgttcatgagattcaagaccaccgccaaggacggcctgctgctgtggagaggcgacagccccatgagacccaacagcgacttcatcagcctgggcctgagagacggcgccctggtgttcagctacaacctgggcagcggcgtggccagcatcatggtgaacggcagcttcaacgacggcagatggcacagagtgaaggccgtgagagacggccagagcggcaagatcaccgtggacgactacggcgccagaaccggcaagagccccggcatgatgagacagctgaacatcaacggcgccctgtacgtgggcggcatgaaggagatcgccctgcacaccaacagacagtacatgagaggcctggtgggctgcatcagccacttcaccctgagcaccgactaccacatcagcctggtggaggacgccgtggacggcaagaacatcaacacctgcggcgccaagtag

SEQ ID NO: 3792 - DNA, 1272 bp, Artificial Sequence
  Description of Artificial Sequence: Synthetic coding sequence
atgagcgtgagaggcatcctgagactgggcacccaggagtaccccagccccctggaccccgaggtgggcccctactgcgacacccccaccatgagaaccctgttcaacctgctgtggctggccctggcctgcagccccgtgcacaccaccctgagcaagagcgacgccaagaaggccgccagcaagaccctgctggagaagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctacgtgaccccctggaacagccacggctacgacgtgaccaaggtgttcggcagcaagttcacccagatcagccccgtgtggctgcagctgaagagaagaggcagagagatgttcgaggtgaccggcctgcacgacgtggaccagggctggatgagagccgtgagaaagcacgccaagggcctgcacatcgtgcccagactgctgttcgaggactggacctacgacgacttcagaaacgtgctggacagcgaggacgagatcgaggagctgagcaagaccgtggtgcaggtggccaagaaccagcacttcgacggcttcgtggtggaggtgtggaaccagctgctgagccagaagagagtgggcctgatccacatgctgacccacctggccgaggccctgcaccaggccagactgctggccctgctggtgatcccccccgccatcacccccggcaccgaccagctgggcatgttcacccacaaggagttcgagcagctggcccccgtgctggacggcttcagcctgatgacctacgactacagcaccgcccaccagcccggccccaacgcccccctgagctgggtgagagcctgcgtgcaggtgctggaccccaagagcaagtggagaagcaagatcctgctgggcctgaacttctacggcatggactacgccaccagcaaggacgccagagagcccgtggtgggcgccagatacatccagaccctgaaggaccacagacccagaatggtgtgggacagccaggccagcgagcacttcttcgagtacaagaagagcagaagcggcagacacgtggtgttctaccccaccctgaagagcctgcaggtgagactggagctggccagagagctgggcgtgggcgtgagcatctgggagctgggccagggcctggactacttctacgacctgctgtag

SEQ ID NO: 3793 - DNA, 1182 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctacgtgaccccctggaacagccacggctacgacgtgaccaaggtgttcggcagcaagttcacccagatcagccccgtgtggctgcagctgaagagaagaggcagagagatgttcgaggtgaccggcctgcacgacgtggaccagggctggatgagagccgtgagaaagcacgccaagggcctgcacatcgtgcccagactgctgttcgaggactggacctacgacgacttcagaaacgtgctggacagcgaggacgagatcgaggagctgagcaagaccgtggtgcaggtggccaagaaccagcacttcgacggcttcgtggtggaggtgtggaaccagctgctgagccagaagagagtgggcctgatccacatgctgacccacctggccgaggccctgcaccaggccagactgctggccctgctggtgatcccccccgccatcacccccggcaccgaccagctgggcatgttcacccacaaggagttcgagcagctggcccccgtgctggacggcttcagcctgatgacctacgactacagcaccgcccaccagcccggccccaacgcccccctgagctgggtgagagcctgcgtgcaggtgctggaccccaagagcaagtggagaagcaagatcctgctgggcctgaacttctacggcatggactacgccaccagcaaggacgccagagagcccgtggtgggcgccagatacatccagaccctgaaggaccacagacccagaatggtgtgggacagccaggccagcgagcacttcttcgagtacaagaagagcagaagcggcagacacgtggtgttctaccccaccctgaagagcctgcaggtgagactggagctggccagagagctgggcgtgggcgtgagcatctgggagctgggccagggcctggactacttctacgacctgctgtag

SEQ ID NO: 3794 - DNA, 1959 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacgcccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacagactggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagctacctggacctgaacttcgagatcagcttcggcggcatccccacccccggcagaagcagagccttcagaagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgagaagaggcagcggcagcttcgtgctgttcctgaaggacggcaagctgaagctgagcctgttccagcccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcgccctgtacgagcagagctgcgaggcccacaagcacagaggcaaccccagcggcctgtactacatcgacgccgacggcagcggccccctgggccccttcctggtgtactgcaacatgaccgacgccgcctggaccgtggtgcagcacggcggccccgacgccgtgaccctgagaggcgcccccagcggccaccccagaagcgccgtgagcttcgcctacgccgccggcgccggccagctgagaagcgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggcagaaacgagtggtag

SEQ ID NO: 3795 - DNA, 1455 bp, Artificial Sequence
  Description of Artificial Sequence: Synthetic coding sequence
atgtggtacgtgagcaccagaggcgtggcccccagagtgaacttcgagggcgccctgttcagcggctacgcccccgacggcggcctgttcatgcccgaggagctgccccagctggacagaggcaccctgtgccagtggagcaccctgagctaccccggcctggtgaaggagctgtgcgccctgttcatcggcagcgagctgctgcccaaggacgagctgaacgacctgatcgacagagccttcagcagattcagacacagagaggtggtgcacctgagcagactgagaaacggcctgaacgtgctggagctgtggcacggcgtgacctacgccttcaaggacctgagcctgagctgcaccacccagttcctgcagtacttcctggagaagagagagaagcacgtgaccgtggtggtgggcaccagcggcgacaccggcagcgccgccatcgagagcgtgcagggcgccaagaacatggacatcatcgtgctgctgcccaagggccactgcaccaagatccaggagctgcagatgaccaccgtgctgaagcagaacgtgcacgtgttcggcgtggagggcaacagcgacgagctggacgagcccatcaagaccgtgttcgccgacgtggccttcgtgaagaagcacaacctgatgagcctgaacagcatcaactggagcagagtgctggtgcagatggcccaccacttcttcgcctacttccagtgcacccccagcctggacacccaccccctgcccctggtggaggtggtggtgcccaccggcgccgccggcaacctggccgccggctacatcgcccagaagatcggcctgcccatcagactggtggtggccgtgaacagaaacgacatcatccacagaaccgtgcagcagggcgacttcagcctgagcgaggccgtgaagagcaccctggccagcgccatggacatccaggtgccctacaacatggagagagtgttctggctgctgagcggcagcgacagccaggtgaccagagccctgatggagcagttcgagagaacccagagcgtgaacctgcccaaggagctgcacagcaagctgagcgaggccgtgaccagcgtgagcgtgagcgacgaggccatcacccagaccatgggcagatgctgggacgagaaccagtacctgctgtgcccccacagcgccgtggccgtgaactaccactaccagcagatcgacagacagcagcccagcacccccagatgctgcctggcccccgccagcgccgccaagttccccgaggccgtgctggccgccggcctgacccccgagacccccgccgagatcgtggccctggagcacaaggagaccagatgcaccctgatgagaagaggcgacaactggatgctgatgctgagagacaccatcgaggacctgagcagacagtggagaagccacgccctgaacaccagccagtag

SEQ ID NO: 3796 - DNA, 264 bp, Artificial Sequence
  Description of Artificial Sequence: Synthetic coding sequence
atggtgagcctgatgaagctgtggatccccatgctgatgaccttcttctgcaccgtgctgctgagcgtgctgggcgagatgagaaagaagagatacgacagaaaggagctgctgctggaggagtgctggggcaagcccaacgtgaaggagtgcaccaacaagtgcagcaaggccttcagatgcaaggacaagaactacacctgctgctggacctactgcggcaacatctgctggatcaacgtggagaccagcggcgactactag

SEQ ID NO: 3797 - DNA, 453 bp, Artificial Sequence
  Description of Artificial Sequence: Synthetic coding sequence
atgagattcatggccggccccgccggcagccagagcctgggccccctgtgcttccacagcagcccccaggccctgtacaccgtgctgctgatcgtgctggtgatgatgagcctggtgttcggcaagttcgtgcccgtgaactgggagcccccccagcccctgcccttccccaagtacctgagatgctacagatgcctgctggagaccaaggagctgggctgcctgctgggcagcgacatctgcctgacccccgccggcagcagctgcatcaccctgcacaagaagaacagcagcggcagcgacgtgatggtgagcgactgcagaagcaaggagcagatgagcgactgcagcaacaccagaaccagccccgtgagcggcttctggatcttcagccagtactgcttcctggacttctgcaacgacccccagaacagaggcctgtacaccccctag

SEQ ID NO: 3798 - DNA, 873 bp, Artificial Sequence
  Description of Artificial Sequence: Synthetic coding sequence
atgagcgtgagaagaggcagaagacccgccagacccggcaccagactgagctggctgctgtgctgcagcgccctgctgagccccgccgccggctacgtgatcgtgagcagcgtgagctgggccgtgaccaacgaggtggacgaggagctggacagcgccagcaccgaggaggccatgcccgccctgctggaggacagcggcagcatctggcagcagagcttccccgccagcgcccacaaggaggacgcccacctgagacccagagccggcgccgccagagccagacccccccccgccccccccggcatgttcagctacagaagagagggcggccagaccgccagcgccccccccggccccagactgagagccgccaccgccagaagcctggcccacgccagcgtgtggggctgcctggccaccgtgagcacccacaagaagatccagggcctgcccttcggcaactgcctgcccgtgagcgacggccccttcaacaacagcaccggcatccccttcttctacatgaccgccaaggaccccgtggtggccgacctgatgaagaaccccatggccagcctgatgctgcccgagagcgagggcgagttctgcagaaagaacatcgtggaccccgaggaccccagatgcgtgcagctgaccctgaccggccagatgatcgccgtgagccccgaggaggtggagttcgccaagcaggccatgttcagcagacaccccggcatgagaaagtggcccagacagtacgagtggttcttcatgaagatgagaatcgagcacatctggctgcagaagtggtacggcggcgccagcagcatcagcagagaggagtacttcaaggccgtgcccagaaaggcctag

SEQ ID NO: 3799 - DNA, 2742 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctacgtggagatggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggccgagagaagagtgctggaggaggagctgaccgtgcacctgagcgtgcccggcgacaccatcctgatcaacaacagacccggccccagagagccccccccctaccaggagcccagacccagaggcaaccccccccacagcgccccctgcgtgcccaacggcagcgccctgctgctgagcaaccccgcctacagactgctgctggccacctacgccagaccccccagaggccccggcccccccacccccgcctgggccaagcccaccaacacccaggcctacagcggcgactacatggagcccgagaagcccggcgcccccctgctgcccccccccccccagaacagcgtgccccactacgccgaggccgacatcgtgaccctgcagggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaacttcgtgcacagagacctggccaccagaaactgcctggtgggcgagaacttcaccatcaagatcgccgacttcggcatgagcagaaacctgtacgccggcgactactacagagtgcagggcagagccgtgctgcccatcagatggatggcctgggagtgcatcctgatgggcaagttcaccaccgccagcgacgtgtgggccttcggcgtgaccctgtgggaggtgctgatgctgtgcagagcccagcccttcggccagctgaccgacgagcaggtgatcgagaacgccggcgagttcttcagagaccagggcagacaggtgtacctgagcagaccccccgcctgcccccagggcctgtacgagctgatgctgagatgctggagcagagagagcgagcagagaccccccttcagccagctgcacagattcctggccgaggacgccctgaacaccgtgtag

SEQ ID NO: 3800 - DNA, 243 bp, Artificial Sequence
  Description of Artificial Sequence: Synthetic coding sequence
atgaagctgagcggcatgttcctgctgctgagcctggccctgttctgcttcctgaccggcgtgttcagccagggcggccaggtggactgcggcgagttccaggaccccaaggtgtactgcaccagagagagcaacccccactgcggcagcgacggccagacctacggcaacaagtgcgccttctgcaaggccatcgtgaagagcggcggcaagatcagcctgaagcaccccggcaagtgctag

SEQ ID NO: 3801 - DNA, 270 bp, Artificial Sequence
  Description of Artificial Sequence: Synthetic coding sequence
atgaagccctggatcctgctgctggtgatgttcatcagcggcgtggtgatgctgctgcccgtgctgggcagcttctggaacaaggaccccttcctggacatgatcagagagaccgagcagtgctgggtgcagcccccctacaagtactgcgagaagagatgcaccaagatcatgacctgcgtgagacccaaccacacctgctgctggacctactgcggcaacatctgcctggacaacgaggagcccctgaagagcatgctgaacccctag

SEQ ID NO: 3802 - DNA, 264 bp, Artificial Sequence
  Description of Artificial Sequence: Synthetic coding sequence
atgctgccctgcctggccctgctgctgctgatggagctgagcgtgtgcaccgtggccggcgacggcggcgaggagcagaccctgagcaccgaggccgagacctgggagggcgccggccccagcatccagctgcagctgcaggaggtgaagaccggcaaggccagccagttcttcggcctgatgggcaagagagtgggcggcagacccctgatccagcccagaagaaagaagggcagagaggacgaggcccagggcagcgagtag

SEQ ID NO: 3803 - DNA, 285 bp, Artificial Sequence
  Description of Artificial Sequence: Synthetic coding sequence
atgcagcacagcctggtgttcttcttcgccgtgatcctgcacctgagccacctgctgcacctggacgccagcatccaccccttcagactgcccttcagcagcaagcccttcctgctgatccccatgagcaacaccaccctgccccacaccgcctggcccctgagcttcctgcaccagaccgtgagcaccctgaaggccgtggccgtgacccacagcctgtggcacctgcagatccccgtggactgccaggcctgcaacagaaagagcaagaagatctactgctag

SEQ ID NO: 3804 - DNA, 327 bp, Artificial Sequence
  Description of Artificial Sequence: Synthetic coding sequence
atgagacagagactgctgcccagcgtgaccagcctgctgctggtggccctgctgttccccggcagcagccaggccagacacgtgaaccacagcgccaccgaggccctgggcgagctgagagagagagcccccggccagggcaccaacggcttccagctgctgagacacgccgtgaagagagacctgctgccccccagaacccccccctaccagggcgacgtgcccctgggcatcagaaacaccatctgcagaatgcagcagggcatctgcagactgttcttctgccacagcggcaccggccagcagcacagacagagatgcggctag

SEQ ID NO: 3805 - DNA, 807 bp, Artificial Sequence
  Description of Artificial Sequence: Synthetic coding sequence
atgctgctgctggccgccgccttcctggtggccttcgtgctgctgctgtacatggtgagccccctgatcagccccaagcccctggccctgcccggcgcccacgtggtggtgaccggcggcagcagcggcatcggcaagtgcatcgccatcgagtgctacaagcagggcgccttcatcaccctggtggccagaaacgaggacaagctgctgcaggccaagaaggagatcgagatgcacagcatcaacgacaagcaggtggtgctgtgcatcagcgtggacgtgagccaggactacaaccaggtggagaacgtgatcaagcaggcccaggagaagctgggccccgtggacatgctggtgaactgcgccggcatggccgtgagcggcaagttcgaggacctggaggtgagcaccttcgaggtgaagccctacaacgtgtacatcaccgtggcctacccccccgacaccgacacccccggcttcgccgaggagaacagaaccaagcccctggagaccagactgatcagcgagaccaccagcgtgtgcaagcccgagcaggtggccaagcagatcgtgaaggacgccatccagggcaacttcaacagcagcctgggcagcgacggctacatgctgagcgccctgacctgcggcatggcccccgtgaccagcatcaccgagggcctgcagcaggtggtgaccatgggcctgttcagaaccatcgccctgttctacctgggcagcttcgacagcatcgtgagaagatgcatgatgcagagagagaagagcgagaacgccgacaagaccgcctag

SEQ ID NO: 3806 - DNA, 1686 bp, Artificial Sequence
  Description of Artificial Sequence: Synthetic coding sequence
atgagatggatcctgtgctggagcctgaccctgtgcctgatggcccagaccgccctgggcgccctgcacaccaagagaccccaggtggtgaccaagtacggcaccctgcagggcaagcagatgcacgtgggcaagacccccatccaggtgttcctgggcgtgcccttcagcagaccccccctgggcatcctgagattcgccccccccgagccccccgagccctggaagggcatcagagacgccaccacctacccccccggctgcctgcaggagagctggggccagctggccagcatgtacgtgagcaccagagagagatacaagtggctgagattcagcgaggactgcctgtacctgaacgtgtacgcccccgccagagcccccggcgacccccagctgcccgtgatggtgtggttccccggcggcgccttcatcgtgggcgccgccagcagctacgagggcagcgacctggccgccagagagaaggtggtgctggtgttcctgcagcacagactgggcatcttcggcttcctgagcaccgacgacagccacgccagaggcaactggggcctgctggaccagatggccgccctgagatgggtgcaggagaacatcgccgccttcggcggcgaccccggcaacgtgaccctgttcggccagagcgccggcgccatgagcatcagcggcctgatgatgagccccctggccagcggcctgttccacagagccatcagccagagcggcaccgccctgttcagactgttcatcaccagcaaccccctgaaggtggccaagaaggtggcccacctggccggctgcaaccacaacagcacccagatcctggtgaactgcctgagagccctgagcggcaccaaggtgatgagagtgagcaacaagatgagattcctgcagctgaacttccagagagaccccgaggagatcatctggagcatgagccccgtggtggacggcgtggtgatccccgacgaccccctggtgctgctgacccagggcaaggtgagcagcgtgccctacctgctgggcgtgaacaacctggagttcaactggctgctgccctacatcatgaagttccccctgaacagacaggccatgagaaaggagaccatcaccaagatgctgtggagcaccagaaccctgctgaacatcaccaaggagcaggtgcccctggtggtggaggagtacctggacaacgtgaacgagcacgactggaagatgctgagaaacagaatgatggacatcgtgcaggacgccaccttcgtgtacgccaccctgcagaccgcccactaccacagagacgccggcctgcccgtgtacctgtacgagttcgagcaccacgccagaggcatcatcgtgaagcccagaaccgacggcgccgaccacggcgacgagatgtacttcctgttcggcggccccttcgccaccggcctgagcatgggcaaggagaaggccctgagcctgcagatgatgaagtactgggccaacttcgccagaaccggcaaccccaacgacggcaacctgccctgctggcccagatacaacaaggacgagaagtacctgcagctggacttcaccaccagagtgggcatgaagctgaaggagaagaagatggccttctggatgagcctgtaccagagccagagacccgagaagcagagacagttctag

SEQ ID NO: 3807 - DNA, 444 bp, Artificial Sequence
  Description of Artificial Sequence: Synthetic coding sequence
atggccagcagcctgaagatctggggcaccctgctggccctgctgtgcatcctgtgcaccctgctggtgcagagcaaggaggtgagctggagagagttcatgaagcagcactacctgagccccagcagagagttcagagagtacaagtgcgacgtgctgatgagagagaacgaggccctgaaggacaagagcagccacatgttcatctacatcagctggtacaagatcgagcacatctgcaccagcgacaactggatggacagattcagaaacgcctacgtgtgggtgcagaaccccctgaaggtgctgaagtgccaccaggagaacagcaagaacagctacaccgagagcagaagcttcaactacatcgagttccactgcagcatggacggctacgtggacagcatcgaggacctgaagatggtggagcccatcggcaactag

SEQ ID NO: 3808 - DNA, 444 bp, Artificial Sequence
  Description of Artificial Sequence: Synthetic coding sequence
atgaccagcagcctgaagatctggggcatcctgctggccctgctgtgcatcctgtgcagactgtgcgtgtacagcaacaacatctactggagagagttcatcaagctgcactacctgagccccagcagagagttcaaggagtacaagtgcgacgtgctgatgagagagaaggaggccctgaagggcaagagcttccacatgttcatctacagcctgtggttcaagatccagagagcctgcatcaacgagaagggcagcgacagatacagaaacgcctacgtgtgggcccccggcgccctgaaggtgctggagtgccactgggagaagtacaacaacagatacaccgagagcagaagcttcagctacatcgagttccactgcggcgtggacggctacgtggacaacatcgaggacctgagaatcatcgagcccatcagcaactag

SEQ ID NO: 3809 - DNA, 1248 bp, Artificial Sequence
  Description of Artificial Sequence: Synthetic coding sequence
atgagccccttcctgtacctggtgctgctggtgctgggcctgcacgccaccatccactgcgccagccccgagggcaaggtgaccgcctgccacagcagccagcccaacgccaccctgtacaagatgagcagcatcaacgccgacttcgccttcaacctgtacagaagattcaccgtggagacccccgacaagaacatcttcttcagccccgtgagcatcagcgccgccctggtgatgctgagcttcggcgcctgctgcagcacccagaccgagatcgtggagaccctgggcttcaacctgaccgacacccccatggtggagatccagcacggcttccagcacctgatctgcagcctgaacttccccaagaaggagctggagctgcagatcggcaacgccctgttcatcggcaagcacctgaagcccctggccaagttcctgaacgacgtgaagaccctgtacgagaccgaggtgttcagcaccgacttcagcaacatcagcgccgccaagcaggagatcaacagccacgtggagatgcagaccaagggcaaggtggtgggcctgatccaggacctgaagcccaacaccatcatggtgctggtgaactacatccacttcaaggcccagtgggccaaccccttcgaccccagcaagaccgaggacagcagcagcttcctgatcgacaagaccaccaccgtgcaggtgcccatgatgcaccagatggagcagtactaccacctggtggacatggagctgaactgcaccgtgctgcagatggactacagcaagaacgccctggccctgttcgtgctgcccaaggagggccagatggagagcgtggaggccgccatgagcagcaagaccctgaagaagtggaacagactgctgcagaagggctgggtggacctgttcgtgcccaagttcagcatcagcgccacctacgacctgggcgccaccctgctgaagatgggcatccagcacgcctacagcgagaacgccgacttcagcggcctgaccgaggacaacggcctgaagctgagcaacgccgcccacaaggccgtgctgcacatcggcgagaagggcaccgaggccgccgccgtgcccgaggtggagctgagcgaccagcccgagaacaccttcctgcaccccatcatccagatcgacagaagcttcatgctgctgatcctggagagaagcaccagaagcatcctgttcctgggcaaggtggtgaaccccaccgaggcctag

SEQ ID NO: 3810 - DNA, 285 bp, Artificial Sequence
  Description of Artificial Sequence: Synthetic coding sequence
atgagaaccctggccatcctggccgccatcctgctggtggccctgcaggcccaggccgagcccctgcaggccagagccgacgaggtggccgccgcccccgagcagatcgccgccgacatccccgaggtggtggtgagcctggcctgggacgagagcctggcccccaagcaccccggcagcagaaagaacatggactgctactgcagaatccccgcctgcatcgccggcgagagaagatacggcacctgcatctaccagggcagactgtgggccttctgctgctag

SEQ ID NO: 3811 - DNA, 1062 bp, Artificial Sequence
  Description of Artificial Sequence: Synthetic coding sequence
atgagactgcccagaagagccgccctgggcctgctgcccctgctgctgctgctgccccccgcccccgaggccgccaagaagcccaccccctgccacagatgcagaggcctggtggacaagttcaaccagggcatggtggacaccgccaagaagaacttcggcggcggcaacaccgcctgggaggagaagaccctgagcaagtacgagagcagcgagatcagactgctggagatcctggagggcctgtgcgagagcagcgacttcgagtgcaaccagatgctggaggcccaggaggagcacctggaggcctggtggctgcagctgaagagcgagtaccccgacctgttcgagtggttctgcgtgaagaccctgaaggtgtgctgcagccccggcacctacggccccgactgcctggcctgccagggcggcagccagagaccctgcagcggcaacggccactgcagcggcgacggcagcagacagggcgacggcagctgcagatgccacatgggctaccagggccccctgtgcaccgactgcatggacggctacttcagcagcctgagaaacgagacccacagcatctgcaccgcctgcgacgagagctgcaagacctgcagcggcctgaccaacagagactgcggcgagtgcgaggtgggctgggtgctggacgagggcgcctgcgtggacgtggacgagtgcgccgccgagccccccccctgcagcgccgcccagttctgcaagaacgccaacggcagctacacctgcgaggagtgcgacagcagctgcgtgggctgcaccggcgagggccccggcaactgcaaggagtgcatcagcggctacgccagagagcacggccagtgcgccgacgtggacgagtgcagcctggccgagaagacctgcgtgagaaagaacgagaactgctacaacacccccggcagctacgtgtgcgtgtgccccgacggcttcgaggagaccgaggacgcctgcgtgccccccgccgaggccgaggccaccgagggcgagagccccacccagctgcccagcagagaggacctgtag

SEQ ID NO: 3812 - DNA, 651 bp, Artificial Sequence
  Description of Artificial Sequence: Synthetic coding sequence
atgaagctgaacctggtgcagatcttcttcatgctgctgatgctgctgctgggcctgggcatgggcctgggcctgggcctgcacatggccaccgccgtgctggaggagagcgaccagcccctgaacgagttctggagcagcgacagccaggacaaggccgaggccaccgaggagggcgacggcacccagaccaccgagaccctggtgctgagcaacaaggaggtggtgcagcccggctggcccgaggaccccatcctgggcgaggacgaggtgggcggcaacaagatgctgagagccagcgccctgttccagagcaacaaggactacctgagactggaccagaccgacagagagtgcaacgacatgatggcccacaagatgaaggagcccagccagagctgcatcgcccagtacgccttcatccacgaggacctgaacaccgtgaaggccgtgtgcaacagccccgtgatcgcctgcgagctgaagggcggcaagtgccacaagagcagcagacccttcgacctgaccctgtgcgagctgagccagcccgaccaggtgacccccaactgcaactacctgaccagcgtgatcaagaagcacatcatcatcacctgcaacgacatgaagagacagctgcccaccggccagtag

SEQ ID NO: 3813 - DNA, 222 bp, Artificial Sequence
  Description of Artificial Sequence: Synthetic coding sequence
atgagaatcgccgtgctgctgttcgccatcttcttcttcatgagccaggtgctgcccgccagaggcaagttcaaggagatctgcgagagacccaacggcagctgcagagacttctgcctggagaccgagatccacgtgggcagatgcctgaacagccagccctgctgcctgcccctgggccaccagcccagaatcgagagcaccacccccaagaaggactag

SEQ ID NO: 3814 - DNA, 609 bp, Artificial Sequence
  Description of Artificial Sequence: Synthetic coding sequence
atggagagaggcgccggcgccaagctgctgcccctgctgctgctgctgagagccaccggcttcacctgcgcccagaccgacggcagaaacggctacaccgccgtgatcgaggtgaccagcggcggcccctggggcgactgggcctggcccgagatgtgccccgacggcttcttcgccagcggcttcagcctgaaggtggagcccccccagggcatccccggcgacgacaccgccctgaacggcatcagactgcactgcgccagaggcaacgtgctgggcaacacccacgtggtggagagccagagcggcagctggggcgagtggagcgagcccctgtggtgcagaggcggcgcctacctggtggccttcagcctgagagtggaggcccccaccaccctgggcgacaacaccgccgccaacaacgtgagattcagatgcagcgacggcgaggagctgcagggccccggcctgagctggggcgacttcggcgactggagcgaccactgccccaagggcgcctgcggcctgcagaccaagatccagggccccagaggcctgggcgacgacaccgccctgaacgacgccagactgttctgctgcagaagctag

SEQ ID NO: 3815 - DNA, 759 bp, Artificial Sequence
  Description of Artificial Sequence: Synthetic coding sequence
atgcagctgaccagatgctgcttcgtgttcctggtgcagggcagcctgtacctggtgatctgcggccaggacgacggcccccccggcagcgaggaccccgagagagacgaccacgagggccagcccagacccagagtgcccagaaagagaggccacatcagccccaagagcagacccatggccaacagcaccctgctgggcctgctggccccccccggcgaggcctggggcatcctgggccagccccccaacagacccaaccacagccccccccccagcgccaaggtgaagaagatcttcggctggggcgacttctacagcaacatcaagaccgtggccctgaacctgctggtgaccggcaagatcgtggaccacggcaacggcaccttcagcgtgcacttccagcacaacgccaccggccagggcaacatcagcatcagcctggtgccccccagcaaggccgtggagttccaccaggagcagcagatcttcatcgaggccaaggccagcaagatcttcaactgcagaatggagtgggagaaggtggagagaggcagaagaaccagcctgtgcacccacgaccccgccaagatctgcagcagagaccacgcccagagcagcgccacctggagctgcagccagcccttcaaggtggtgtgcgtgtacatcgccttctacagcaccgactacagactggtgcagaaggtgtgccccgactacaactaccacagcgacaccccctactaccccagcggctag

SEQ ID NO: 3816 - DNA, 555 bp, Artificial Sequence
  Description of Artificial Sequence: Synthetic coding sequence
atgaagatcctggtggccttcctggtggtgctgaccatcttcggcatccagagccacggctacgaggtgttcaacatcatcagccccagcaacaacggcggcaacgtgcaggagaccgtgaccatcgacaacgagaagaacaccgccatcatcaacatccacgccggcagctgcagcagcaccaccatcttcgactacaagcacggctacatcgccagcagagtgctgagcagaagagcctgcttcatcctgaagatggaccaccagaacatcccccccctgaacaacctgcagtggtacatctacgagaagcaggccctggacaacatgttcagcagcaagtacacctgggtgaagtacaaccccctggagagcctgatcaaggacgtggactggttcctgctgggcagccccatcgagaagctgtgcaagcacatccccctgtacaagggcgaggtggtggagaacacccacaacgtgggcgccggcggctgcgccaaggccggcctgctgggcatcctgggcatcagcatctgcgccgacatccacgtgtag

SEQ ID NO: 3817 - DNA, 651 bp, Artificial Sequence
  Description of Artificial Sequence: Synthetic coding sequence
atgggcgccgtgatgggcaccttcagcagcctgcagaccaagcagagaagacccagcaaggacaagatcgaggacgagctggagatgaccatggtgtgccacagacccgagggcctggagcagctggaggcccagaccaacttcaccaagagagagctgcaggtgctgtacagaggcttcaagaacgagtgccccagcggcgtggtgaacgaggacaccttcaagcagatctacgcccagttcttcccccacggcgacgccagcacctacgcccactacctgttcaacgccttcgacaccacccagaccggcagcgtgaagttcgaggacttcgtgaccgccctgagcatcctgctgagaggcaccgtgcacgagaagctgagatggaccttcaacctgtacgacatcaacaaggacggctacatcaacaaggaggagatgatggacatcgtgaaggccatctacgacatgatgggcaagtacacctaccccgtgctgaaggaggacacccccagacagcacgtggacgtgttcttccagaagatggacaagaacaaggacggcatcgtgaccctggacgagttcctggagagctgccaggaggacgacaacatcatgagaagcctgcagctgttccagaacgtgatgtag

SEQ ID NO: 3818 - DNA, 2736 bp, Artificial Sequence
  Description of Artificial Sequence: Synthetic coding sequence
atggcccagctgttcctgcccctgctggccgccctggtgctggcccaggcccccgccgccctggccgacgtgctggagggcgacagcagcgaggacagagccttcagagtgagaatcgccggcgacgcccccctgcagggcgtgctgggcggcgccctgaccatcccctgccacgtgcactacctgagacccccccccagcagaagagccgtgctgggcagccccagagtgaagtggaccttcctgagcagaggcagagaggccgaggtgctggtggccagaggcgtgagagtgaaggtgaacgaggcctacagattcagagtggccctgcccgcctaccccgccagcctgaccgacgtgagcctggccctgagcgagctgagacccaacgacagcggcatctacagatgcgaggtgcagcacggcatcgacgacagcagcgacgccgtggaggtgaaggtgaagggcgtggtgttcctgtacagagagggcagcgccagatacgccttcagcttcagcggcgcccaggaggcctgcgccagaatcggcgcccacatcgccacccccgagcagctgtacgccgcctacctgggcggctacgagcagtgcgacgccggctggctgagcgaccagaccgtgagataccccatccagacccccagagaggcctgctacggcgacatggacggcttccccggcgtgagaaactacggcgtggtggaccccgacgacctgtacgacgtgtactgctacgccgaggacctgaacggcgagctgttcctgggcgacccccccgagaagctgaccctggaggaggccagagcctactgccaggagagaggcgccgagatcgccaccaccggccagctgtacgccgcctgggacggcggcctggaccactgcagccccggctggctggccgacggcagcgtgagataccccatcgtgacccccagccagagatgcggcggcggcctgcccggcgtgaagaccctgttcctgttccccaaccagaccggcttccccaacaagcacagcagattcaacgtgtactgcttcagagacagcgcccagcccagcgccatccccgaggccagcaaccccgccagcaaccccgccagcgacggcctggaggccatcgtgaccgtgaccgagaccctggaggagctgcagctgccccaggaggccaccgagagcgagagcagaggcgccatctacagcatccccatcatggaggacggcggcggcggcagcagcacccccgaggaccccgccgaggcccccagaaccctgctggagttcgagacccagagcatggtgccccccaccggcttcagcgaggaggagggcaaggccctggaggaggaggagaagtacgaggacgaggaggagaaggaggaggaggaggaggaggaggaggtggaggacgaggccctgtgggcctggcccagcgagctgagcagccccggccccgaggccagcctgcccaccgagcccgccgcccaggaggagagcctgagccaggcccccgccagagccgtgctgcagcccggcgccagccccctgcccgacggcgagagcgaggccagcagaccccccagagtgcacggcccccccaccgagaccctgcccacccccagagagagaaacctggccagccccagccccagcaccctggtggaggccagagaggtgggcgaggccaccggcggccccgagctgagcggcgtgcccagaggcgagagcgaggagaccggcagcagcgagggcgcccccagcctgctgcccgccaccagagcccccgagggcaccagagagctggaggcccccagcgaggacaacagcggcagaaccgcccccgccggcaccagcgtgcaggcccagcccgtgctgcccaccgacagcgccagcagaggcggcgtggccgtggtgcccgccagcggcgactgcgtgcccagcccctgccacaacggcggcacctgcctggaggaggaggagggcgtgagatgcctgtgcctgcccggctacggcggcgacctgtgcgacgtgggcctgagattctgcaaccccggctgggacgccttccagggcgcctgctacaagcacttcagcaccagaagaagctgggaggaggccgagacccagtgcagaatgtacggcgcccacctggccagcatcagcacccccgaggagcaggacttcatcaacaacagatacagagagtaccagtggatcggcctgaacgacagaaccatcgagggcgacttcctgtggagcgacggcgtgcccctgctgtacgagaactggaaccccggccagcccgacagctacttcctgagcggcgagaactgcgtggtgatggtgtggcacgaccagggccagtggagcgacgtgccctgcaactaccacctgagctacacctgcaagatgggcctggtgagctgcggccccccccccgagctgcccctggcccaggtgttcggcagacccagactgagatacgaggtggacaccgtgctgagatacagatgcagagagggcctggcccagagaaacctgcccctgatcagatgccaggagaacggcagatgggaggccccccagatcagctgcgtgcccagaagacccgccagagccctgcaccccgaggaggaccccgagggcagacagggcagactgctgggcagatggaaggccctgctgatcccccccagcagccccatgcccggcccctag

SEQ ID NO: 3819 - DNA, 852 bp, Artificial Sequence
  Description of Artificial Sequence: Synthetic coding sequence
atgggcctgggcctgagaggctggggcagacccctgctgaccgtggccaccgccctgatgctgcccgtgaagccccccgccggcagctggggcgcccagatcatcggcggccacgaggtgaccccccacagcagaccctacatggccagcgtgagattcggcggccagcaccactgcggcggcttcctgctgagagccagatgggtggtgagcgccgcccactgcttcagccacagagacctgagaaccggcctggtggtgctgggcgcccacgtgctgagcaccgccgagcccacccagcaggtgttcggcatcgacgccctgaccacccaccccgactaccaccccatgacccacgccaacgacatctgcctgctgagactgaacggcagcgccgtgctgggccccgccgtgggcctgctgagaccccccggcagaagagccagaccccccaccgccggcaccagatgcagagtggccggctggggcttcgtgagcgacttcgaggagctgccccccggcctgatggaggccaaggtgagagtgctggaccccgacgtgtgcaacagcagctggaagggccacctgaccctgaccatgctgtgcaccagaagcggcgacagccacagaagaggcttctgcagcgccgacagcggcggccccctggtgtgcagaaacagagcccacggcctggtgagcttcagcggcctgtggtgcggcgaccccaagacccccgacgtgtacacccaggtgagcgccttcgtggcctggatctgggacgtggtgagaagaagcagcccccagcccggccccctgcccggcaccaccagaccccccggcgaggccgcctag

SEQ ID NO: 3820 - DNA, 1209 bp, Artificial Sequence
  Description of Artificial Sequence: Synthetic coding sequence
atgatggtggccctgagaggcgccagcgccctgctggtgctgttcctggccgccttcctgccccccccccagtgcacccaggaccccgccatggtgcactacatctaccagagattcagagtgctggagcagggcctggagaagtgcacccaggccaccagagcctacatccaggagttccaggagttcagcaagaacatcagcgtgatgctgggcagatgccagacctacaccagcgagtacaagagcgccgtgggcaacctggccctgagagtggagagagcccagagagagatcgactacatccagtacctgagagaggccgacgagtgcatcgagagcgaggacaagaccctggccgagatgctgctgcaggaggccgaggaggagaagaagatcagaaccctgctgaacgccagctgcgacaacatgctgatgggcatcaagagcctgaagatcgtgaagaagatgatggacacccacggcagctggatgaaggacgccgtgtacaacagccccaaggtgtacctgctgatcggcagcagaaacaacaccgtgtgggagttcgccaacatcagagccttcatggaggacaacaccaagcccgcccccagaaagcagatcctgaccctgagctggcagggcaccggccaggtgatctacaagggcttcctgttcttccacaaccaggccaccagcaacgagatcatcaagtacaacctgcagaagagaaccgtggaggacagaatgctgctgcccggcggcgtgggcagagccctggtgtaccagcacagccccagcacctacatcgacctggccgtggacgagcacggcctgtgggccatccacagcggccccggcacccacagccacctggtgctgaccaagatcgagcccggcaccctgggcgtggagcacagctgggacaccccctgcagaagccaggacgccgaggccagcttcctgctgtgcggcgtgctgtacgtggtgtacagcaccggcggccagggcccccacagaatcacctgcatctacgaccccctgggcaccatcagcgaggaggacctgcccaacctgttcttccccaagagacccagaagccacagcatgatccactacaaccccagagacaagcagctgtacgcctggaacgagggcaaccagatcatctacaagctgcagaccaagagaaagctgcccctgaagtag

SEQ ID NO: 3821 - DNA, 1221 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagcaccaagatgcagatcctggagggcctgggcctgaacctgcagaagagcagcgagaaggagctgcacagaggcttccagcagctgctgcaggagctgaaccagcccagagacggcttccagctgagcctgggcaacgccctgttcaccgacctggtggtggacctgcaggacaccttcgtgagcgccatgaagaccctgtacctggccgacaccttccccaccaacttcagagacagcgccggcgccatgaagcagatcaacgactacgtggccaagcagaccaagggcaagatcgtggacctgctgaagaacctggacagcaacgccgtggtgatcatggtgaactacatcttcttcaaggccaagtgggagaccagcttcaaccacaagggcacccaggagcaggacttctacgtgaccagcgagaccgtggtgagagtgcccatgatgagcagagaggaccagtaccactacctgctggacagaaacctgagctgcagagtggtgggcgtgccctaccagggcaacgccaccgccctgttcatcctgcccagcgagggcaagatgcagcaggtggagaacggcctgagcgagaagaccctgagaaagtggctgaagatgttcaagaagagacagctggagctgtacctgcccaagttcagcatcgagggcagctaccagctggagaaggtgctgcccagcctgggcatcagcaacgtgttcaccagccacgccgacctgagcggcatcagcaaccacagcaacatccaggtgagcgagatggtgcacaaggccgtggtggaggtggacgagagcggcaccagagccgccgccgccaccggcaccatcttcaccttcagaagcgccagactgaacagccagagactggtgttcaacagacccttcctgatgttcatcgtggacaacaacatcctgttcctgggcaaggtgaacagaccctag

SEQ ID NO: 3822 - DNA, 1626 bp, Artificial Sequence
  Description of Artificial Sequence: Synthetic coding sequence
atgagactgagccccttccacctgcagctggagttccacatgaaggagaagagagaggacctgcagatcagctggagcttcatcagcgtgcccgagatggccgtgaacatccagcccaaggccctgggcgaggaccaggtggccgagaccagcgccatgagcgacgtgctgaaggacatcctgaagcacctggccggcagcgccagccccagcgtggtgctgatcaccaagcccaccaccgtgaaggaggcccagaacctgcagtgcgccgccagcaccgcccaggagagctgcccccccaagccccccagagcccacgagctgaagctgctggtgagaaacatccacgtgctgctgctgagcgagcccggcgccagcggccacatcaacgccgtgtgcgtggtgcagctgaacgaccccgtgcagagattcagcagcaccctgaccaagaacacccccgacctgatgtgggaggaggagttcaccttcgagctgaacgccaagagcaaggagctgcacctgcagatcagcgaggccggcagaagcagcgagggcctgctggccaccgccaccgtgcccctggacctgttcaagaagcagcccagcggcccccagagcttcaccctgaccagcggcagcgcctgcggcagcagcgtgctgggcagcgtgaccgccgagttcagctacatggagcccggcgagctgaagagctggcccatccccccccccgtgcccgccgccaagatcgagaaggacagaaccgtgatgccctgcggcaccgtggtgaccaccgtgaccgccgtgaagaccaagcccagagtggacgtgggcagagccagccccctgagcagcgacagccccgtgaagacccccatcaaggtgaaggtgatcgagaaggacatcagcgtgcaggccatcgcctgcagaagcgcccccgtgagcaagaccctgagcagcagcgacaccgagctgctggtgctgaacggcagcgaccccgtggccgaggtggccatcagacagctgagcgagagcagcaagctgaagctgaagagccccagaaagaagagcaccatcatcatcagcggcatcagcaagaccagcctgagccaggaccacgacgccgccctgatgcagggctacaccgccagcgtggacagcacccaccaggaggacgcccccagccaccccgagagagccgccgccagcgccccccccgaggaggccgagagcgcccaggccagcctggcccccaagccccaggaggacgagctggacagctgggacctggagaaggagccccaggccgccgcctggagcagccaggtgctgctggaccccgacggcgacgagctgagcgagagcagcatgagcgtgctggagcccggcaccgccaagaagcacaagggcggcatcctgagaaagggcgccaagctgttcttcagaagaagacaccagcagaaggaccccggcatgagccagagccacaacgacctggtgttcctggagcagcccgagggcagcagaagaaagggcatcaccctgaccagaatcctgaacaagaagctgctgagcagacacagaaacaagaacaccatgaacggcgcccccgtggagccctgcacctag

SEQ ID NO: 3823 - DNA, 993 bp, Artificial Sequence
  Description of Artificial Sequence: Synthetic coding sequence
atggccttcctgcccagctgggtgtgcgtgctggtgggcagcttcagcgccagcctggccggcaccagcaacctgagcgagaccgagccccccctgtggaaggagagccccggccagctgagcgactacagagtggagaacagcatgtacatcatcaacccctgggtgtacctggagagaatgggcatgtacaagatcatcctgaaccagaccgccagatacttcgccaagttcgcccccgacaacgagcagaacatcctgtggggcctgcccctgcagtacggctggcagtacagaaccggcagactggccgaccccaccagaagaaccaactgcggctacgagagcggcgaccacatgtgcatcagcgtggacagctggtgggccgacctgaactacttcctgagcagcctgcccttcctggccgccgtggacagcggcgtgatgggcatcagcagcgaccaggtgagactgctgcccccccccaagaacgagagaaagttctgctacgacgtgagcagctgcagaagcagcttccccgagaccatgaacaagtggaacaccttctaccagtacctgcagagccccttcagcaagttcgacgacctgctgaagtacctgtgggccgcccacaccagcaccctggccgacaacatcaagagcttcgaggacagatacgactactacagcaaggccgaggcccacttcgagagaagctgggtgctggccgtggaccacctggccgccgtgctgttccccaccaccctgatcagaagctacaagttccagaagggcatgccccccagaatcctgctgaacaccgacgtggcccccttcatcagcgacttcaccgccttccagaacgtggtgctggtgctgctgaacatgctggacaacgtggacaagagcatcggctacctgtgcaccgagaagagcaacgtgtacagagaccacagcgagagcagcagcagaagctacggcaacaacagctag

SEQ ID NO: 3824 - DNA, 813 bp, Artificial Sequence
  Description of Artificial Sequence: Synthetic coding sequence
atggacagcctggagtggaactgggccctggtgtacgagctgagcggcgagcaccacgacgaggagtggagcgtgaagacctaccaggaggtggcccagaagttcgtggagacccaccccgagttcatcggcatcaagatcatctacagcgaccacagaagcaaggacgtggccgtgatcgccgagagcatcagaatggccatgggcctgagaatcaagttccccaccgtggtggccggcttcgacctggtgggccacgaggacaccggccacagcctgcacgactacaaggaggccctgatgatccccgccaaggacggcgtgaagctgccctacttcttccacgccggcgagaccgactggcagggcaccagcatcgacagaaacatcctggacgccctgatgctgaacaccaccagaatcggccacggcttcgccctgagcaagcaccccgccgtgagaacctacagctggaagaaggacatccccatcgaggtgtgccccatcagcaaccaggtgctgaagctggtgagcgacctgagaaaccaccccgtggccaccctgatggccaccggccaccccatggtgatcagcagcgacgaccccgccatgttcggcgccaagggcctgagctacgacttctacgaggtgttcatgggcatcggcggcatgaaggccgacctgagaaccctgaagcagctggccatgaacagcatcaagtacagcaccctgctggagagcgagaagaacaccttcatggagatctggaagaagagatgggacaagttcatcgccgacgtggccaccaagtag

SEQ ID NO: 3825 - DNA, 939 bp, Artificial Sequence
  Description of Artificial Sequence: Synthetic coding sequence
atgggcgtgatggccatgctgatgctgcccctgctgctgctgggcatcagcggcctgctgttcatctaccaggaggtgagcagactgtggagcaagagcgccgtgcagaacaaggtggtggtgatcaccgacgccatcagcggcctgggcaaggagtgcgccagagtgttccacaccggcggcgccagactggtgctgtgcggcaagaactgggagagactggagaacctgtacgacgccctgatcagcgtggccgaccccagcaagcagaccttcacccccaagctggtgctgctggacctgagcgacatcagctgcgtgcccgacgtggccaaggaggtgctggactgctacggctgcgtggacatcctgatcaacaacgccagcgtgaaggtgaagggccccgcccacaagatcagcctggagctggacaagaagatcatggacgccaactacttcggccccatcaccctgaccaaggccctgctgcccaacatgatcagcagaagaaccggccagatcgtgctggtgaacaacatccagggcaagttcggcatccccttcagaaccacctacgccgccagcaagcacgccgccctgggcttcttcgactgcctgagagccgaggtggaggagtacgacgtggtgatcagcaccgtgagccccaccttcatcagaagctaccacgtgtaccccgagcagggcaactgggaggccagcatctggaagttcttcttcagaaagctgacctacggcgtgcaccccgtggaggtggccgaggaggtgatgagaaccgtgagaagaaagaagcaggaggtgttcatggccaaccccatccccaaggccgccgtgtacgtgagaaccttcttccccgagttcttcttcgccgtggtggcctgcggcgtgaaggagaagctgaacgtgcccgaggagggctag

SEQ ID NO: 3826 - DNA, 738 bp, Artificial Sequence
  Description of Artificial Sequence: Synthetic coding sequence
atggccagcaccgccctgctggccctgtgcagcaccggcgccttcagcggcctggccgtggaggccggcgccggcgtgtgccacgccacccccatctacgccggccacagctggcaccaggccaccttcagactgaacgtggccggcagcaccctgagcagatacctgagagacctgctggtggccgccaaccccgacctgctgcagcaggccctgcccagaaaggccatcacccacctgaagaagagaagctgctacgtgagcctggacttcgagggcgacctgagagaccccgccagacaccaccccgccagcttcagcgtgggcaacggctgctgcgtgtgcctgagcagcgagagattcagatgccccgagcccatcttccagcccggcctgctgggccaggccgagcagggcctgcccgccctggccttcagagccctgcagaagatgcccaagaccctgagaaccagactggccgacaccgtggtgctggccggcggcagcaccctgttccccggcttcgccgagagactggacaaggagctggaggcccagtgcagaagacacggctacgccgccctgagaccccacctggtggccaagcacggcagaggcatggccgtgtggaccggcggcagcatggtggccagcctgcacagcttccagagaagatggatcaccagagccatgtaccaggagtgcggcagcagactgctgtacgacgtgttcaactag

SEQ ID NO: 3827 - DNA, 909 bp, Artificial Sequence
  Description of Artificial Sequence: Synthetic coding sequence
atgagaagatgggcctgggccgccgtggtggtgctgctgggcccccagctggtgctgctgggcggcgtgggcgccagaagagaggcccagagaacccagcagcccggccagagagccgacccccccaacgccaccgccagcgccagcagcagagagggcctgcccgaggcccccaagcccagccaggccagcggccccgagttcagcgacgcccacatgacctggctgaacttcgtgagaagacccgacgacggcgccctgagaaagagatgcggcagcagagacaagaagcccagagacctgttcggcccccccggcccccccggcgccgaggtgaccgccgagaccctgctgcacgagttccaggagctgctgaaggaggccaccgagagaagattcagcggcctgctggaccccctgctgccccagggcgccggcctgagactggtgggcgaggccttccactgcagactgcagggccccagaagagtggacaagagaaccctggtggagctgcacggcttccaggcccccgccgcccagggcgccttcctgagaggcagcggcctgagcctggccagcggcagattcaccgcccccgtgagcggcatcttccagttcagcgccagcctgcacgtggaccacagcgagctgcagggcaaggccagactgagagccagagacgtggtgtgcgtgctgatctgcatcgagagcctgtgccagagacacacctgcctggaggccgtgagcggcctggagagcaacagcagagtgttcaccctgcaggtgcagggcctgctgcagctgcaggccggccagtacgccagcgtgttcgtggacaacggcagcggcgccgtgctgaccatccaggccggcagcagcttcagcggcctgctgctgggcacctag

SEQ ID NO: 3828 - DNA, 1416 bp, Artificial Sequence
  Description of Artificial Sequence: Synthetic coding sequence
atggacagcgcccccctgttccccagaccccacctgttccagaacctgctgctgttcctgtgggccctgctgaactgcggcctgggcgtgagcgcccagggccccggcgagtggaccccctgggtgagctggaccagatgcagcagcagctgcggcagaggcgtgagcgtgagaagcagaagatgcctgagactgcccggcgaggagccctgctggggcgacagccacgagtacagactgtgccagctgcccgactgcccccccggcgccgtgcccttcagagacctgcagtgcgccctgtacaacggcagacccgtgctgggcacccagaagacctaccagtgggtgcccttccacggcgcccccaaccagtgcgacctgaactgcctggccgagggccacgccttctaccacagcttcggcagagtgctggacggcaccgcctgcagccccggcgcccagggcgtgtgcgtggccggcagatgcctgagcgccggctgcgacggcctgctgggcagcggcgccctggaggacagatgcggcagatgcggcggcgccaacgacagctgcctgttcgtgcagagagtgttcagagacgccggcgccttcgccggctactggaacgtgaccctgatccccgagggcgccagacacatcagagtggagcacagaagcagaaaccacctggccctgatgggcggcgacggcagatacgtgctgaacggccactgggtggtgagcccccccggcacctacgaggccgccggcacccacgtggtgtacaccagagacaccggcccccaggagaccctgcaggccgccggccccaccagccacgacctgctgctgcaggtgctgctgcaggagcccaaccccggcatcgagttcgagttctggctgcccagagagagatacagccccttccaggccagagtgcaggccctgggctggcccctgagacagccccagcccagaggcgtggagccccagccccccgccgcccccgccgtgacccccgcccagacccccaccctggcccccgacccctgccccccctgccccgacaccagaggcagagcccacagactgctgcactactgcggcagcgacttcgtgttccaggccagagtgctgggccaccaccaccaggcccaggagaccagatacgaggtgagaatccagctggtgtacaagaacagaagccccctgagagccagagagtacgtgtgggcccccggccactgcccctgccccatgctggccccccacagagactacctgatggccgtgcagagactggtgagccccgacggcacccaggaccagctgctgctgccccacgccggctacgccagaccctggagccccgccgaggacagcagaatcagactgaccgccagaagatgccccggctag

SEQ ID NO: 3829 - DNA, 222 bp, Artificial Sequence
  Description of Artificial Sequence: Synthetic coding sequence
atggccccccagaccctgctgctggtgctggtgctgtgcgtgctgctgctgcaggcccagggcggctacagagacaagatgagaatgcagagaatcaaggtgtgcgagaagagacccagcatcgacctgtgcatccaccactgcagctacttccagaagtgcgagaccaacaagatctgctgcagcgccttctgcggcaacatctgcatgagcatcctgtag

SEQ ID NO: 3830 - DNA, 2349 bp, Artificial Sequence
  Description of Artificial Sequence: Synthetic coding sequence
atggccagagccagagccggcgccctgctggccctgtgggtgctgggcgccgccgcccacccccagtgcctggacttcagaccccccttcagacccacccagcccctgagactgtgcgcccagtacagcgacttcggctgctgcgacgagggcagagacgccgagctgaccagaagattctgggccctggccagcagagtggacgccgccgagtgggccgcctgcgccggctacgccagagacctgctgtgccaggagtgcagcccctacgccgcccacctgtacgacgccgaggaccccttcacccccctgagaaccgtgcccggcctgtgccaggactactgcctggacatgtggcacaagtgcagaggcctgttcagacacctgagcaccgaccaggagctgtgggccctggagggcaacctggccagattctgcagatacctgagcctggacgacaccgactactgcttcccctacctgctggtgaacaagaacctgaacagcaacctgggccacgtggtggccgacgccaagggctgcctgcagctgtgcctggaggaggtggccaacggcctgagaaaccccgtggccatggtgcacgccagagacggcacccacagattcttcgtggccgagcaggtgggcctggtgtgggcctacctgcccgacagaagcagactgggcaagcccttcctgaacatcagcagagtggtgctgaccagcccctgggagggcgacgagagaggcttcctgggcatcgccttccaccccagcttccagcacaacagaagactgtacgtgtactacagcgtgggcatcagaagcagcgagtggatcagaatcagcgagttcagagtgagcgaggacgacgagaacgccgtggaccacagcagcgagagaatcatcctggaggtgaaggagcccgccagcaaccacaacggcggccagctgctgttcggcgacgacggctacctgtacatcttcaccggcgacggcggcatggccggcgaccccttcggcaccttcggcaacgcccagaacaagagcgccctgctgggcaaggtgctgagaatcgacgtggacagaaaggagagaggcctgccctacggcatcccccccgacaaccccttcgtgggcgaccccgccgcccagcccgaggtgtacgccctgggcgtgagaaacatgtggagatgcagcttcgacagaggcgaccccagcagcggcaccggcagaggcagactgttctgcggcgacgtgggccagaacaagttcgaggaggtggacgtggtggagagaggcggcaactacggctggagagccagagagggcttcgagtgctacgacagaagcctgtgcgccaacaccagcctgaacgacctgctgcccatcttcgcctacccccacaccgtgggcaagagcgtgaccggcggctacgtgtacagaggctgcgagtaccccaacctgaacggcctgtacatcttcggcgacttcatgagcggcagactgatgagcctgcaggagaaccccggcaccggccagtggcagtacagcgagatctgcatgggccacggccagacctgcgagttccccggcctgatcaacaactactacccctacatcatcagcttcggcgaggacgaggccggcgagctgtacttcatgagcaccggcgagcccagcgccaccgcccccagaggcgtggtgtacaagatcatcgacgccagcagaagagccccccccggcaagtgccagatccagcccgcccaggtgaagatcagaagcagactgatccccttcgtgcccaaggagaagttcatccccaagaccagaagcacccccagacccaccgccagagcccccaccagagcccccagaagaggcagacccaccgccgccccccccgcccccacccccagacccgccagacccacccagcagcccggcagcagaagaggcggcggcagaagaagaggcagactgaacagcgccagcagagccttcagagacggcgaggtgagactggtgagacccgccggcctgagcagcggcagcggcagagtggaggtgttcgtgggcggcagatggggcaccgtgtgcgacgacagctggaacatcagcggcgccgccgtggtgtgcagacagctgggcttcgcctacgccgtgagagccgtgaagagagccgagttcggccagggcggcagcctgcccatcctgctggacgacgtgagatgcgccggctgggagagaaacctgctggagtgccagcacaacggcgtgggcacccacaactgcgagcacgacgaggacgccggcgtggtgtgcagccaccagaaccccgacctgtag

SEQ ID NO: 3831 - DNA, 1317 bp, Artificial Sequence
  Description of Artificial Sequence: Synthetic coding sequence
atgcaccccctgcccggctactggagctgctactgcctgctgctgctgttcagcctgggcgtgcagggcagcctgggcgcccccagcgccgcccccgagcaggtgcacctgagctaccccggcgagcccggcagcatgaccgtgacctggaccacctgggtgcccaccagaagcgaggtgcagttcggcctgcagcccagcggccccctgcccctgagagcccagggcaccttcgtgcccttcgtggacggcggcatcctgagaagaaagctgtacatccacagagtgaccctgagaaagctgctgcccggcgtgcagtacgtgtacagatgcggcagcgcccagggctggagcagaagattcagattcagagccctgaagaacggcgcccactggagccccagactggccgtgttcggcgacctgggcgccgacaaccccaaggccgtgcccagactgagaagagacacccagcagggcatgtacgacgccgtgctgcacgtgggcgacttcgcctacaacctggaccaggacaacgccagagtgggcgacagattcatgagactgatcgagcccgtggccgccagcctgccctacatgacctgccccggcaaccacgaggagagatacaacttcagcaactacaaggccagattcagcatgcccggcgacaacgagggcctgtggtacagctgggacctgggccccgcccacatcatcagcttcagcaccgaggtgtacttcttcctgcactacggcagacacctggtgcagagacagttcagatggctggagagcgacctgcagaaggccaacaagaacagagccgccagaccctggatcatcaccatgggccacagacccatgtactgcagcaacgccgacctggacgactgcaccagacacgagagcaaggtgagaaagggcctgcagggcaagctgtacggcctggaggacctgttctacaagtacggcgtggacctgcagctgtgggcccacgagcacagctacgagagactgtggcccatctacaactaccaggtgttcaacggcagcagagagatgccctacaccaaccccagaggccccgtgcacatcatcaccggcagcgccggctgcgaggagagactgacccccttcgccgtgttccccagaccctggagcgccgtgagagtgaaggagtacggctacaccagactgcacatcctgaacggcacccacatccacatccagcaggtgagcgacgaccaggacggcaagatcgtggacgacgtgtgggtggtgagacccctgttcggcagaagaatgtacctgtag

SEQ ID NO: 3832 - DNA, 411 bp, Artificial Sequence
  Description of Artificial Sequence: Synthetic coding sequence
atggccagaaccaagcagaccgccagaaagagcaccggcggcaaggcccccagaaagcagctggccaccaaggccgccagaaagagcgcccccgccaccggcggcgtgaagaagccccacagatacagacccggcaccgtggccctgagagagatcagaagataccagaagagcaccgagctgctgatcagaaagctgcccttccagagactggtgagagagatcgcccaggacttcaagaccgacctgagattccagagcagcgccgtgatggccctgcaggaggccagcgaggcctacctggtgggcctgttcgaggacaccaacctgtgcgccatccacgccaagagagtgaccatcatgcccaaggacatccagctggccagaagaatcagaggcgagagagcctag

SEQ ID NO: 3833 - DNA, 1209 bp, Artificial Sequence
  Description of Artificial Sequence: Synthetic coding sequence
atggccgccagacccggccccctgtggctgctgggcctgaccctgtgcgccctgggcggcggcggccccggcctgagacccccccccggctgcccccagagaagactgggcgccagagagagaagagacgtgcagagagagatcctggccgtgctgggcctgcccggcagacccagacccagagccccccccgccgccagcagactgcccgccagcgcccccctgttcatgctggacctgtaccacgccatggccggcgacgacgacgaggacggcgcccccgccgagcagagactgggcagagccgacctggtgatgagcttcgtgaacatggtggagagagacagagccctgggccaccaggagccccactggaaggagttcagattcgacctgacccagatccccgccggcgaggccgtgaccgccgccgagttcagaatctacaaggtgcccagcatccacctgctgaacagaaccctgcacgtgagcatgttccaggtggtgcaggagcagagcaacagagagagcgacctgttcttcctggacctgcagaccctgagagccggcgacgagggctggctggtgctggacgtgaccgccgccagcgactgctggctgctgaagagacacaaggacctgggcctgagactgtacgtggagaccgaggacggccacagcgtggaccccggcctggccggcctgctgggccagagagcccccagaagccagcagcccttcgtggtgaccttcttcagagccagccccagccccatcagaacccccagagccgtgagacccctgagaagaagacagcccaagaagagcaacgagctgccccaggccaacagactgcccggcatcttcgacgacgtgagaggcagccacggcagacaggtgtgcagaagacacgagctgtacgtgagcttccaggacctgggctggctggactgggtgatcgccccccagggctacagcgcctactactgcgagggcgagtgcagcttccccctggacagctgcatgaacgccaccaaccacgccatcctgcagagcctggtgcacctgatgaagcccaacgccgtgcccaaggcctgctgcgcccccaccaagctgagcgccaccagcgtgctgtactacgacagcagcaacaacgtgatcctgagaaagcacagaaacatggtggtgaaggcctgcggctgccactag

SEQ ID NO: 3834 - DNA, 957 bp, Artificial Sequence
  Description of Artificial Sequence: Synthetic coding sequence
atggccgccgccgccctgccccccagacccctgctgctgctgcccctggtgctgctgctgagcggcagacccaccagagccgacagcaaggtgttcggcgacctggaccaggtgagaatgaccagcgagggcagcgactgcagatgcaagtgcatcatgagacccctgagcaaggacgcctgcagcagagtgagaagcggcagagccagagtggaggacttctacaccgtggagaccgtgagcagcggcaccgactgcagatgcagctgcaccgccccccccagcagcctgaacccctgcgagaacgagtggaagatggagaagctgaagaagcaggcccccgagctgctgaagagcatcaaggccaacctgagcagagagaacgaggtggtgaaggacagcgtgagacacctgagcgagcagctgagacactacgagaaccacagcgccatcatgctgggcatcaagaaggagctgagcagactgggcctgcagctgctgcagaaggacgccgccgccgcccccgccacccccgccaccggcaccggcagcaaggcccaggacaccgccagaggcaagggcaaggacatcagcaagtacggcagcgtgcagaagagcttcgccgacagaggcctgcccaagccccccaaggagaagctgctgcaggtggagaagctgagaaaggagagcggcaagggcagcttcctgcagcccaccgccaagcccagagccctggcccagcagcaggccgtgatcagaggcttcacctactacaaggccggcaagcaggaggtgaccgaggccgtggccgacaacaccctgcagggcaccagctggctggagcagctgccccccaaggtggagggcagaagcaacagcgccgagcccaacagcgccgagcaggacgaggccgagcccagaagcagcgagagagtggacctggccagcggcacctag

SEQ ID NO: 3835 - DNA, 402 bp, Artificial Sequence
  Description of Artificial Sequence: Synthetic coding sequence
atggccctgggcgtgcccatcagcgtgtacctgctgttcaacgccatgaccgccctgaccgaggaggccgccgtgaccgtgaccccccccatcaccgcccagcaggccgacaacatcgagggccccatcgccctgaagttcagccacctgtgcctggaggaccacaacagctactgcatcaacggcgcctgcgccttccaccacgagctggagaaggccatctgcagatgcttcaccggctacaccggcgagagatgcgagcacctgaccctgaccagctacgccgtggacagctacgagaagtacatcgccatcggcatcggcgtgggcctgctgctgagcggcttcctggtgatcttctactgctacatcagaaagagatacgagaaggacaagatctag

SEQ ID NO: 3836 - DNA, 651 bp, Artificial Sequence
  Description of Artificial Sequence: Synthetic coding sequence
atgagcagcgaggccgagacccagcagccccccgccgccccccccgccgcccccgccctgagcgccgccgacaccaagcccggcaccaccggcagcggcgccggcagcggcggccccggcggcctgaccagcgccgcccccgccggcggcgacaagaaggtgatcgccaccaaggtgctgggcaccgtgaagtggttcaacgtgagaaacggctacggcttcatcaacagaaacgacaccaaggaggacgtgttcgtgcaccagggcgccgaggccgccaacgtgaccggccccggcggcgtgcccgtgcagggcagcaagtacgccgccgacagaaaccactacagaagataccccagaagaagaggcccccccagaaactaccagcagaactaccagaacagcgagagcggcgagaagaacgagggcagcgagagcgcccccgagggccaggcccagcagagaagaccctacagaagaagaagattccccccctactacatgagaagaccctacggcagaagaccccagtacagcaacccccccgtgcagggcgaggtgatggagggcgccgacaaccagggcgccggcgagcagggcagacccgtgagacagaacatgtacagaggctacagacccagattcagatag

SEQ ID NO: 3837 - DNA, 756 bp, Artificial Sequence
  Description of Artificial Sequence: Synthetic coding sequence
aacgactggagcgccgaccagctgtacctggagaccaccggcaagagcagaaccctgcagagcggcctggccctgctgtacggcttcctgcccgacttcgactggaagaagatctacttcagacaccagcccagcgccctgttctgcagcggcagctgctactgccccgtgagaaaccagtacctggagaaggagcagagaagacagtacctgctgagactgaagaacagccagctggagaagacctacggcgagatggccaagatcgtggacgtgcccaccaagcagctgagagccgccaaccccatcgacagcatgctgtgccacttctgccacaacgtgagcttcccctgcaccagaaacggctgcgtggacatggagcacttcaaggtgatcaagacccaccagatcgaggacgagagagagagaagagagaagaagctgtacttcggctacagcctgctgggcgcccaccccatcctgaaccagaccatcggcagaatgcagagagccaccgagggcagaaaggaggagctgttcgccctgtacagcgcccacgacgtgaccctgagccccgtgctgagcgccctgggcctgagcgaggccagattccccagattcgccgccagagtgaacatccccagcggcttcttcaccatggccagcatgagccacagcacccccctgagcgccaagaccaccaccagcgtgctgcccagcccctgcgccagactgaagacctggagcgccctgtag

SEQ ID NO: 3838 - DNA, 576 bp, Artificial Sequence
  Description of Artificial Sequence: Synthetic coding sequence
atggccgcccccagaggcagagccgccccctggaccaccgccctgctgctgctgctggccagccaggtgctgagccccggcagctgcgccgacgaggaggaggtgcccgaggagtgggtgctgctgcacgtggtgcagggccagatcggcgccggcaactacagctacctgagactgaaccacgagggcaagatcgtgctgagaatgagaagcctgaagggcgacgccgacctgtacgtgagcgccagcagcctgcaccccagcttcgacgactacgagctgcagagcgccacctgcggccccgacgccgtgagcatccccgcccacttcagaagacccgtgggcatcggcgtgtacggccaccccagccacctggagagcgagttcgagatgaaggtgtactacgacggcaccgtggagcagcaccccttcggcgaggccgcctaccccgccgacggcgccgacgccggccagaagcacgccggcgcccccgaggacgccagccaggaggaggagagcgtgctgtggaccatcctgatcagcatcctgaagctggtgctggagatcctgttctag

SEQ ID NO: 3839 - DNA, 2301 bp, Artificial Sequence
  Description of Artificial Sequence: Synthetic coding sequence
atgggcagaagaagactgctggtgtggctgtgcgccgtggccgccctgctgagcggcgcccaggccagaggcacccccctgctggccagacccgccccccccggcgccagcagatacagcctgtacaccaccggctggagacccagactgagacccggcccccacaaggccctgtgcgcctacgtggtgcacagaaacgtgacctgcatcctgcaggagggcgccgagagctacgtgaaggccgagtacagacagtgcagatggggccccaagtgccccggcaccgtgacctacagaaccgtgctgagacccaagtacaaggtgggctacaagaccgtgaccgacctggcctggagatgctgccccggcttcaccggcaagagatgccccgagcacctgaccgaccacggcgccgccagcccccagctggagcccgagccccagatccccagcggccagctggaccccggccccagaccccccagctacagcagagccgcccccagcccccacggcagaaagggccccggcctgttcggcgagagactggagagactggagggcgacgtgcagagactggcccagacctacggcaccctgagcggcctggtggccagccacgaggaccccaacagaatgaccggcggccccagagcccccgccgtgcccgtgggcttcggcgtgatccccgagggcctggtgggccccggcgacagagccagaggccccctgaccccccccctggacgagatcctgagcaaggtgaccgaggtgagcaacaccctgcagaccaaggtgcagctgctggacaaggtgcacggcctggccctgggccacgaggcccacctgcagagactgagagaggccccccccagccccctgaccagcctggccctgctggaggagtacgtggacagaagactgcacagactgtggggcagcctgctggacggcttcgagcagaagctgcagggcgtgcagagcgagtgcgacctgagagtgcaggaggtgagaagacagtgcgaggagggccaggccgccagcagaagactgcaccagagcctggacggcagagagctggccctgagacaggagctgagccagctgggcagccagctgcagggcctgagcgtgagcggcagaggcagctgctgcggccagctggccctgatcaacgccagaatggacggcctggagagagccctgcaggccgtgaccgagacccagagaggccccggcgcccccgccggcgacgagctgaccagactgagcgccgccatgctggagggcggcgtggacggcctgctggagggcctggagaccctgaacggcaccgagggcggcgccagaggctgctgcctgagactggacatgggcggctggggcgtgggcggcttcggcaccatgctggaggagagagtgcagagcctggaggagagactggccaccctggccggcgagctgagccacgacagcgccagccccggcagaagcgccagacccctggtgcagaccgagctggccgtgctggagcagagactggtgagcctggagaccagctgcacccccagcaccaccagcgccatcctggacagcctggtggccgaggtgaaggcctggcagagcagaagcgaggccctgctgagacaggtggccagccacgccgccctgctgcagcagctgaacggcaccgtggccgaggtgcagggccagctggccgagggcaccggcagcagcctgcagggcgagatcaccctgctgaaggtgaacctgaacagcgtgagcaagagcctgaccggcctgagcgacagcgtgagccagtacagcgacgccttcctggccgccaacaccagcctggacgagagagagagaaaggtggaggccgaggtgcaggccatccaggagcaggtgagcagccagggcagcagactgcaggccggccacagacaggtgctgaacctgagaggcgagctggagcagctgaaggccggcgtggccaaggtggccagcggcctgagcagatgccaggacaccgcccagaagctgcagcacaccgtgggccacttcgaccagagagtggcccaggtggagggcgcctgcagaagactgggcctgctggccgccggcctggacagcctgcccaccgagcccctgagacccagagagggcctgtggagccacgtggaccagctgaacagaaccctggcccagcacacccaggacatcgccagactgagagacgacctgctggactgccaggcccagctggccgagcaggtgagacccggccaggccaactag

SEQ ID NO: 3840 - DNA, 1251 bp, Artificial Sequence
  Description of Artificial Sequence: Synthetic coding sequence
atgtacagacacggcatcagcagccagagaagctggcccctgtggaccaccatcttcatcttcctgggcgtggccgccatcctgggcgtgaccatcggcctgctggtgcacttcctggccgtggagaagacctactactaccagggcgacttccacatcagcggcgtgacctacaacgacaactgcgagaacgccgccagccaggccagcaccaacctgagcaaggacatcgagaccaagatgctgaacgccttccagaacagcagcatctacaaggagtacgtgaagagcgaggtgatcaagctgctgcccaacgccaacggcagcaacgtgcagctgcagctgaagttcaagttcccccccgccgagggcgtgagcatgagaaccaagatcaaggccaagctgcaccagatgctgaagaacaacatggccagctggaacgccgtgcccgccagcatcaagctgatggagatcagcaaggccgccagcgagatgctgaccaacaactgctgcggcagacaggtggccaacagcatcatcaccggcaacaagatcgtgaacggcaagagcagcctggagggcgcctggccctggcaggccagcatgcagtggaagggcagacactactgcggcgccagcctgatcagcagcagatggctgctgagcgccgcccactgcttcgccaagaagaacaacagcaaggactggaccgtgaacttcggcatcgtggtgaacaagccctacatgaccagaaaggtgcagaacatcatcttccacgagaactacagcagccccggcctgcacgacgacatcgccctggtgcagctggccgaggaggtgagcttcaccgagtacatcagaaagatctgcctgcccgaggccaagatgaagctgagcgagaacgacaacgtggtggtgaccggctggggcaccctgtacatgaacggcagcttccccgtgatcctgcaggaggacttcctgaagatcatcgacaacaagatctgcaacgccagctacgcctacagcggcttcgtgaccgacaccatgctgtgcgccggcttcatgagcggcgaggccgacgcctgccagaacgacagcggcggccccctggcctaccccgacagcagaaacatctggcacctggtgggcatcgtgagctggggcgacggctgcggcaagaagaacaagcccggcgtgtacaccagagtgaccagctacagaaactggatcaccagcaagaccggcctgtag

SEQ ID NO: 3841 - DNA, 639 bp, Artificial Sequence
  Description of Artificial Sequence: Synthetic coding sequence
atgctgagcagcgtggtgttctggggcctgatcgccctgatcggcaccagcagaggcagctaccccttcagccacagcatgaagccccacctgcaccccagactgtaccacggctgctacggcgacatcatgaccatgaagaccagcggcgccacctgcgacgccaacagcgtgatgaactgcggcatcagaggcagcgagatgttcgccgagatggacctgagagccatcaagccctaccagaccctgatcaaggaggtgggccagagacactgcgtggaccccgccgtgatcgccgccatcatcagcagagagagccacggcggcagcgtgctgcaggacggctgggaccacagaggcctgaagttcggcctgatgcagctggacaagcagacctaccaccccgtgggcgcctgggacagcaaggagcacctgagccaggccaccggcatcctgaccgagagaatcaaggccatccagaagaagttccccacctggagcgtggcccagcacctgaagggcggcctgagcgccttcaagagcggcatcgaggccatcgccacccccagcgacatcgacaacgacttcgtgaacgacatcatcgccagagccaagttctacaagagacagagcttctag

SEQ ID NO: 3842 - DNA, 378 bp, Artificial Sequence
  Description of Artificial Sequence: Synthetic coding sequence
atggccagaagcgccaccctggccgccgccgccctggccctgtgcctgctgctggccccccccggcctggcctggtacaagcccgccgccggccacagcagctacagcgtgggcagagccgccggcctgctgagcggcctgagaagaagcccctacgccagaagaagccagccctacagaggcgccgagccccccggcggcgccggcgccagccccgagctgcagctgcaccccagactgagaagcctggccgtgtgcgtgcaggacgtggcccccaacctgcagagatgcgagagactgcccgacggcagaggcacctaccagtgcaaggccaacgtgttcctgagcctgagagccgccgactgcctggccgcctag

SEQ ID NO: 3843 - DNA, 867 bp, Artificial Sequence
  Description of Artificial Sequence: Synthetic coding sequence
atgaacaacctgagcttcagcgagctgtgctgcctgttctgctgccccccctgccccggcaagatcgccagcaagctggccttcctgccccccgaccccacctacaccctgatgtgcgacgagagcggcagcagatggaccctgcacctgagcgagagagccgactggcagtacagcagcagagagaaggacgccatcgagtgcttcatgaccagaaccagcaagggcaacagaatcgcctgcatgttcgtgagatgcagccccaacgccaagtacaccctgctgttcagccacggcaacgccgtggacctgggccagatgagcagcttctacatcggcctgggcagcagaatcaactgcaacatcttcagctacgactacagcggctacggcgccagcagcggcaagcccaccgagaagaacctgtacgccgacatcgaggccgcctggctggccctgagaaccagatacggcatcagacccgagaacgtgatcatctacggccagagcatcggcaccgtgcccagcgtggacctggccgccagatacgagagcgccgccgtgatcctgcacagccccctgaccagcggcatgagagtggccttccccgacaccaagaagacctactgcttcgacgccttccccaacatcgacaagatcagcaagatcaccagccccgtgctgatcatccacggcaccgaggacgaggtgatcgacttcagccacggcctggccctgttcgagagatgccagagacccgtggagcccctgtgggtggagggcgccggccacaacgacgtggagctgtacggccagtacctggagagactgaagcagttcgtgagccaggagctggtgaacctgtag

SEQ ID NO: 3844 - DNA, 417 bp, Artificial Sequence
  Description of Artificial Sequence: Synthetic coding sequence
atggtggcccccgccgccagagtgttcctgagagccgtgagagccgccctgaccagcaccgtgcccgacctgctgtgcctgctggccagaggcagccccagaggcctggccagcggcagactgcccctggccgtgcacagcgcccagcacggccccggcagcggcgccccctggctgagaatcgccagaagagccctgagattcgtgctgagcaagcactggggcgacgactgctacctgaccaacagactgtggcaggacctgaagccccccagccacgtggagaacggccaggagctgagactggccccccccgtgcagtgggccctgcaggtgcagggcaaccagctgcagaccgccgtgctgtgcctgagaatggccccccccgagcccgccggcagcagacagagaatctag

SEQ ID NO: 3845 - DNA, 1332 bp, Artificial Sequence
  Description of Artificial Sequence: Synthetic coding sequence
atgggcggccccagagcctgggccctgctgtgcctgggcctgctgctgcccggcggcggcgccgcctggagcatcggcgccgcccccttcagcggcagaagaaactggtgcagctacgtggtgaccagaaccatcagctgccacgtgcagaacggcacctacctgcagagagtgctgcagaactgcccctggcccatgagctgccccggcagcagctacagaaccgtggtgagacccacctacaaggtgatgtacaagatcgtgaccgccagagagtggagatgctgccccggccacagcggcgtgagctgcgaggaggtggccgccagcagcgccagcctggagcccatgtggagcggcagcaccatgagaagaatggccctgagacccaccgccttcagcggctgcctgaactgcagcaaggtgagcgagctgaccgagagactgaaggtgctggaggccaagatgaccatgctgaccgtgatcgagcagcccgtgccccccacccccgccacccccgaggaccccgcccccctgtggggccccccccccgcccagggcagccccggcgacggcggcctgcaggaccaggtgggcgcctggggcctgcccggccccaccggccccaagggcgacgccggcagcagaggccccatgggcatgagaggcccccccggcccccagggcccccccggcagccccggcagagccggcgccgtgggcacccccggcgagagaggcccccccggcccccccggcccccccggcccccccggcccccccgcccccgtgggccccccccacgccagaatcagccagcacggcgaccccctgctgagcaacaccttcaccgagaccaacaaccactggccccagggccccaccggcccccccggcccccccggccccatgggcccccccggcccccccggccccaccggcgtgcccggcagccccggccacatcggcccccccggccccaccggccccaagggcatcagcggccaccccggcgagaagggcgagagaggcctgagaggcgagcccggcccccagggcagcgccggccagagaggcgagcccggccccaagggcgaccccggcgagaagagccactggggcgagggcctgcaccagctgagagaggccctgaagatcctggccgagagagtgctgatcctggagaccatgatcggcctgtacgagcccgagctgggcagcggcgccggccccgccggcaccggcacccccagcctgctgagaggcaagagaggcggccacgccaccaactacagaatcgtggcccccagaagcagagacgagagaggctag

SEQ ID NO: 3846 - DNA, 717 bp, Artificial Sequence
  Description of Artificial Sequence: Synthetic coding sequence
atggtgctgctgctgctggtggccatccccctgctggtgcacagcagcagaggccccgcccactacgagatgctgggcagatgcagaatggtgtgcgacccccacggccccagaggccccggccccgacggcgcccccgccagcgtgccccccttcccccccggcgccaagggcgaggtgggcagaagaggcaaggccggcctgagaggcccccccggcccccccggccccagaggcccccccggcgagcccggcagacccggcccccccggcccccccggccccggccccggcggcgtggcccccgccgccggctacgtgcccagaatcgccttctacgccggcctgagaagaccccacgagggctacgaggtgctgagattcgacgacgtggtgaccaacgtgggcaacgcctacgaggccgccagcggcaagttcacctgccccatgcccggcgtgtacttcttcgcctaccacgtgctgatgagaggcggcgacggcaccagcatgtgggccgacctgatgaagaacggccaggtgagagccagcgccatcgcccaggacgccgaccagaactacgactacgccagcaacagcgtgatcctgcacctggacgtgggcgacgaggtgttcatcaagctggacggcggcaaggtgcacggcggcaacaccaacaagtacagcaccttcagcggcttcatcatctaccccgactag

SEQ ID NO: 3847 - DNA, 282 bp, Artificial Sequence
  Description of Artificial Sequence: Synthetic coding sequence
atgaagctgttcctggtgctgatcatcctgctgttcgaggtgctgaccgacggcgccagactgaagaagtgcttcaacaaggtgaccggctactgcagaaagaagtgcaaggtgggcgagagatacgagatcggctgcctgagcggcaagctgtgctgcgccaacgacgaggaggagaagaagcacgtgagcttcaagaagccccaccagcacagcggcgagaagctgagcgtgctgcaggactacatcatcctgcccaccatcaccatcttcaccgtgtag

SEQ ID NO: 3848 - DNA, 609 bp, Artificial Sequence
  Description of Artificial Sequence: Synthetic coding sequence
atggtgagaatctggaccaccatcatgatcgtgctgatcctgctgctgagaatcggccccaacaagcccagcctgagcggcagacaggcccccgcccaggcccagaccagcgacctggtgcccagcctgttccccctgggcctgtgggcccccggcttctgcacctggagcagccccgacgaggacaaggtgtggagacccgcctgggagcagggccccaagggcgagcccgaccccagaggcctgagacccagaaagcccgtgcccggcaccggcaacagagacagcggcaccagaagaagactgcaggacgccaccgagcaggaccccagacccggcaacgacgtggccagcgccgagaccgccggcccccccagccccagcggcatcagagcccaggacagagcccccagacacagaagagccccccccgccagaatgcccgtggcccccgcccccagcgccgacggcgagcccctgcaggagcagggcggcggcctgttccacagaaccagaagcgtgtacaacggcctggagctgaacacctggatgaaggtggagagactgttcgtggagaagttccaccagagcttcagcctggacaactag

SEQ ID NO: 3849 - DNA, 342 bp, Artificial Sequence
  Description of Artificial Sequence: Synthetic coding sequence
atgctgccctgcctggccctgctgctgctgatggagctgagcgtgtgcaccgtggccggcgacggcggcgaggagcagaccctgagcaccgaggccgagacctgggtgatcgtggccctggaggagggcgccggccccagcatccagctgcagctgcaggaggtgaagaccggcaaggccagccagttcttcggcctgatgggcaagagagtgggcggcagacccctgatccagcccagaagaaagaaggcctaccagctggagcacaccttccagggcctgctgggcaagagaagcctgttcaccgagggcagagaggacgaggcccagggcagcgagtag

SEQ ID NO: 3850 - DNA, 1269 bp, Artificial Sequence
  Description of Artificial Sequence: Synthetic coding sequence
atgggccccgcctggctgtggctgctgggcaccggcatcctggccagcgtgcactgccagcccctgctggcccacggcgacaagagcctgcagggcccccagccccccagacaccagctgagcgagcccgcccccgcctaccacagaatcacccccaccatcaccaacttcgccctgagactgtacaaggagctggccgccgacgcccccggcaacatcttcttcagccccgtgagcatcagcaccaccctggccctgctgagcctgggcgcccaggccaacaccagcgccctgatcctggagggcctgggcttcaacctgaccgagacccccgaggccgacatccaccagggcttcagaagcctgctgcacaccctggccctgcccagccccaagctggagctgaaggtgggcaacagcctgttcctggacaagagactgaagcccagacagcactacctggacagcatcaaggagctgtacggcgccttcgccttcagcgccaacttcaccgacagcgtgaccaccggcagacagatcaacgactacctgagaagacagacctacggccaggtggtggactgcctgcccgagttcagccaggacaccttcatggtgctggccaactacatcttcttcaaggccaagtggaagcaccccttcagcagataccagacccagaagcaggagagcttcttcgtggacgagagaaccagcctgcaggtgcccatgatgcaccagaaggagatgcacagattcctgtacgaccaggacctggcctgcaccgtgctgcagatcgagtacagaggcaacgccctggccctgctggtgctgcccgaccccggcaagatgaagcaggtggaggccgccctgcagccccagaccctgagaaagtggggccagctgctgctgcccagcctgctggacctgcacctgcccagattcagcatcagcggcacctacaacctggaggacatcctgccccagatcggcctgaccaacatcctgaacctggaggccgacttcagcggcgtgaccggccagctgaacaagaccatcagcaaggtgagccacaaggccatggtggacatgagcgagaagggcaccgaggccggcgccgccagcggcctgctgagccagccccccagcctgaacaccatgagcgacccccacgcccacttcaacagacccttcctgctgctgctgtgggaggtgaccacccagagcctgctgttcctgggcaaggtggtgaaccccgtggccggctag

SEQ ID NO: 3851 - DNA, 237 bp, Artificial Sequence
  Description of Artificial Sequence: Synthetic coding sequence
atggccctgatcagaaagaccttctacttcctgttcgccatgttcttcatcctggtgcagctgcccagcggctgccaggccggcctggacttcagccagcccttccccagcggcgagttcgccgtgtgcgagagctgcaagctgggcagaggcaagtgcagaaaggagtgcctggagaacgagaagcccgacggcaactgcagactgaacttcctgtgctgcagacagagaatctag

SEQ ID NO: 3852 - DNA, 2139 bp, Artificial Sequence
  Description of Artificial Sequence: Synthetic coding sequence
atggccgccgccggcctggtggccgtggccgccgccgccgagtacagcggcaccgtggccagcggcggcaacctgcccggcgtgcactgcggccccagcagcggcgccggccccggcttcggccccggcagctggagcagaagcctggacagagccctggaggaggccgccgtgaccggcgtgctgagcctgagcggcagaaagctgagagagttccccagaggcgccgccaaccacgacctgaccgacaccaccagagccgacctgagcagaaacagactgagcgagatccccatcgaggcctgccacttcgtgagcctggagaacctgaacctgtaccagaactgcatcagatacatccccgaggccatcctgaacctgcaggccctgaccttcctgaacatcagcagaaaccagctgagcaccctgcccgtgcacctgtgcaacctgcccctgaaggtgctgatcgccagcaacaacaagctggtgagcctgcccgaggagatcggccacctgagacacctgatggagctggacgtgagctgcaacgagatccagaccatccccagccagatcggcaacctggaggccctgagagacctgaacgtgagaagaaaccacctggtgcacctgcccgaggagctggccgagctgcccctgatcagactggacttcagctgcaacaagatcaccaccatccccgtgtgctacagaaacctgagacacctgcagaccatcaccctggacaacaaccccctgcagagcccccccgcccagatctgcatcaagggcaaggtgcacatcttcaagtacctgaacatccaggcctgcaagatcgcccccgacctgcccgactacgacagaagacccctgggcttcggcagctgccacgaggagctgtacagcagcagaccctacggcgccctggacagcggcttcaacagcgtggacagcggcgacaagagatggagcggcaacgagcccaccgacgagttcagcgacctgcccctgagagtggccgagatcaccaaggagcagagactgagaagagagagccagtaccaggagaacagaggcagcctggtggtgaccaacggcggcgtggagcacgacctggaccagatcgactacatcgacagctgcaccgccgaggaggaggaggccgaggtgagacagcccaagggccccgaccccgacagcctgagcagccagttcatggcctacatcgagcagagaagaatcagccacgagggcagccccgtgaagcccgtggccatcagagagttccagaagaccgaggacatgagaagatacctgcaccagaacagagtgcccgccgagcccagcagcctgctgagcctgagcgccagccacaaccagctgagccacaccgacctggagctgcaccagagaagagagcagctggtggagagaaccagaagagaggcccagctggccgccctgcagtacgaggaggagaagatcagaaccaagcagatccagagagacgccgtgctggacttcgtgaagcagaaggccagccagagcccccagaagcagcaccccctgctggacggcgtggacggcgagtgccccttccccagcagaagaagccagcacaccgacgacagcgccctgtgcatgagcctgagcggcctgaaccaggtgggctgcgccgccaccctgccccacagcagcgccttcacccccctgaagagcgacgacagacccaacgccctgctgagcagccccgccaccgagaccgtgcaccacagccccgcctacagcttccccgccgccatccagagaaaccagccccagagacccgagagcttcctgttcagagccggcgtgagagccgagaccaacaagggccacgccagccccctgccccccagcgccgcccccaccaccgacagcaccgacagcatcaccggccagaacagcagacagagagaggaggagctggagctgatcgaccagctgagaaagcacatcgagtacagactgaaggtgagcctgccctgcgacctgggcgccgccctgaccgacggcgtggtgctgtgccacctggccaaccacgtgagacccagaagcgtgcccagcatccacgtgcccagccccgccgtggtgagctag

SEQ ID NO: 3853 - DNA, 213 bp, Artificial Sequence
  Description of Artificial Sequence: Synthetic coding sequence
atgagagtgctgttcttcgtgttcggcgtgctgagcctgatgttcaccgtgccccccgccagaagcttcatcagcaacgacgagtgccccagcgagtactaccactgcagactgaagtgcaacgccgacgagcacgccatcagatactgcgccgacttcagcatctgctgcaagctgaagatcatcgagatcgacggccagaagaagtggtag

SEQ ID NO: 3854 - DNA, 789 bp, Artificial Sequence
  Description of Artificial Sequence: Synthetic coding sequence
atggccgccgccagcgccggcgccaccagactgctgctgctgctgctgatggccgtggccgcccccagcagagccagaggcagcggctgcagagccggcaccggcgccagaggcgccggcgccgagggcagagagggcgaggcctgcggcaccgtgggcctgctgctggagcacagcttcgagatcgacgacagcgccaacttcagaaagagaggcagcctgctgtggaaccagcaggacggcaccctgagcctgagccagagacagctgagcgaggaggagagaggcagactgagagacgtggccgccctgaacggcctgtacagagtgagaatccccagaagacccggcgccctggacggcctggaggccggcggctacgtgagcagcttcgtgcccgcctgcagcctggtggagagccacctgagcgaccagctgaccctgcacgtggacgtggccggcaacgtggtgggcgtgagcgtggtgacccaccccggcggctgcagaggccacgaggtggaggacgtggacctggagctgttcaacaccagcgtgcagctgcagccccccaccaccgcccccggccccgagaccgccgccttcatcgagagactggagatggagcaggcccagaaggccaagaacccccaggagcagaagagcttcttcgccaagtactggatgtacatcatccccgtggtgctgttcctgatgatgagcggcgcccccgacaccggcggccagggcggcggcggcggcggcggcggcggcggcggcagcggcagatag

SEQ ID NO: 3855 - DNA, 150 bp, Artificial Sequence
  Description of Artificial Sequence: Synthetic coding sequence
atggacagcagcagagagcccaccctgggcagactggacgccgccggcttctggcaggtgtggcagagattcgacgccgacggccacggccacgagagcaagttcgcccagggcgagaccgccgtgtacgactaccccagatgcctgtag

SEQ ID NO: 3856 - DNA, 213 bp, Artificial Sequence
  Description of Artificial Sequence: Synthetic coding sequence
atgcccggcgccatgaagatcttcgtgttcatcctggccgccctgatcctgctggcccagatcttccaggccagaaccgccatccacagagccctgatcagcaagagaatggagggccactgcgaggccgagtgcctgaccttcgaggtgaagatcggcggctgcagagccgagctggcccccttctgctgcaagaacagaaagaagcactag

SEQ ID NO: 3857 - DNA, 711 bp, Artificial Sequence
  Description of Artificial Sequence: Synthetic coding sequence
atgatgcccgccgagagaagactgcccctgagcttcgtgctggacgtgctggagggcagagcccagcaccccggcgtgctgtacgtgcagaagcagtgcagcaacctgcccagcgagctgccccagctgctgcccgacctggagagccacgtgccctgggccagcgaggccctgggcaagatgcccgacgccgtgaacttctggctgggcgaggccgccgccgtgaccagcctgcacaaggaccactacgagaacctgtactgcgtggtgagcggcgagaagcacttcctgttccacccccccagcgacagacccttcatcccctacggcctgagagtgcccggctgcctgcagttcccccacaccctgctgccctgggcccccgagctgtacacccccgccacctaccagctgaccgaggagggcaccttcaaggtggtggacgaggaggccatggagaaggtgccctggatccccctggaccccctggcccccgacctggccagataccccagctacagccaggcccaggccctgagatgcaccgtgagagccggcgagatgctgtacctgcccgccctgtggttccaccacgtgcagcagagccagggctgcatcgccgtgaacttctggtacgacatggagtacgacctgaagtacagctacttccagctgctggacagcctgaccaaggccagcggcctggactag

SEQ ID NO: 3858 - DNA, 1098 bp, Artificial Sequence
  Description of Artificial Sequence: Synthetic coding sequence
atggcccccaagctgatcaccgtgctgtgcctgggcttctgcctgaaccagaagatctgcccccacgccggcgcccaggacaagttcagcctgagcgcctggcccagccccgtggtgcccctgggcggcagagtgaccctgagctgccacagccacctgagattcgtgatctggaccatcttccagaccaccggcaccagaagccacgagctgcacaccggcctgagcaacaacatcaccatcagccccgtgacccccgagcacgccggcacctacagatgcgtgggcatctacaagcacgccagcaagtggagcgccgagagcaacagcctgaagatcatcgtgaccggcctgttcaccaagcccagcatcagcgcccaccccagcagcctggtgcacgccggcgccagagtgagcctgagatgccacagcgagctggccttcgacgagttcatcctgtacaaggagggccacatccagcacagccagcagctggaccagggcatggaggccggcatccactacgtggaggccgtgttcagcatgggccccgtgacccccgcccacgccggcgcctacagatgctgcggctgcttcagccacagcagatacgagtggagcgcccccagcgaccccctggacatcgtgatcaccggcaagtacaagaagcccagcctgagcacccaggtggaccccatgatgagactgggcgagaagctgaccctgttctgcagcagcgagatcagcttcgaccagtaccacctgttcagacacggcgtggcccacggccagtggctgagcggcggccagagacacagagaggccttccaggccaacttcagcgtgggcagagccacccccgtgcccggcggcacctacagatgctacggcagcttcaacgacagcccctacaagccccccgtgaccagatgcaacttcaccccccaggagaccctgagagtgctgctgtgccacagccagaacccccccctgaacctgacccccccctggcagacccagagccccagaaaggccaacggcagaatgaagagaagcctgcagcagaagagacacagaagaagctacatgcccagctag

SEQ ID NO: 3859 - DNA, 198 bp, Artificial Sequence
  Description of Artificial Sequence: Synthetic coding sequence
atgagaaccttcctgttcctgttcgccgtgctgttcttcctgacccccgccaagaacgccttcttcgacgagaagtgcaacaagctgaagggcacctgcaagaacaactgcggcaagaacgaggagctgatcgccctgtgccagaagagcctgaagtgctgcagaaccatccagccctgcggcagcatcatcgactag

SEQ ID NO: 3860 - DNA, 198 bp, Artificial Sequence; identical to SEQ ID NO: 3859
  Description of Artificial Sequence: Synthetic coding sequence

SEQ ID NO: 3861 - DNA, 237 bp, Artificial Sequence; identical to SEQ ID NO: 3851
  Description of Artificial Sequence: Synthetic coding sequence

SEQ ID NO: 3862 - DNA, 2868 bp, Artificial Sequence
  Description of Artificial Sequence: Synthetic coding sequence
atgtgggccggcctgctgctgagagccgcctgcgtggccctgctgctgcccggcgcccccgccagaggctacaccggcagaaagccccccggccacttcgccgccgagagaagaagactgggcccccacgtgtgcctgagcggcttcggcagcggctgctgccccggctgggcccccagcatgggcggcggccactgcaccctgcccctgtgcagcttcggctgcggcagcggcatctgcatcgcccccaacgtgtgcagctgccaggacggcgagcagggcgccacctgccccgagacccacggcccctgcggcgagtacggctgcgacctgacctgcaaccacggcggctgccaggaggtggccagagtgtgccccgtgggcttcagcatgaccgagaccgccgtgggcatcagatgcaccgacatcgacgagtgcgtgaccagcagctgcgagggccactgcgtgaacaccgagggcggcttcgtgtgcgagtgcggccccggcatgcagctgagcgccgacagacacagctgccaggacaccgacgagtgcctgggcaccccctgccagcagagatgcaagaacagcatcggcagctacaagtgcagctgcagaaccggcttccacctgcacggcaacagacacagctgcgtggacgtgaacgagtgcagaagacccctggagagaagagtgtgccaccacagctgccacaacaccgtgggcagcttcctgtgcacctgcagacccggcttcagactgagagccgacagagtgagctgcgaggccttccccaaggccgtgctggcccccagcgccatcctgcagcccagacagcaccccagcaagatgctgctgctgctgcccgaggccggcagacccgccctgagccccggccacagcccccccagcggcgcccccggcccccccgccggcgtgagaaccaccagactgcccagccccacccccagactgcccaccagcagccccagcgcccccgtgtggctgctgagcaccctgctggccacccccgtgcccaccgccagcctgctgggcaacctgagaccccccagcctgctgcagggcgaggtgatgggcacccccagcagccccagaggccccgagagccccagactggccgccggccccagcccctgctggcacctgggcgccatgcacgagagcagaagcagatggaccgagcccggctgcagccagtgctggtgcgaggacggcaaggtgacctgcgagaaggtgagatgcgaggccgcctgcagccaccccatccccagcagagacggcggctgctgccccagctgcaccggctgcttccacagcggcgtggtgagagccgagggcgacgtgttcagcccccccaacgagaactgcaccgtgtgcgtgtgcctggccggcaacgtgagctgcatcagccccgagtgccccagcggcccctgccagacccccccccagaccgactgctgcacctgcgtgcccgtgagatgctacttccacggcagatggtacgccgacggcgccgtgttcagcggcggcggcgacgagtgcaccacctgcgtgtgccagaacggcgaggtggagtgcagcttcatgccctgccccgagctggcctgccccagagaggagtggagactgggccccggccagtgctgcttcacctgccaggagcccacccccagcaccggctgcagcctggacgacaacggcgtggagttccccatcggccagatctggagccccggcgacccctgcgagctgtgcatctgccaggccgacggcagcgtgagctgcaagagaaccgactgcgtggacagctgcccccaccccatcagaatccccggccagtgctgccccgactgcagcgccggctgcacctacaccggcagaatcttctacaacaacgagaccttccccagcgtgctggacccctgcctgagctgcatctgcctgctgggcagcgtggcctgcagccccgtggactgccccatcacctgcacctaccccttccaccccgacggcgagtgctgccccgtgtgcagagactgcaactacgagggcagaaaggtggccaacggccaggtgttcaccctggacgacgagccctgcaccagatgcacctgccagctgggcgaggtgagctgcgagaaggtgccctgccagagagcctgcgccgaccccgccctgctgcccggcgactgctgcagcagctgccccgacagcctgagccccctggaggagaagcagggcctgagcccccacggcaacgtggccttcagcaaggccggcagaagcctgcacggcgacaccgaggcccccgtgaactgcagcagctgccccggcccccccaccgccagccccagcagacccgtgctgcacctgctgcagctgctgctgagaaccaacctgatgaagacccagaccctgcccaccagccccgccggcgcccacggcccccacagcctggccctgggcctgaccgccaccttccccggcgagcccggcgccagccccagactgagccccggccccagcaccccccccggcgcccccaccctgcccctggccagccccggcgccccccagcccccccccgtgacccccgagagaagcttcagcgccagcggcgcccagatcgtgagcagatggccccccctgcccggcaccctgctgaccgaggccagcgccctgagcatgatggaccccagccccagcaagacccccatcaccctgctgggccccagagtgctgagccccaccaccagcagactgagcaccgccctggccgccaccacccaccccggcccccagcagccccccgtgggcgccagcagaggcgaggagagcaccatgtag

SEQ ID NO: 3863 - DNA, 270 bp, Artificial Sequence
  Description of Artificial Sequence: Synthetic coding sequence
atggtgagctgcgagagaagagccagcaagagcgtgggccagatcctgctgtgggacttcggctacacctgcagactgagccacagaagaagaaacagcaccgagatcctgagcagaaacctgcccgccctgtacaccggcatcaaggtgtgcgagaagagacccagcatcgacctgtgcatccaccactgcagctacttccagaagtgcgagaccaacaagatctgctgcagcgccttctgcggcaacatctgcatgagcatcctgtag

SEQ ID NO: 3864 - DNA, 600 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcaccgacgaggagatgcagtacgacatggccaagagcggccaggagaagcagaccatcgagatcctgatgaaccccatcctgctggtgaagaacaccagcctgagcatgagcaaggacgacatgagcagcaccctgctgaccttcagaagcctgcactacaacgaccccaagggcaacagcagcggcaacgacaaggagtgctgcaacgacatgaccgtgtggagaaaggtgagcgaggccaacggcagctgcaagtggagcaacaacttcatcagaagcagcaccgaggtgatgagaagagtgcacagagcccccagctgcaagttcgtgcagaaccccggcatcagctgctgcgagagcctggagctggagaacaccgtgtgccagttcaccaccggcaagcagttccccagatgccagtaccacagcgtgaccagcctggagaagatcctgaccgtgctgaccggccacagcctgatgagctggctggtgtgcggcagcaagctgtag

SEQ ID NO: 3865 - DNA, 729 bp, Artificial Sequence
  Description of Artificial Sequence: Synthetic coding sequence
atggccgccgccaccagaggctgcagaccctggggcagcctgctgggcctgctgggcctggtgagcgccgccgccgccgcctgggacctggccagcctgagatgcaccctgggcgccttctgcgagtgcgacttcagacccgacctgcccggcctggagtgcgacctggcccagcacctggccggccagcacctggccaaggccctggtggtgaaggccctgaaggccttcgtgagagaccccgcccccaccaagcccctggtgctgagcctgcacggctggaccggcaccggcaagagctacgtgagcagcctgctggcccactacctgttccagggcggcctgagaagccccagagtgcaccacttcagccccgtgctgcacttcccccaccccagccacatcgagagatacaagaaggacctgaagagctgggtgcagggcaacctgaccgcctgcggcagaagcctgttcctgttcgacgagatggacaagatgccccccggcctgatggaggtgctgagacccttcctgggcagcagctgggtggtgtacggcaccaactacagaaaggccatcttcatcttcatcagatggctgctgaagctgggccaccacggcagagccccccccagaagaagcggcgccctgccccccgcccccgccgcccccagacccgccctgagagcccagagagccggccccgccggccccggcgccaagggctag

SEQ ID NO: 3866 - DNA, 627 bp, Artificial Sequence
  Description of Artificial Sequence: Synthetic coding sequence
atgctgggcctgctggtggccctgctggccctgggcctggccgtgttcgccctgctggacgtgtggtacctggtgagactgccctgcgccgtgctgagagccagactgctgcagcccagagtgagagacctgctggccgagcagagattccccggcagagtgctgcccagcgacctggacctgctgctgcacatgaacaacgccagatacctgagagaggccgacttcgccagagtggcccacctgaccagatgcggcgtgctgggcgccctgagagagctgagagcccacaccgtgctggccgccagctgcgccagacacagaagaagcctgagactgctggagcccttcgaggtgagaaccagactgctgggctgggacgacagagccttctacctggaggccagattcgtgagcctgagagacggcttcgtgtgcgccctgctgagattcagacagcacctgctgggcaccagccccgagagagtggtgcagcacctgtgccagagaagagtggagccccccgagctgcccgccgacctgcagcactggatcagctacaacgaggccagcagccagctgctgagaatggagagcggcctgagcgacgtgaccaaggaccagtag

SEQ ID NO: 3867 - DNA, 423 bp, Artificial Sequence
  Description of Artificial Sequence: Synthetic coding sequence
atgctggtgaagctgaacagccaggccagactgagcagcatggtgaagaaggtgagactgcccagcagatgcgagccccccggcaccacctgcaccgtgagcggctggggcaccaccaccagccccgacgtgaccttccccagcgacctgatgtgcgtggacgtgaagctgatcagcccccaggactgcaccaaggtgtacaaggacctgctggagaacagcatgctgtgcgccggcatccccgacagcaagaagaacgcctgcaacggcgacagcggcggccccctggtgtgcagaggcaccctgcagggcctggtgagctggggcaccttcccctgcggccagcccaacgaccccggcgtgtacacccaggtgtgcaagttcaccaagtggatcaacgacaccatgaagaagcacagatag

SEQ ID NO: 3868 - DNA, 354 bp, Artificial Sequence
  Description of Artificial Sequence: Synthetic coding sequence
atgctgagcaaggcccacggctgcaagaccgccctgagcctgggcagatgccccaagatcagagaggagtgcgagttccaggagagagacgtgtgcaccaaggacagacagtgccaggacaacaagaagtgctgcgtgttcagctgcggcaagaagtgcctggacctgaagcaggacgtgtgcgagatgcccaaggagaccggcccctgcctggcctacttcctgcactggtggtacgacaagaaggacaacacctgcagcatgttcgtgtacggcggctgccagggcaacaacaacaacttccagagcaaggccaactgcctgaacacctgcaagaacaagagattcccctag

SEQ ID NO: 3869 - DNA, 2328 bp, Artificial Sequence
  Description of Artificial Sequence: Synthetic coding sequence
atgcaccccggccccgaggaggccggcagcggcagatacggccccagatacatcaccgacatgggcgccggcgaggacgacgagggcttcgaggacgacctggacctggacatcagcttcgaggaggtgaagcccctgcccgccaccaagggcggcaacaagaagttcctggtggagagcaagaagatgagcatcagcaaccccaagaccatcagcagactgatcccccccaccagcgccagcctgcccgtgaccaccgtggccccccagcccatccccatccagagaaagggcaagaacggcgtggccatcatgagcagactgttcgacatgccctgcgacgagaccctgtgcagcgccgacagcttctgcgtgaacgactacacctggggcggcagcagatgccagtgcaccctgggcaagggcggcgagagctgcagcgaggacatcgtgatccagtacccccagttcttcggccacagctacgtgaccttcgagcccctgaagaacagctaccaggccttccagatcaccctggagttcagagccgaggccgaggacggcctgctgctgtactgcggcgagaacgagcacggcagaggcgacttcatgagcctggccatcatcagaagaagcctgcagttcagattcaactgcggcaccggcgtggccatcatcgtgagcgagaccaagatcaagctgggcggctggcacaccgtgatgctgtacagagacggcctgaacggcctgctgcagctgaacaacggcacccccgtgaccggccagagccagggccagtacagcaagatcaccttcagaacccccctgtacctgggcggcgcccccagcgcctactggctggtgagagccaccggcaccaacagaggcttccagggctgcgtgcagagcctggccgtgaacggcagaagaatcgacatgagaccctggcccctgggcaaggccctgagcggcgccgacgtgggcgagtgcagcagcggcatctgcgacgaggccagctgcatccacggcggcacctgcaccgccatcaaggccgacagctacatctgcctgtgccccctgggcttcaagggcagacactgcgaggacgccttcaccctgaccatcccccagttcagagagagcctgagaagctacgccgccaccccctggcccctggagccccagcactacctgagcttcatggagttcgagatcaccttcagacccgacagcggcgacggcgtgctgctgtacagctacgacaccggcagcaaggacttcctgagcatcaacctggccggcggccacgtggagttcagattcgactgcggcagcggcaccggcgtgctgagaagcgaggaccccctgaccctgggcaactggcacgagctgagagtgagcagaaccgccaagaacggcatcctgcaggtggacaagcagaagatcgtggagggcatggccgagggcggcttcacccagatcaagtgcaacaccgacatcttcatcggcggcgtgcccaactacgacgacgtgaagaagaacagcggcgtgctgaagcccttcagcggcagcatccagaagatcatcctgaacgacagaaccatccacgtgaagcacgacttcaccagcggcgtgaacgtggagaacgccgcccacccctgcgtgagagccccctgcgcccacggcggcagctgcagacccagaaaggagggctacgactgcgactgccccctgggcttcgagggcctgcactgccagaaggccatcatcgaggccatcgagatcccccagttcatcggcagaagctacctgacctacgacaaccccgacatcctgaagagagtgagcggcagcagaagcaacgtgttcatgagattcaagaccaccgccaaggacggcctgctgctgtggagaggcgacagccccatgagacccaacagcgacttcatcagcctgggcctgagagacggcgccctggtgttcagctacaacctgggcagcggcgtggccagcatcatggtgaacggcagcttcaacgacggcagatggcacagagtgaaggccgtgagagacggccagagcggcaagatcaccgtggacgactacggcgccagaaccggcaagagccccggcatgatgagacagctgaacatcaacggcgccctgtacgtgggcggcatgaaggagatcgccctgcacaccaacagacagtacatgagaggcctggtgggctgcatcagccacttcaccctgagcaccgactaccacatcagcctggtggaggacgccgtggacggcaagaacatcaacacctgcggcgccaagtag

SEQ ID NO: 3870 - DNA, 1257 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaaggtgaagttctgcagctgctgccccggctggagcgccatggccagaagctggctgaccgccaccagcgccacccagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctacgtgaccccctggaacagccacggctacgacgtgaccaaggtgttcggcagcaagttcacccagatcagccccgtgtggctgcagctgaagagaagaggcagagagatgttcgaggtgaccggcctgcacgacgtggaccagggctggatgagagccgtgagaaagcacgccaagggcctgcacatcgtgcccagactgctgttcgaggactggacctacgacgacttcagaaacgtgctggacagcgaggacgagatcgaggagctgagcaagaccgtggtgcaggtggccaagaaccagcacttcgacggcttcgtggtggaggtgtggaaccagctgctgagccagaagagagtgggcctgatccacatgctgacccacctggccgaggccctgcaccaggccagactgctggccctgctggtgatcccccccgccatcacccccggcaccgaccagctgggcatgttcacccacaaggagttcgagcagctggcccccgtgctggacggcttcagcctgatgacctacgactacagcaccgcccaccagcccggccccaacgcccccctgagctgggtgagagcctgcgtgcaggtgctggaccccaagagcaagtggagaagcaagatcctgctgggcctgaacttctacggcatggactacgccaccagcaaggacgccagagagcccgtggtgggcgccagatacatccagaccctgaaggaccacagacccagaatggtgtgggacagccaggccagcgagcacttcttcgagtacaagaagagcagaagcggcagacacgtggtgttctaccccaccctgaagagcctgcaggtgagactggagctggccagagagctgggcgtgggcgtgagcatctgggagctgggccagggcctggactacttctacgacctgctgtag

SEQ ID NO: 3871 - DNA, 813 bp, Artificial Sequence
  Description of Artificial Sequence: Synthetic coding sequence
atgatgctgagactgctgagcagcctgctgctggtggccgtggccagcggctacggcccccccagcagcagacccagcagcagagtggtgaacggcgaggacgccgtgccctacagctggccctggcaggtgagcctgcagtacgagaagagcggcagcttctaccacacctgcggcggcagcctgatcgcccccgactgggtggtgaccgccggccactgcatcagcagcagcagaacctaccaggtggtgctgggcgagtacgacagagccgtgaaggagggccccgagcaggtgatccccatcaacagcggcgacctgttcgtgcaccccctgtggaacagaagctgcgtggcctgcggcaacgacatcgccctgatcaagctgagcagaagcgcccagctgggcgacgccgtgcagctggccagcctgccccccgccggcgacatcctgcccaacgagaccccctgctacatcaccggctggggcagactgtacaccaacggccccctgcccgacaagctgcaggaggccctgctgcccgtggtggactacgagcactgcagcagatggaactggtggggcagcagcgtgaagaagaccatggtgtgcgccggcggcgacatcagaagcggctgcaacggcgacagcggcggccccctgaactgccccaccgaggacggcggctggcaggtgcacggcgtgaccagcttcgtgagcgccttcggctgcaacaccagaagaaagcccaccgtgttcaccagagtgagcgccttcatcgactggatcgaggagaccatcgccagccactag

SEQ ID NO: 3872 - DNA, 585 bp, Artificial Sequence; identical to SEQ ID NO: 3585
  Description of Artificial Sequence: Synthetic coding sequence

SEQ ID NO: 3873 - DNA, 1308 bp, Artificial Sequence
  Description of Artificial Sequence: Synthetic coding sequence
atgcagggccagggcagaagaagaggcacctgcaaggacatcttctgcagcaagatggccagctacctgtacggcgtgctgttcgccgtgggcctgtgcgcccccatctactgcgtgagccccgccaacgcccccagcgcctaccccagacccagcagcaccaagagcacccccgccagccaggtgtacagcctgaacaccgacttcgccttcagactgtacagaagactggtgctggagacccccagccagaacatcttcttcagccccgtgagcgtgagcaccagcctggccatgctgagcctgggcgcccacagcgtgaccaagacccagatcctgcagggcctgggcttcaacctgacccacacccccgagagcgccatccaccagggcttccagcacctggtgcacagcctgaccgtgcccagcaaggacctgaccctgaagatgggcagcgccctgttcgtgaagaaggagctgcagctgcaggccaacttcctgggcaacgtgaagagactgtacgaggccgaggtgttcagcaccgacttcagcaaccccagcatcgcccaggccagaatcaacagccacgtgaagaagaagacccagggcaaggtggtggacatcatccagggcctggacctgctgaccgccatggtgctggtgaaccacatcttcttcaaggccaagtgggagaagcccttccaccccgagtacaccagaaagaacttccccttcctggtgggcgagcaggtgaccgtgcacgtgcccatgatgcaccagaaggagcagttcgccttcggcgtggacaccgagctgaactgcttcgtgctgcagatggactacaagggcgacgccgtggccttcttcgtgctgcccagcaagggcaagatgagacagctggagcaggccctgagcgccagaaccctgagaaagtggagccacagcctgcagaagagatggatcgaggtgttcatccccagattcagcatcagcgccagctacaacctggagaccatcctgcccaagatgggcatccagaacgtgttcgacaagaacgccgacttcagcggcatcgccaagagagacagcctgcaggtgagcaaggccacccacaaggccgtgctggacgtgagcgaggagggcaccgaggccaccgccgccaccaccaccaagttcatcgtgagaagcaaggacggccccagctacttcaccgtgagcttcaacagaaccttcctgatgatgatcaccaacaaggccaccgacggcatcctgttcctgggcaaggtggagaaccccaccaagagctag

SEQ ID NO: 3874 - DNA, 393 bp, Artificial Sequence
  Description of Artificial Sequence: Synthetic coding sequence
atggccagcgacctgatcagaaccatcctggccgtggccctgatcagcaagctgggcaccgccgtggacgccgagctgatgcccagcggcgccatcctgcagaacaagagagagaacctgcccagagtgtgccacgccctggccttcctgggcatggccagatgccaggacctgttcctggtgagactgcagggctggaagctgggcaccagattccaggacggccccagaagcaccccccaggaggagggcggcagcccccagagaaagagaggcatgcccgtgcagatccacttcctgctgaagagcttcctgagcagccccatcaccttcgccttcatcagcctggccagaaccgtgagcctggccaccgccatctgcaagatcgtgtag

SEQ ID NO: 3875 - DNA, 837 bp, Artificial Sequence
  Description of Artificial Sequence: Synthetic coding sequence
atgcagtggctgagagtgagagagagccccggcgaggccaccggccacagagtgaccatgggcaccgccgccctgggccccgtgtgggccgccctgctgctgttcctgctgatgtgcgagatccccatggtggagctgaccttcgacagagccgtggccagcggctgccagagatgctgcgacagcgaggaccccctggaccccgcccacgtgagcagcgccagcagcagcggcagaccccacgccctgcccgagatcagaccctacatcaacatcaccatcctgaagggcgacaagggcgaccccggccccatgggcctgcccggctacatgggcagagagggcccccagggcgagcccggcccccagggcagcaagggcgacaagggcgagatgggcagccccggcgccccctgccagaagagattcttcgccttcagcgtgggcagaaagaccgccctgcacagcggcgaggacttccagaccctgctgttcgagagagtgttcgtgaacctggacggctgcttcgacatggccaccggccagttcgccgcccccctgagaggcatctacttcttcagcctgaacgtgcacagctggaactacaaggagacctacgtgcacatcatgcacaaccagaaggaggccgtgatcctgtacgcccagcccagcgagagaagcatcatgcagagccagagcgtgatgctggacctggcctacggcgacagagtgtgggtgagactgttcaagagacagagagagaacgccatctacagcaacgacttcgacacctacatcaccttcagcggccacctgatcaaggccgaggacgactag

SEQ ID NO: 3876 - DNA, 1635 bp, Artificial Sequence
  Description of Artificial Sequence: Synthetic coding sequence
atgtgcaccgtggtggaccccagaatcgtgagaagatacctgctgagaagacagctgggccagggcgcctacggcatcgtgtggaaggccgtggacagaagaaccggcgaggtggtggccatcaagaagatcttcgacgccttcagagacaagaccgacgcccagagaaccttcagagagatcaccctgctgcaggagttcggcgaccaccccaacatcatcagcctgctggacgtgatcagagccgagaacgacagagacatctacctggtgttcgagttcatggacaccgacctgaacgccgtgatcagaaagggcggcctgctgcaggacgtgcacgtgagaagcatcttctaccagctgctgagagccaccagattcctgcacagcggccacgtggtgcacagagaccagaagcccagcaacgtgctgctggacgccaactgcaccgtgaagctgtgcgacttcggcctggccagaagcctgggcgacctgcccgagggccccgaggaccaggccgtgaccgagtacgtggccaccagatggtacagagcccccgaggtgctgctgagcagccacagatacaccctgggcgtggacatgtggagcctgggctgcatcctgggcgagatgctgagaggcagacccctgttccccggcaccagcaccctgcaccagctggagctgatcctggagaccatccccccccccagcgaggaggacctgctggccctgggcagcggctgcagagccagcgtgctgcaccagctgggcagcagacccagacagaccctggacgccctgctgccccccgacaccagccccgaggccctggacctgctgagaagactgctggtgttcgcccccgacaagagactgagcgccacccaggccctgcagcacccctacgtgcagagattccactgccccagcgacgagtgggccagagaggccgacgtgagacccagagcccacgagggcgtgcagctgagcgtgcccgagtacagaagcagagtgtaccagatgatcctggagtgcggcggcagcagcggcaccagcagagagaagggccccgagggcgtgagccccagccaggcccacctgcacaagcccagagccgacccccagctgcccagcagaacccccgtgcagggccccagacccagaccccagagcagccccggccacgaccccgccgagcacgagagccccagagccgccaagaacgtgcccagacagaacagcgcccccctgctgcagaccgccctgctgggcaacggcgagagaccccccggcgccaaggaggccccccccctgaccctgagcctggtgaagcccagcggcagaggcgccgcccccagcctgaccagccaggccgccgcccaggtggccaaccaggccctgatcagaggcgactggaacagaggcggcggcgtgagagtggccagcgtgcagcaggtgccccccagactgccccccgaggccagacccggcagaagaatgttcagcaccagcgccctgcagggcgcccagggcggcgccagagccctgctgggcggctacagccaggcctacggcaccgtgtgccacagcgccctgggccacctgcccctgctggagggccaccacgtgtag

SEQ ID NO: 3877 - DNA, 399 bp, Artificial Sequence
  Description of Artificial Sequence: Synthetic coding sequence
atgaagagcagcggcctgttccccttcctggtgctgctggccctgggcaccctggccccctgggccgtggagggcagcggcaagagcttcaaggccggcgtgtgcccccccaagaagagcgcccagtgcctgagatacaagaagcccgagtgccagagcgactggcagtgccccggcaagaagagatgctgccccgacacctgcggcatcaagtgcctggaccccgtggacacccccaaccccaccagaagaaagcccggcaagtgccccgtgacctacggccagtgcctgatgctgaacccccccaacttctgcgagatggacggccagtgcaagagagacctgaagtgctgcatgggcatgtgcggcaagagctgcgtgagccccgtgaaggcctag

SEQ ID NO: 3878 - DNA, 1401 bp, Artificial Sequence
  Description of Artificial Sequence: Synthetic coding sequence
atgaagccccccctgctggtgttcatcgtgtgcctgctgtggctgaaggacagccactgcgcccccacctggaaggacaagaccgccatcagcgagaacctgaagagcttcagcgaggtgggcgagatcgacgccgacgaggaggtgaagaaggccctgaccggcatcaagcagatgaagatcatgatggagagaaaggagaaggagcacaccaacctgatgagcaccctgaagaagtgcagagaggagaagcaggaggccctgaagctgctgaacgaggtgcaggagcacctggaggaggaggagagactgtgcagagagagcctggccgacagctggggcgagtgcagaagctgcctggagaacaactgcatgagaatctacaccacctgccagcccagctggagcagcgtgaagaacaagatcgagagattcttcagaaagatctaccagttcctgttccccttccacgaggacaacgagaaggacctgcccatcagcgagaagctgatcgaggaggacgcccagctgacccagatggaggacgtgttcagccagctgaccgtggacgtgaacagcctgttcaacagaagcttcaacgtgttcagacagatgcagcaggagttcgaccagaccttccagagccacttcatcagcgacaccgacctgaccgagccctacttcttccccgccttcagcaaggagcccatgaccaaggccgacctggagcagtgctgggacatccccaacttcttccagctgttctgcaacttcagcgtgagcatctacgagagcgtgagcgagaccatcaccaagatgctgaaggccatcgaggacctgcccaagcaggacaaggcccccgaccacggcggcctgatcagcaagatgctgcccggccaggacagaggcctgtgcggcgagctggaccagaacctgagcagatgcttcaagttccacgagaagtgccagaagtgccaggcccacctgagcgaggactgccccgacgtgcccgccctgcacaccgagctggacgaggccatcagactggtgaacgtgagcaaccagcagtacggccagatcctgcagatgaccagaaagcacctggaggacaccgcctacctggtggagaagatgagaggccagttcggctgggtgagcgagctggccaaccaggcccccgagaccgagatcatcttcaacagcatccaggtggtgcccagaatccacgagggcaacatcagcaagcaggacgagaccatgatgaccgacctgagcatcctgcccagcagcaacttcaccctgaagatccccctggaggagagcgccgagagcagcaacttcatcggctacgtggtggccaaggccctgcagcacttcaaggagcacttcaagacctggtag

SEQ ID NO: 3879 - DNA, 522 bp, Artificial Sequence
  Description of Artificial Sequence: Synthetic coding sequence
atgcactggaagatgctgctgctgctgctgctgtactacaacgccgaggccagcatgtgccacagatggagcagagccgtgctgttccccgccgcccacagacccaagagaagcagcagcctgcccctgaaccccgtgctgcagaccagcctggaggaggtggagctgctgtacgagttcctgctggccgagctggagatcagccccgacctgcagatcagcatcaaggacgaggagctggccagcctgagaaaggccagcgacttcagaaccgtgtgcaacaacgtgatccccaagagcatccccgacatcagaagactgagcgccagcctgagcagccaccccggcatcctgaagaaggaggacttcgagagaaccgtgctgaccctggcctacaccgcctacagaaccgccctgagccacggccaccagaaggacatctgggcccagagcctggtgagcctgttccaggccctgagacacgacctgatgagaagcagccagcccggcgtgcccccctag

SEQ ID NO: 3880 - DNA, 1473 bp, Artificial Sequence
  Description of Artificial Sequence: Synthetic coding sequence
atggaggacagcgacagcgccgccaagcagctgggcctggccgaggccgccgccgtggccgccgccgccgccgtggccgccgccgccgccgccgccgccggcggcgaggccgaggagcccgtgctgagcagagacgaggacagcgaggaggacgccgacagcgaggccgagagagagacccccagagtgaccgccgtggccgtgatggccgccgagcccggccacatggacatgggcgccgaggccctgcccggccccgacgaggccgccgccgccgccgccttcgccgaggtgaccaccgtgaccgtggccaacgtgggcgccgccgccgacaacgtgttcaccaccagcgtggccaacgccgccagcatcagcggccacgtgctgagcggcagaaccgccctgcagatcggcgacagcctgaacaccgagaaggccaccctgatcgtggtgcacaccgacggcagcatcgtggagaccaccggcctgaagggccccgccgcccccctgacccccggcccccagagcccccccacccccctggcccccggccaggagaagggcggcaccaagtacaactgggaccccagcgtgtacgacagcgagctgcccgtgagatgcagaaacatcagcggcaccctgtacaagaacagactgggcagcggctgggacctgaagcccagcagatgcctgctgcacctgtgctgcctgctgagaagacacgacctgatcaccgtgacccccagcggccagatcaccaccagcggcgccctgaccttcgacagagccagcaccgtggaggccaccgccgtgatcagcgagagccccgcccagggcgacgtgttcgccggcgccaccgtgcaggaggccagcgtgcagcccccctgcagagccagccaccccgagccccactaccccggctaccaggacagctgccagatcgcccccttccccgaggccgccctgcccaccagccaccccaagatcgtgctgaccagcctgcccgccctggccgtgcccccccccacccccaccaaggccgccccccccgccctggtgaacggcctggagctgagcgagcccagaagctggctgtacctggaggagatggtgaacagcctgctgaacaccgcccagcagctgaagaccctgttcgagcaggccaagcacgccagcacctacagagaggccgccaccaaccaggccaagatccacgccgacgccgagagaaaggaggtgatccacccccccagactgcccaaggtgctgggcctgcagcagagctgcgtgaactgcggcagagaggccatgagcgagtgcaccggctgccacaaggtgaactactgcagcaccttctgccagagaaaggactggaaggaccaccagcacatctgcggccagagcgccgccgtgaccgtgcaggccgacgaggtgcacgtggccgagagcgtgatggagaaggtgaccgtgtag

SEQ ID NO: 3881 - DNA, 1476 bp, Artificial Sequence
  Description of Artificial Sequence: Synthetic coding sequence
atgcccagcaccgtgctgcccagcaccgtgctgcccagcctgctgcccaccgccggcgccggctggagcatgagatggatcctgtgctggagcctgaccctgtgcctgatggcccagaccgccctgggcgccctgcacaccaagagaccccaggtggtgaccaagtacggcaccctgcagggcaagcagatgcacgtgggcaagacccccatccaggtgttcctgggcgtgcccttcagcagaccccccctgggcatcctgagattcgccccccccgagccccccgagccctggaagggcatcagagacgccaccacctacccccccggctgcctgcaggagagctggggccagctggccagcatgtacgtgagcaccagagagagatacaagtggctgagattcagcgaggactgcctgtacctgaacgtgtacgcccccgccagagcccccggcgacccccagctgcccgtgatggtgtggttccccggcggcgccttcatcgtgggcgccgccagcagctacgagggcagcgacctggccgccagagagaaggtggtgctggtgttcctgcagcacagactgggcatcttcggcttcctgagcaccgacgacagccacgccagaggcaactggggcctgctggaccagatggccgccctgagatgggtgcaggagaacatcgccgccttcggcggcgaccccggcaacgtgaccctgttcggccagagcgccggcgccatgagcatcagcggcctgatgatgagccccctggccagcggcctgttccacagagccatcagccagagcggcaccgccctgttcagactgttcatcaccagcaaccccctgaaggtggccaagaaggtggcccacctggccggctgcaaccacaacagcacccagatcctggtgaactgcctgagagccctgagcggcaccaaggtgatgagagtgagcaacaagatgagattcctgcagctgaacttccagagagaccccgaggagatcatctggagcatgagccccgtggtggacggcgtggtgatccccgacgaccccctggtgctgctgacccagggcaaggtgagcagcgtgccctacctgctgggcgtgaacaacctggagttcaactggctgctgccctacatcatgaagttccccctgaacagacaggccatgagaaaggagaccatcaccaagatgctgtggagcaccagaaccctgctgaacatcaccaaggagcaggtgcccctggtggtggaggagtacctggacaacgtgaacgagcacgactggaagatgctgagaaacagaatgatggacatcgtgcaggacgccaccttcgtgtacgccaccctgcagaccgcccactaccacagagagacccccatgatgggcatctgccccgccggccacgccaccaccagaatgaagagcacctgcagctggatcctgccccaggagtgggcctag

SEQ ID NO: 3882 - DNA, 753 bp, Artificial Sequence
  Description of Artificial Sequence: Synthetic coding sequence
atgcccgccagcagccccttcctgctggcccccaagggcccccccggcaacatgggcggccccgtgagagagcccgccctgagcgtggccctgtggctgagctggggcgccgccctgggcgccgtggcctgcgccatggccctgctgacccagcagaccgagctgcagagcctgagaagagaggtgagcagactgcagggcaccggcggccccagccagaacggcgagggctacccctggcagagcctgcccgagcagagcagcgacgccctggaggcctgggagaacggcgagagaagcagaaagagaagagccgtgctgacccagaagcagaagaagcagcacagcgtgctgcacctggtgcccatcaacgccaccagcaaggacgacagcgacgtgaccgaggtgatgtggcagcccgccctgagaagaggcagaggcctgcaggcccagggctacggcgtgagaatccaggacgccggcgtgtacctgctgtacagccaggtgctgttccaggacgtgaccttcaccatgggccaggtggtgagcagagagggccagggcagacaggagaccctgttcagatgcatcagaagcatgcccagccaccccgacagagcctacaacagctgctacagcgccggcgtgttccacctgcaccagggcgacatcctgagcgtgatcatccccagagccagagccaagctgaacctgagcccccacggcaccttcctgggcttcgtgaagctgtag

SEQ ID NO: 3883 - DNA, 1437 bp, Artificial Sequence
  Description of Artificial Sequence: Synthetic coding sequence
atgagcccccccctgctgaagctgggcgccgtgctgagcaccatggccatgatcagcaactggatgagccagaccctgcccagcctggtgggcctgaacaccaccagactgagcacccccgacaccctgacccagatcagccccaaggagggctggcaggtgtacagcagcgcccaggaccccgacggcagatgcatctgcaccgtggtggcccccgagcagaacctgtgcagcagagacgccaagagcagacagctgagacagctgctggagaaggtgcagaacatgagccagagcatcgaggtgctgaacctgagaacccagagagacttccagtacgtgctgaagatggagacccagatgaagggcctgaaggccaagttcagacagatcgaggacgacagaaagaccctgatgaccaagcacttccaggagctgaaggagaagatggacgagctgctgcccctgatccccgtgctggagcagtacaagaccgacgccaagctgatcacccagttcaaggaggagatcagaaacctgagcgccgtgctgaccggcatccaggaggagatcggcgcctacgactacgaggagctgcaccagagagtgctgagcctggagaccagactgagagactgcatgaagaagctgacctgcggcaagctgatgaagatcaccggccccgtgaccgtgaagaccagcggcaccagattcggcgcctggatgaccgaccccctggccagcgagaagaacaacagagtgtggtacatggacagctacaccaacaacaagatcgtgagagagtacaagagcatcgccgacttcgtgagcggcgccgagagcagaacctacaacctgcccttcaagtgggccggcaccaaccacgtggtgtacaacggcagcctgtacttcaacaagtaccagagcaacatcatcatcaagtacagcttcgacatgggcagagtgctggcccagagaagcctggagtacgccggcttccacaacgtgtacccctacacctggggcggcttcagcgacatcgacctgatggccgacgagatcggcctgtgggccgtgtacgccaccaaccagaacgccggcaacatcgtgatcagccagctgaaccaggacaccctggaggtgatgaagagctggagcaccggctaccccaagagaagcgccggcgagagcttcatgatctgcggcaccctgtacgtgaccaacagccacctgaccggcgccaaggtgtactacagctacagcaccaagaccagcacctacgagtacaccgacatccccttccacaaccagtacttccacatcagcatgctggactacaacgccagagacagagccctgtacgcctggaacaacggccaccaggtgctgttcaacgtgaccctgttccacatcatcaagaccgaggacgacacctag

SEQ ID NO: 3884 - DNA, 1101 bp, Artificial Sequence
  Description of Artificial Sequence: Synthetic coding sequence
atggccagagagagaccccccggcagaggctgcggcgtgctgagaagatgcctgctgggcgccgtgctgctgttcggcctgagactgtgcgccgagctgagaagagccggccccggcagccccaccagaagcgccccccccggccccgcctggagaccccccggcccccacctgccccccgcccccggccagcccagaggcgccagcagaagacaggtgacctacgtgagaagcggcagaagagccccccccggcggcggcggcagcggcacccccgagcccggctgctgcgcccccagaggcagacccagaagaaagggccccagatggcacatcgacctgcagccctgggccggcagcgcccagagcctggacgaggaggcctggagattcctgagatacatcagcaccacccagatcgcctgcaaccacatgaacaccgacagcctggccaccgacagcagccccacccacaagccctggagcgtgtgcctggacgacagattcaacctggcccaccagatcagaaacaagcagtgcagactgtacagcctgggcctgggcagcgacgacacccacttcgaggtgagcatggccaacaacggctgcgaggtgcacagattcgaccccagcgtgaagagcgcccacatcctggagagccagcacctgtggtaccacagactgagcatcgactggagagacccccaccccgccgtggccgcccagaagccccacagcaacaccagaaagctgggcagcatcctgaacgagttcggccaccacaagatcgacgtgctgaaggccgacctggagagcgccgagtggaaggtgctggagaacctgatcctggaggacgtgctggagcagatcggccagctgatcttcgagatccacctgcactggcccggcttcgaggtgagcggcagcgacagcagcgtggtgagattctggtacagcctgctgaaggagctggagcagaaggacttcagactgttccacagctacaaggacctgagcaagccccagctgttcctgaagaaggacatcttcaacgccagcagctgctacaccctgagctgggtgaacaccagatggaagtag

SEQ ID NO: 3885 - DNA, 300 bp, Artificial Sequence
  Description of Artificial Sequence: Synthetic coding sequence
atgaagatccccgtgctgcccgccgtggtgctgctgagcctgctggtgctgcacagcgcccagggcgccaccctgggcggccccgaggaggagagcaccatcgagaactacgccagcagacccgaggccttcaacacccccttcctgaacatcgacaagctgagaagcgccttcaaggccgacgagttcctgaactggcacgccctgttcgagagcatcaagagaaagctgcccttcctgaactgggacgccttccccaagctgaagggcctgagaagcgccacccccgacgcccagtag

SEQ ID NO: 3886 - DNA, 618 bp, Artificial Sequence
  Description of Artificial Sequence: Synthetic coding sequence
atgatgagaaccctgatcaccacccaccccctgcccctgctgctgctgccccagcagctgctgcagctggtgcagttccaggaggtggacaccgacttcgacttccccgaggaggacaagaaggaggagttcgaggagtgcctggagaagttcttcagcaccggccccgccagaccccccaccaaggagaaggtgaagagaagagtgctgatcgagcccggcatgcccctgaaccacatcgagtactgcaaccacgagatcatgggcaagaacgtgtactacaagcacagatgggtggccgagcactacttcctgctgatgcagtacgacgagctgcagaagatctgctacaacagattcgtgccctgcaagaacggcatcagaaagtgcaacagaagcaagggcctggtggagggcgtgtactgcaacctgaccgaggccttcgagatccccgcctgcaagtacgagagcctgtacagaaagggctacgtgctgatcacctgcagctggcagaacgagatgcagaagagaatcccccacaccatcaacgacctggtggagccccccgagcacagaagcttcctgagcgaggacggcgtgttcgtgatcagcccctag

SEQ ID NO: 3887 - DNA, 402 bp, Artificial Sequence
  Description of Artificial Sequence: Synthetic coding sequence
atgctggactggagactggccagcgcccacttcatcctggccgtgaccctgaccctgtggagcagcggcaaggtgctgagcgtggacgtgaccaccaccgaggccttcgacagcggcgtgatcgacgtgcagagcacccccaccgtgagagaggagaagagcgccaccgacctgaccgccaagctgctgctgctggacgagctggtgagcctggagaacgacgtgatcgagaccaagaagaagagaagcttcagcggcttcggcagccccctggacagactgagcgccggcagcgtggaccacaagggcaagcagagaaaggtggtggaccaccccaagagaagattcggcatccccatggacagaatcggcagaaacagactgagcaacagcagaggctag

SEQ ID NO: 3888 - DNA, 846 bp, Artificial Sequence
  Description of Artificial Sequence: Synthetic coding sequence
atgggcagcagaggccagggcctgctgctggcctactgcctgctgctggccttcgccagcggcctggtgctgagcagagtgccccacgtgcagggcgagcagcaggagtgggagggcaccgaggagctgcccagcccccccgaccacgccgagagagccgaggagcagcacgagaagtacagacccagccaggaccagggcctgcccgccagcagatgcctgagatgctgcgaccccggcaccagcatgtaccccgccaccgccgtgccccagatcaacatcaccatcctgaagggcgagaagggcgacagaggcgacagaggcctgcagggcaagtacggcaagaccggcagcgccggcgccagaggccacaccggccccaagggccagaagggcagcatgggcgcccccggcgagagatgcaagagccactacgccgccttcagcgtgggcagaaagaagcccatgcacagcaaccactactaccagaccgtgatcttcgacaccgagttcgtgaacctgtacgaccacttcaacatgttcaccggcaagttctactgctacgtgcccggcctgtacttcttcagcctgaacgtgcacacctggaaccagaaggagacctacctgcacatcatgaagaacgaggaggaggtggtgatcctgttcgcccaggtgggcgacagaagcatcatgcagagccagagcctgatgctggagctgagagagcaggaccaggtgtgggtgagactgtacaagggcgagagagagaacgccatcttcagcgaggagctggacacctacatcaccttcagcggctacctggtgaagcacgccaccgagccctag

SEQ ID NO: 3889 - DNA, 132 bp, Artificial Sequence
  Description of Artificial Sequence: Synthetic coding sequence
atgaagctgctgtacctgttcctggccatcctgctggccatcgaggagcccgtgatcagcgccctggtgagaaccgtgggctgctgcctggacaccgccagacagaccccccaccccagcatgcacggctag

SEQ ID NO: 3890 - DNA, 861 bp, Artificial Sequence
  Description of Artificial Sequence: Synthetic coding sequence
atgaaggtgctgctgctgaccggcctgggcgccctgttcttcgcctactactgggacgacaacttcgaccccgccagcctgcagggcgccagagtgctgctgaccggcgccaacgccggcgtgggcgaggagctggcctaccactacgccagactgggcagccacctggtgctgaccgcccacaccgaggccctgctgcagaaggtggtgggcaactgcagaaagctgggcgcccccaaggtgttctacatcgccgccgacatggccagccccgaggcccccgagagcgtggtgcagttcgccctggacaagctgggcggcctggactacctggtgctgaaccacatcggcggcgcccccgccggcaccagagccagaagcccccaggccaccagatggctgatgcaggtgaacttcgtgagctacgtgcagctgaccagcagagccctgcccagcctgaccgacagcaagggcagcctggtggtggtgagcagcctgctgggcagagtgcccaccagcttcagcaccccctacagcgccgccaagttcgccctggacggcttcttcggcagcctgagaagagagctggacgtgcaggacgtgaacgtggccatcaccatgtgcgtgctgggcctgagagacagagccagcgccgccgaggccgtgagaggcgtgaccagagtgaaggccgcccccggccccaaggccgccctggccgtgatcagaggcggcgccaccagagccgccggcgtgttctacccctggagattcagactgctgtgcctgctgagaagatggctgcccagacccagagcctggttcatcagacaggagctgaacgtgaccgccgccgccgcctag

SEQ ID NO: 3891 - DNA, 1326 bp, Artificial Sequence
  Description of Artificial Sequence: Synthetic coding sequence
atgagagtggtgaccatcgtgatcctgctgtgcttctgcaaggccgccgagctgagaaaggccagccccggcagcgtgagaagcagagtgaaccacggcagagccggcggcggcagaagaggcagcaaccccgtgaagagatacgcccccggcctgccctgcgacgtgtacacctacctgcacgagaagtacctggactgccaggagagaaagctggtgtacgtgctgcccggctggccccaggacctgctgcacatgctgctggccagaaacaagatcagaaccctgaagaacaacatgttcagcaagttcaagaagctgaagagcctggacctgcagcagaacgagatcagcaagatcgagagcgaggccttcttcggcctgaacaagctgaccaccctgctgctgcagcacaaccagatcaaggtgctgaccgaggaggtgttcatctacacccccctgctgagctacctgagactgtacgacaacccctggcactgcacctgcgagatcgagaccctgatcagcatgctgcagatccccagaaacagaaacctgggcaactacgccaagtgcgagagcccccaggagcagaagaacaagaagctgagacagatcaagagcgagcagctgtgcaacgaggaggagaaggagcagctggaccccaagccccaggtgagcggcagaccccccgtgatcaagcccgaggtggacagcaccttctgccacaactacgtgttccccatccagaccctggactgcaagagaaaggagctgaagaaggtgcccaacaacatcccccccgacatcgtgaagctggacctgagctacaacaagatcaaccagctgagacccaaggagttcgaggacgtgcacgagctgaagaagctgaacctgagcagcaacggcatcgagttcatcgaccccgccgccttcctgggcctgacccacctggaggagctggacctgagcaacaacagcctgcagaacttcgactacggcgtgctggaggacctgtacttcctgaagctgctgtggctgagagacaacccctggagatgcgactacaacatccactacctgtactactggctgaagcaccactacaacgtgcacttcaacggcctggagtgcaagacccccgaggagtacaagggctggagcgtgggcaagtacatcagaagctactacgaggagtgccccaaggacaagctgcccgcctaccccgagagcttcgaccaggacaccgaggacgacgagtgggagaagaagcacagagaccacaccgccaagaagcagagcgtgatcatcaccatcgtgggctag

SEQ ID NO: 3892 - DNA, 1539 bp, Artificial Sequence
  Description of Artificial Sequence: Synthetic coding sequence
atggccgagagcggcctggccatgtggcccagcctgctgctgctgctgctgctgcccggccccccccccgtggccggcctggaggacgccgccttcccccacctgggcgagagcctgcagcccctgcccagagcctgccccctgagatgcagctgccccagagtggacaccgtggactgcgacggcctggacctgagagtgttccccgacaacatcaccagagccgcccagcacctgagcctgcagaacaaccagctgcaggagctgccctacaacgagctgagcagactgagcggcctgagaaccctgaacctgcacaacaacctgatcagcagcgagggcctgcccgacgaggccttcgagagcctgacccagctgcagcacctgtgcgtggcccacaacaagctgagcgtggccccccagttcctgcccagaagcctgagagtggccgacctggccgccaaccaggtgatggagatcttccccctgaccttcggcgagaagcccgccctgagaagcgtgtacctgcacaacaaccagctgagcaacgccggcctgccccccgacgccttcagaggcagcgaggccatcgccaccctgagcctgagcaacaaccagctgagctacctgccccccagcctgccccccagcctggagagactgcacctgcagaacaacctgatcagcaaggtgcccagaggcgccctgagcagacagacccagctgagagagctgtacctgcagcacaaccagctgaccgacagcggcctggacgccaccaccttcagcaagctgcacagcctggagtacctggacctgagccacaaccagctgaccaccgtgcccgccggcctgcccagaaccctggccatcctgcacctgggcagaaacagaatcagacaggtggaggccgccagactgcacggcgccagaggcctgagatacctgctgctgcagcacaaccagctgggcagcagcggcctgcccgccggcgccctgagacccctgagaggcctgcacaccctgcacctgtacggcaacggcctggacagagtgccccccgccctgcccagaagactgagagccctggtgctgccccacaaccacgtggccgccctgggcgccagagacctggtggccacccccggcctgaccgagctgaacctggcctacaacagactggccagcgccagagtgcaccacagagccttcagaagactgagagccctgagaagcctggacctggccggcaaccagctgaccagactgcccatgggcctgcccaccggcctgagaaccctgcagctgcagagaaaccagctgagaatgctggagcccgagcccctggccggcctggaccagctgagagagctgagcctggcccacaacagactgagagtgggcgacatcggccccggcacctggcacgagctgcaggccctgcaggtgagacacagactggtgagccacaccgtgcccagagccccccccagcccctgcctgccctgccacgtgcccaacatcctggtgagctggtag

SEQ ID NO: 3893 - DNA, 2328 bp, Artificial Sequence
  Description of Artificial Sequence: Synthetic coding sequence
atgaaggagggccccgaggaggccggcagcggcagatacggccccagatacatcaccgacatgggcgccggcgaggacgacgagggcttcgaggacgacctggacctggacatcagcttcgaggaggtgaagcccctgcccgccaccaagggcggcaacaagaagttcctggtggagagcaagaagatgagcatcagcaaccccaagaccatcagcagactgatcccccccaccagcgccagcctgcccgtgaccaccgtggccccccagcccatccccatccagagaaagggcaagaacggcgtggccatcatgagcagactgttcgacatgccctgcgacgagaccctgtgcagcgccgacagcttctgcgtgaacgactacacctggggcggcagcagatgccagtgcaccctgggcaagggcggcgagagctgcagcgaggacatcgtgatccagtacccccagttcttcggccacagctacgtgaccttcgagcccctgaagaacagctaccaggccttccagatcaccctggagttcagagccgaggccgaggacggcctgctgctgtactgcggcgagaacgagcacggcagaggcgacttcatgagcctggccatcatcagaagaagcctgcagttcagattcaactgcggcaccggcgtggccatcatcgtgagcgagaccaagatcaagctgggcggctggcacaccgtgatgctgtacagagacggcctgaacggcctgctgcagctgaacaacggcacccccgtgaccggccagagccagggccagtacagcaagatcaccttcagaacccccctgtacctgggcggcgcccccagcgcctactggctggtgagagccaccggcaccaacagaggcttccagggctgcgtgcagagcctggccgtgaacggcagaagaatcgacatgagaccctggcccctgggcaaggccctgagcggcgccgacgtgggcgagtgcagcagcggcatctgcgacgaggccagctgcatccacggcggcacctgcaccgccatcaaggccgacagctacatctgcctgtgccccctgggcttcaagggcagacactgcgaggacgccttcaccctgaccatcccccagttcagagagagcctgagaagctacgccgccaccccctggcccctggagccccagcactacctgagcttcatggagttcgagatcaccttcagacccgacagcggcgacggcgtgctgctgtacagctacgacaccggcagcaaggacttcctgagcatcaacctggccggcggccacgtggagttcagattcgactgcggcagcggcaccggcgtgctgagaagcgaggaccccctgaccctgggcaactggcacgagctgagagtgagcagaaccgccaagaacggcatcctgcaggtggacaagcagaagatcgtggagggcatggccgagggcggcttcacccagatcaagtgcaacaccgacatcttcatcggcggcgtgcccaactacgacgacgtgaagaagaacagcggcgtgctgaagcccttcagcggcagcatccagaagatcatcctgaacgacagaaccatccacgtgaagcacgacttcaccagcggcgtgaacgtggagaacgccgcccacccctgcgtgagagccccctgcgcccacggcggcagctgcagacccagaaaggagggctacgactgcgactgccccctgggcttcgagggcctgcactgccagaaggccatcatcgaggccatcgagatcccccagttcatcggcagaagctacctgacctacgacaaccccgacatcctgaagagagtgagcggcagcagaagcaacgtgttcatgagattcaagaccaccgccaaggacggcctgctgctgtggagaggcgacagccccatgagacccaacagcgacttcatcagcctgggcctgagagacggcgccctggtgttcagctacaacctgggcagcggcgtggccagcatcatggtgaacggcagcttcaacgacggcagatggcacagagtgaaggccgtgagagacggccagagcggcaagatcaccgtggacgactacggcgccagaaccggcaagagccccggcatgatgagacagctgaacatcaacggcgccctgtacgtgggcggcatgaaggagatcgccctgcacaccaacagacagtacatgagaggcctggtgggctgcatcagccacttcaccctgagcaccgactaccacatcagcctggtggaggacgccgtggacggcaagaacatcaacacctgcggcgccaagtag

SEQ ID NO: 3894 - DNA, 1431 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcggcagcggcagccagagcggcagcagcggcagcggcagcaacggcgacaacaacaacggcagcagcagcggcggcagcagcagcggcagcagcagcggcggcagcagcggcggcagcagcggcggcagcagcggcaacagcggcggcagcagaggcgacagcggcagcgagagcagctggggcagcagcaccggcagcagcagcggcaaccacggcggcagcggcggcggcaacggccacaagcccggctgcgagaagcccggcaacgaggccagaggcagcggcgagagcggcatccagaacagcgagaccagccccggcatgttcaacttcgacaccttctggaagaacttcaagagcaagctgggcttcatcaactgggacgccatcaacaagaaccaggtgcccccccccagcaccagagccctgctgtacttcagcagactgtgggaggacttcaagcagaacacccccttcctgaactggaaggccatcatcgagggcgccgacgccagcagcctgcagaagagagccggcagagacgaccagaactacaactacaaccagcacgcctaccccaccgcctacggcggcaagtacagcgtgaagacccccgccaagggcggcgtgagccccagcagcagcgccagcagagtgcagcccggcctgctgcagtgggtgaagttctggtag

SEQ ID NO: 3895 - DNA, 1911 bp, Artificial Sequence
  Description of Artificial Sequence: Synthetic coding sequence
atgaccacctggagcctgagaagaagacccgccagaaccctgggcctgctgctgctggtggtgctgggcttcctggtgctgagaagactggactggagcaccctggtgcccctgagactgagacacagacagctgggcctgcaggccaagggctggaacttcatgctggaggacagcaccttctggatcttcggcggcagcatccactacttcagagtgcccagagagtactggagagacagactgctgaagatgaaggcctgcggcctgaacaccctgaccacctacgtgccctggaacctgcacgagcccgagagaggcaagttcgacttcagcggcaacctggacctggaggccttcgtgctgatggccgccgagatcggcctgtgggtgatcctgagacccggcccctacatctgcagcgagatggacctgggcggcctgcccagctggctgctgcaggaccccggcatgagactgagaaccacctacaagggcttcaccgaggccgtggacctgtacttcgaccacctgatgagcagagtggtgcccctgcagtacaagagaggcggccccatcatcgccgtgcaggtggagaacgagtacggcagctacaacaaggaccccgcctacatgccctacgtgaagaaggccctggaggacagaggcatcgtggagctgctgctgaccagcgacaacaaggacggcctgagcaagggcatcgtgcagggcgtgctggccaccatcaacctgcagagcacccacgagctgcagctgctgaccaccttcctgttcaacgtgcagggcacccagcccaagatggtgatggagtactggaccggctggttcgacagctggggcggcccccacaacatcctggacagcagcgaggtgctgaagaccgtgagcgccatcgtggacgccggcagcagcatcaacctgtacatgttccacggcggcaccaacttcggcttcatgaacggcgccatgcacttccacgactacaagagcgacgtgaccagctacgactacgacgccgtgctgaccgaggccggcgactacaccgccaagtacatgaagctgagagacttcttcggcagcatcagcggcatccccctgccccccccccccgacctgctgcccaagatgccctacgagcccctgacccccgtgctgtacctgagcctgtgggacgccctgaagtacctgggcgagcccatcaagagcgagaagcccatcaacatggagaacctgcccgtgaacggcggcaacggccagagcttcggctacatcctgtacgagaccagcatcaccagcagcggcatcctgagcggccacgtgcacgacagaggccaggtgttcgtgaacaccgtgagcatcggcttcctggactacaagaccaccaagatcgccgtgcccctgatccagggctacaccgtgctgagaatcctggtggagaacagaggcagagtgaactacggcgagaacatcgacgaccagagaaagggcctgatcggcaacctgtacctgaacgacagccccctgaagaacttcagaatctacagcctggacatgaagaagagcttcttccagagattcggcctggacaagtggagcagcctgcccgagacccccaccctgcccgccttcttcctgggcagcctgagcatcagcagcaccccctgcgacaccttcctgaagctggagggctgggagaagggcgtggtgttcatcaacggccagaacctgggcagatactggaacatcggcccccagaagaccctgtacctgcccggcccctggctgagcagcggcatcaaccaggtgatcgtgttcgaggagaccatggccggccccgccctgcagttcaccgagaccccccacctgggcagaaaccagtacatcaagtag

SEQ ID NO: 3896 - DNA, 672 bp, Artificial Sequence
  Description of Artificial Sequence: Synthetic coding sequence
atgaccagatggagcagctacctgctgggctggaccaccttcctgctgtacagctacgagagcagcggcggcatgcacgaggagtgcgtgttccccttcacctacaagggcagcgtgtacttcacctgcacccacatccacagcctgagcccctggtgcgccaccagagccgtgtacaacggccagtggaagtactgccagagcgaggactaccccagatgcatcttccccttcatctacagaggcaaggcctacaacagctgcatcagccagggcagcttcctgggcagcctgtggtgcagcgtgaccagcgtgttcgacgagaagcagcagtggaagttctgcgagaccaacgagtacggcggcaacagcctgagaaagccctgcatcttccccagcatctacagaaacaacgtggtgagcgactgcatggaggacgagagcaacaagctgtggtgccccaccaccgagaacatggacaaggacggcaagtggagcttctgcgccgacaccagaatcagcgccctggtgcccggcttcccctgccacttccccttcaactacaagaacaagaactacttcaactgcaccaacgagggcagcaaggagaacctggtgtggtgcgccaccagctacaactacgaccaggaccacacctgggtgtactgctag

SEQ ID NO: 3897 - DNA, 1368 bp, Artificial Sequence
  Description of Artificial Sequence: Synthetic coding sequence
atgctgcaccccgagaccagccccggcagaggccacctgctggccgtgctgctggccctgctgggcaccacctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcatccccacccccagcctggccagcggcctgtggagaaccctgcaggtgggctggaacatgcagctgctgcccgccggcctggccagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccagaccgccatcgaggccttcgtgtgcgcctacagccccggcggcaactgggaggtgaacggcaagaccatcatcccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcggcgcccagtgcgccaccaaggtgcacttccccttccacacctgcgacctgagaatcgacggcgactgcttcatggtgagcagcgaggccgacacctactacagagccagaatgaagtgccagagaaagggcggcgtgctggcccagatcaagagccagaaggtgcaggacatcctggccttctacctgggcagactggagaccaccaacgaggtgatcgacagcgacttcgagaccagaaacttctggatcggcctgacctacaagaccgccaaggacagcttcagatgggccaccggcgagcaccaggccttcaccagcttcgccttcggccagcccgacaaccacggcctggtgtggctgagcgccgccatgggcttcggcaactgcgtggagctgcaggccagcgccgccttcaactggaacgaccagagatgcaagaccagaaacagatacatctgccagttcgcccaggagcacatcagcagatggggccccggcagctag

SEQ ID NO: 3898 - DNA, 1425 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaagggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacaccaccggcctggcctggagcaagaccggccccgtggccaaggagctgagcggcctgcccagcggccccagcgccggcagctgccccccccccccccccccctgccccccccccccccccgtgagcaccatcagctgcagctacgagagcgccagcagaagcagcctgttcgcccagatcaaccagggcgagagcatcacccacgccctgaagcacgtgagcgacgacatgaagacccacaagaaccccgccctgaaggcccagagcggccccgtgagaagcggccccaagcccttcagcgcccccaagccccagaccagccccagccccaagagagccaccaagaaggagcccgccgtgctggagctggagggcaagaagtggagagtggagaaccaggagaacgtgagcaacctggtgatcgaggacaccgagctgaagcaggtggcctacatctacaagtgcgtgaacaccaccctgcagatcaagggcaagatcaacagcatcaccgtggacaactgcaagaagctgggcctggtgttcgacgacgtggtgggcatcgtggagatcatcaacagcaaggacgtgaaggtgcaggtgatgggcaaggtgcccaccatcagcatcaacaagaccgacggctgccacgcctacctgagcaagaacagcctggactgcgagatcgtgagcgccaagagcagcgagatgaacgtgctgatccccaccgagggcggcgacttcaacgagttccccgtgcccgagcagttcaagaccctgtggaacggccagaagctggtgaccaccgtgaccgagatcgccggctag

SEQ ID NO: 3899 - DNA, 360 bp, Artificial Sequence
  Description of Artificial Sequence: Synthetic coding sequence
atgaacaagatcctgagcagcaccgtgtgcttcggcctgctgaccctgctgagcgtgctgagcttcctgcagagcgtgcacggcagaccctacctgacccagggcaacgagatcttccccgacaagaagtacaccaacagagaggagctgctgctggccctgctgaacaagaacttcgacttccagagacccttcaacaccgacctggccctgcccaacaagctggaggagctgaaccagctggagaagctgaaggagcagctggtggaggagaaggacagcgagaccagctacgccgtggacggcctgttcagcagccaccccagcaagagagcctgcttctggaagtactgcgtgtag

SEQ ID NO: 3900 - DNA, 3756 bp, Artificial Sequence
  Description of Artificial Sequence: Synthetic coding sequence
atgagactgctgctgctggtgcccctgctgctggcccccgcccccggcagcagcgcccccaaggtgagaagacagagcgacacctggggcccctggagccagtggagcccctgcagcagaacctgcggcggcggcgtgagcttcagagagagaccctgctacagccagagaagagacggcggcagcagctgcgtgggccccgccagaagccacagaagctgcagaaccgagagctgccccgacggcgccagagacttcagagccgagcagtgcgccgagttcgacggcgccgagttccagggcagaagatacagatggctgccctactacagcgcccccaacaagtgcgagctgaactgcatccccaagggcgagaacttctactacaagcacagagaggccgtggtggacggcaccccctgcgagcccggcaagagagacgtgtgcgtggacggcagctgcagagtggtgggctgcgaccacgagctggacagcagcaagcaggaggacaagtgcctgagatgcggcggcgacggcaccacctgctaccccgtggccggcaccttcgacgccaacgacctgagcagagccgtgaagaacgtgagaggcgagtactacctgaacggccactggaccatcgaggccgccagagccctgcccgccgccagcaccatcctgcactacgagagaggcgccgagggcgacctggcccccgagagactgcacgccagaggccccaccagcgagcccctggtgatcgagctgatcagccaggagcccaaccccggcgtgcactacgagtaccacctgcccctgagaagacccagccccggcttcagctggagccacggcagctggagcgactgcagcgccgagtgcggcggcggccaccagagcagactggtgttctgcaccatcgaccacgaggcctaccccgaccacatgtgccagagacagcccagacccgccgacagaagaagctgcaacctgcacccctgccccgagaccaagagatggaaggccggcccctgggccccctgcagcgccagctgcggcggcggcagccagagcagaagcgtgtactgcatcagcagcgacggcgccggcatccaggaggccgtggaggaggccgagtgcgccggcctgcccggcaagccccccgccatccaggcctgcaacctgcagagatgcgccgcctggagccccgagccctggggcgagtgcagcgtgagctgcggcgtgggcgtgagaaagagaagcgtgacctgcagaggcgagagaggcagcctgctgcacaccgccgcctgcagcctggaggacagaccccccctgaccgagccctgcgtgcacgaggactgccccctgctgagcgaccaggcctggcacgtgggcacctggggcctgtgcagcaagagctgcagcagcggcaccagaagaagacaggtgatctgcgccatcggcccccccagccactgcggcagcctgcagcacagcaagcccgtggacgtggagccctgcaacacccagccctgccacctgccccaggaggtgcccagcatgcaggacgtgcacacccccgccagcaacccctggatgcccctgggcccccaggagagccccgccagcgacagcagaggccagtggtgggccgcccaggagcaccccagcgccagaggcgaccacagaggcgagagaggcgaccccagaggcgaccagggcacccacctgagcgccctgggccccgcccccagcctgcagcagcccccctaccagcagcccctgagaagcggcagcggcccccacgactgcagacacagcccccacggctgctgccccgacggccacaccgccagcctgggcccccagtggcagggctgccccggcgccccctgccagcagagcagatacggctgctgccccgacagagtgagcgtggccgagggcccccaccacgccggctgcaccaagagctacggcggcgacagcaccggcggcatgcccagaagcagagccgtggccagcaccgtgcacaacacccaccagccccaggcccagcagaacgagcccagcgagtgcagaggcagccagttcggctgctgctacgacaacgtggccaccgccgccggccccctgggcgagggctgcgtgggccagcccagccacgcctaccccgtgagatgcctgctgcccagcgcccacggcagctgcgccgactgggccgccagatggtacttcgtggccagcgtgggccagtgcaacagattctggtacggcggctgccacggcaacgccaacaacttcgccagcgagcaggagtgcatgagcagctgccagggcagcctgcacggccccagaagaccccagcccggcgccagcggcagaagcacccacaccgacggcggcggcagcagccccgccggcgagcaggagcccagccagcacagaaccggcgccgccgtgcagagaaagccctggcccagcggcggcctgtggagacaggaccagcagcccggccccggcgaggccccccacacccaggccttcggcgagtggccctggggccaggagctgggcagcagagcccccggcctgggcggcgacgccggcagccccgccccccccttccacagcagcagctacagaatcagcctggccggcgtggagcccagcctggtgcaggccgccctgggccagctggtgagactgagctgcagcgacgacaccgcccccgagagccaggccgcctggcagaaggacggccagcccatcagcagcgacagacacagactgcagttcgacggcagcctgatcatccaccccctgcaggccgaggacgccggcacctacagctgcggcagcaccagacccggcagagacagccagaagatccagctgagaatcatcggcggcgacatggccgtgctgagcgaggccgagctgagcagattcccccagcccagagaccccgcccaggacttcggccaggccggcgccgccggccccctgggcgccatccccagcagccacccccagcccgccaacagactgagactggaccagaaccagcccagagtggtggacgccagccccggccagagaatcagaatgacctgcagagccgagggcttccccccccccgccatcgagtggcagagagacggccagcccgtgagcagccccagacaccagctgcagcccgacggcagcctggtgatcagcagagtggccgtggaggacggcggcttctacacctgcgtggccttcaacggccaggacagagaccagagatgggtgcagctgagagtgctgggcgagctgaccatcagcggcctgccccccaccgtgaccgtgcccgagggcgacaccgccagactgctgtgcgtggtggccggcgagagcgtgaacatcagatggagcagaaacggcctgcccgtgcaggccgacggccacagagtgcaccagagccccgacggcaccctgctgatctacaacctgagagccagagacgagggcagctacacctgcagcgcctaccagggcagccaggccgtgagcagaagcaccgaggtgaaggtggtgagccccgcccccaccgcccagcccagagaccccggcagagactgcgtggaccagcccgagctggccaactgcgacctgatcctgcaggcccagctgtgcggcaacgagtactacagcagcttctgctgcgccagctgcagcagattccagccccacgcccagcccatctggcagtag

SEQ ID NO: 3901 - DNA, 1731 bp, Artificial Sequence
  Description of Artificial Sequence: Synthetic coding sequence
atggcccagggcgtgctgtggatcctgctgggcctgctgctgtggagcgaccccggcaccgccagcctgcccctgctgatggacagcgtgatccaggccctggccgagctggagcagaaggtgcccgccgccaagaccagacacaccgccagcgcctggctgatgagcgcccccaacagcggcccccacaacagactgtaccacttcctgctgggcgcctggagcctgaacgccaccgagctggacccctgccccctgagccccgagctgctgggcctgaccaaggaggtggccagacacgacgtgagagagggcaaggagtacggcgtggtgctggcccccgacggcagcaccgtggccgtggagcccctgctggccggcctggaggccggcctgcagggcagaagagtgatcaacctgcccctggacagcatggccgccccctgggagaccggcgacaccttccccgacgtggtggccatcgcccccgacgtgagagccaccagcagccccggcctgagagacggcagccccgacgtgaccaccgccgacatcggcgccaacacccccgacgccaccaagggctgccccgacgtgcaggccagcctgcccgacgccaaggccaagagcccccccaccatggtggacagcctgctggccgtgaccctggccggcaacctgggcctgaccttcctgagaggcagccagacccagagccaccccgacctgggcaccgagggctgctgggaccagctgagcgcccccagaaccttcaccctgctggaccccaaggccagcctgctgaccatggccttcctgaacggcgccctggacggcgtgatcctgggcgactacctgagcagaacccccgagcccagacccagcctgagccacctgctgagccagtactacggcgccggcgtggccagagaccccggcttcagaagcaacttcagaagacagaacggcgccgccctgaccagcgccagcatcctggcccagcaggtgtggggcaccctggtgctgctgcagagactggagcccgtgcacctgcagctgcagtgcatgagccaggagcagctggcccaggtggccgccaacgccaccaaggagttcaccgaggccttcctgggctgccccgccatccaccccagatgcagatggggcgccgccccctacagaggcagacccaagctgctgcagctgcccctgggcttcctgtacgtgcaccacacctacgtgcccgcccccccctgcaccgacttcaccagatgcgccgccaacatgagaagcatgcagagataccaccaggacacccagggctggggcgacatcggctacagcttcgtggtgggcagcgacggctacgtgtacgagggcagaggctggcactgggtgggcgcccacaccctgggccacaacagcagaggcttcggcgtggccatcgtgggcaactacaccgccgccctgcccaccgaggccgccctgagaaccgtgagagacaccctgcccagctgcgccgtgagagccggcctgctgagacccgactacgccctgctgggccacagacagctggtgagaaccgactgccccggcgacgccctgttcgacctgctgagaacctggccccacttcaccgccaccgtgaagcccagacccgccagaagcgtgagcaagagaagcagaagagagcccccccccagaaccctgcccgccaccgacctgcagtag

SEQ ID NO: 3902 - DNA, 846 bp, Artificial Sequence
  Description of Artificial Sequence: Synthetic coding sequence
atgctgcccaagagcagaagagccctgaccatccaggagatcgccgccctggccagaagcagcctgcacggcatcagccaggtggtgaaggaccacgtgaccaagcccaccgccatggcccagggcagagtggcccacctgatcgagtggaagggctggagcaagcccagcgacagccccgccgccctggagagcgccttcagcagctacagcgacctgagcgagggcgagcaggaggccagattcgccgccggcgtggccgagcagttcgccatcgccgaggccaagctgagagcctggagcagcgtggacggcgaggacagcaccgacgacagctacgacgaggacttcgccggcggcatggacaccgacatggccggccagctgcccctgggcccccacctgcaggacctgttcaccggccacagattcagcagacccgtgagacagggcagcgtggagcccgagagcgactgcagccagaccgtgagccccgacaccctgtgcagcagcctgtgcagcctggaggacggcctgctgggcagccccgccagactggccagccagctgctgggcgacgagctgctgctggccaagctgccccccagcagagagagcgccttcagaagcctgggccccctggaggcccaggacagcctgtacaacagccccctgaccgagagctgcctgagccccgccgaggaggagcccgccccctgcaaggactgccagcccctgtgcccccccctgaccggcagctgggagagacagagacaggccagcgacctggccagcagcggcgtggtgagcctggacgaggacgaggccgagcccgaggagcagtag

SEQ ID NO: 3903 - DNA, 2619 bp, Artificial Sequence
  Description of Artificial Sequence: Synthetic coding sequence
atgggcatcgtgtggatcctgatgagcgtgctgccctggtggggcagatgcgccgacctggccatcgccagcacccagctggtgcccagcaccgccagcgccagaatggccctgagcagccagctgatgggcagaaccgtgtggacccccatgagcgccagcgccctgcaggagcccgcctaccccgccctggccagaaccagcagagcccccagcgccgccagcgtgcccctggccagcagatgcagagtgaccaccgccctgatcagcaccagcgcccagagaagccccaccagcgccagcctggcccccgtgcccaccgccctgggcgccagcagcgccagcgcccacctggccctgagcagcctgaccatgggcaccgtggccctgacccacggcagagtgagcgccagccccgtgctgagactgggcagcgccagatgccccaagctgagcaccccccccagacccgccgccgccgccgtgagaggcctgggcagagccggcgagacccccgccaactgcgtgcccagaagagccgtgcccggccccgacgacagcagagaggacgtgaacgagtgcgccgagaaccccggcgtgtgcaccaacggcgtgtgcgtgaacaccgacggcagcttcagatgcgagtgccccttcggctacagcctggacttcaccggcatcaactgcgtggacaccgacgagtgcagcgtgggccacccctgcggccagggcacctgcaccaacgtgatcggcggcttcgagtgcgcctgcgccgacggcttcgagcccggcctgatgatgacctgcgaggacatcgacgagtgcagcctgaaccccctgctgtgcgccttcagatgccacaacaccgagggcagctacctgtgcacctgccccgccggctacaccctgagagaggacggcgccatgtgcagagacgtggacgagtgcgccgacggccagcaggactgccacgccagaggcatggagtgcaagaacctgatcggcaccttcgcctgcgtgtgcccccccggcatgagacccctgcccggcagcggcgagggctgcaccgacgacaacgagtgccacgcccagcccgacctgtgcgtgaacggcagatgcgtgaacaccgccggcagcttcagatgcgactgcgacgagggcttccagcccagccccaccctgaccgagtgccacgacatcagacagggcccctgcttcgccgaggtgctgcagaccatgtgcagaagcctgagcagcagcagcgaggccgtgaccagagccgagtgctgctgcggcggcggcagaggctggggccccagatgcgagctgtgccccctgcccggcaccagcgcctacagaaagctgtgcccccacggcagcggctacaccgccgagggcagagacgtggacgagtgcagaatgctggcccacctgtgcgcccacggcgagtgcatcaacagcctgggcagcttcagatgccactgccaggccggctacacccccgacgccaccgccaccacctgcctggacatggacgagtgcagccaggtgcccaagccctgcaccttcctgtgcaagaacaccaagggcagcttcctgtgcagctgccccagaggctacctgctggaggaggacggcagaacctgcaaggacctggacgagtgcaccagcagacagcacaactgccagttcctgtgcgtgaacaccgtgggcgccttcacctgcagatgcccccccggcttcacccagcaccaccaggcctgcttcgacgtgaacgagtgcgacggcccccacagatgccagcacggctgccagaaccagctgggcggctacagatgcagctgcccccagggcttcacccagcacagccagtgggcccagtgcgtggacgagaacgagtgcgccctgagcccccccacctgcggcagcgccagctgcagaaacaccctgggcggcttcagatgcgtgtgccccagcggcttcgacttcgaccaggccctgggcggctgccaggaggtggacgagtgcgccggcagaagaggcccctgcagctacagctgcgccaacacccccggcggcttcctgtgcggctgcccccagggctacttcagagccggccagggccactgcgtgagcggcctgggcttcagccccggcccccaggacacccccgacaaggaggagctgctgagcagcgaggcctgctacgagtgcaagatcaacggcctgagccccagagacagacccagaagaagcgcccacagagaccaccaggtgaacctggccaccctggacagcgaggccctgctgaccctgggcctgaacctgagccacctgggcagagccgagagaatcctggagctgagacccgccctggagggcctggagggcagaatcagatacgtgatcgtgagaggcaacgagcagggcttcttcagaatgcaccacctgagaggcgtgagcagcctgcagctgggcagaagaagacccggccccggcacctacagactggaggtggtgagccacatggccggcccctggggcgtgcagcccgagggccagcccggcccctggggccaggccctgagactgaaggtgcagctgcagctgctgtag

SEQ ID NO: 3904 - DNA, 1368 bp, Artificial Sequence
  Description of Artificial Sequence: Synthetic coding sequence
atggccagaaaggccctgaagctggccagctggaccagcatggccctggccgccagcggcatctacttctacagcaacaagtacctggaccccaacgacttcggcgccgtgagagtgggcagagccgtggccaccaccgccgtgatcagctacgactacctgaccagcctgaagagcgtgccctacggcagcgaggagtacctgcagctgagaagcaagatccacgacctgttccagagcttcgacgacacccccctgggcaccgccagcctggcccaggtgcacaaggccgtgctgcacgacggcagaaccgtggccgtgaaggtgcagcaccccaaggtgagagcccagagcagcaaggacatcctgctgatggaggtgctggtgctggccgtgaagcagctgttccccgagttcgagttcatgtggctggtggacgaggccaagaagaacctgcccctggagctggacttcctgaacgagggcagaaacgccgagaaggtgagccagatgctgagacacttcgacttcctgaaggtgcccagaatccactgggacctgagcaccgagagagtgctgctgatggagttcgtggacggcggccaggtgaacgacagagactacatggagagaaacaagatcgacgtgaacgagatcagcagacacctgggcaagatgtacagcgagatgatcttcgtgaacggcttcgtgcactgcgacccccaccccggcaacgtgctggtgagaaagcaccccggcaccggcaaggccgagatcgtgctgctggaccacggcctgtaccagatgctgaccgaggagttcagactgaactactgccacctgtggcagagcctgatctggaccgacatgaagagagtgaaggagtacagccagagactgggcgccggcgacctgtaccccctgttcgcctgcatgctgaccgccagaagctgggacagcgtgaacagaggcatcagccaggcccccgtgaccgccaccgaggacctggagatcagaaacaacgccgccaactacctgccccagatcagccacctgctgaaccacgtgcccagacagatgctgctgatcctgaagaccaacgacctgctgagaggcatcgaggccgccctgggcaccagagccagcgccagcagcttcctgaacatgagcagatgctgcatcagagccctggccgagcacaagaagaagaacacctgcagcttcttcagaagaacccagatcagcttcagcgaggccttcaacctgtggcagatcaacctgcacgagctgatcctgagagtgaagggcctgaagctggccgacagagtgctggccctgatctgctggctgttccccgcccccctgtag

SEQ ID NO: 3905 - DNA, 1245 bp, Artificial Sequence
  Description of Artificial Sequence: Synthetic coding sequence
atgaaccccaccctgggcctggccatcttcctggccgtgctgctgaccgtgaagggcctgctgaagcccagcttcagccccagaaactacaaggccctgagcgaggtgcagggctggaagcagagaatggccgccaaggagctggccagacagaacatggacctgggcttcaagctgctgaagaagctggccttctacaaccccggcagaaacatcttcctgagccccctgagcatcagcaccgccttcagcatgctgtgcctgggcgcccaggacagcaccctggacgagatcaagcagggcttcaacttcagaaagatgcccgagaaggacctgcacgagggcttccactacatcatccacgagctgacccagaagacccaggacctgaagctgagcatcggcaacaccctgttcatcgaccagagactgcagccccagagaaagttcctggaggacgccaagaacttctacagcgccgagaccatcctgaccaacttccagaacctggagatggcccagaagcagatcaacgacttcatcagccagaagacccacggcaagatcaacaacctgatcgagaacatcgaccccggcaccgtgatgctgctggccaactacatcttcttcagagccagatggaagcacgagttcgaccccaacgtgaccaaggaggaggacttcttcctggagaagaacagcagcgtgaaggtgcccatgatgttcagaagcggcatctaccaggtgggctacgacgacaagctgagctgcaccatcctggagatcccctaccagaagaacatcaccgccatcttcatcctgcccgacgagggcaagctgaagcacctggagaagggcctgcaggtggacaccttcagcagatggaagaccctgctgagcagaagagtggtggacgtgagcgtgcccagactgcacatgaccggcaccttcgacctgaagaagaccctgagctacatcggcgtgagcaagatcttcgaggagcacggcgacctgaccaagatcgccccccacagaagcctgaaggtgggcgaggccgtgcacaaggccgagctgaagatggacgagagaggcaccgagggcgccgccggcaccggcgcccagaccctgcccatggagacccccctggtggtgaagatcgacaagccctacctgctgctgatctacagcgagaagatccccagcgtgctgttcctgggcaagatcgtgaaccccatcggcaagtag

SEQ ID NO: 3906 - DNA, 942 bp, Artificial Sequence
  Description of Artificial Sequence: Synthetic coding sequence
atgagcgacctgctgctgctgggcctgatcggcggcctgaccctgctgctgctgctgaccctgctggccttcgccggctacagcggcctgctggccggcgtggaggtgagcgccggcagcccccccatcagaaacgtgaccgtggcctacaagttccacatgggcctgtacggcgagaccggcagactgttcaccgagagctgcagcatcagccccaagctgagaagcatcgccgtgtactacgacaacccccacatggtgccccccgacaagtgcagatgcgccgtgggcagcatcctgagcgagggcgaggagagccccagccccgagctgatcgacctgtaccagaagttcggcttcaaggtgttcagcttccccgcccccagccacgtggtgaccgccaccttcccctacaccaccatcctgagcatctggctggccaccagaagagtgcaccccgccctggacacctacatcaaggagagaaagctgtgcgcctaccccagactggagatctaccaggaggaccagatccacttcatgtgccccctggccagacagggcgacttctacgtgcccgagatgaaggagaccgagtggaagtggagaggcctggtggaggccatcgacacccaggtggacggcaccggcgccgacaccatgagcgacaccagcagcgtgagcctggaggtgagccccggcagcagagagaccagcgccgccaccctgagccccggcgccagcagcagaggctgggacgacggcgacaccagaagcgagcacagctacagcgagagcggcgccagcggcagcagcttcgaggagctggacctggagggcgagggccccctgggcgagagcagactggaccccggcaccgagcccctgggcaccaccaagtggctgtgggagcccaccgcccccgagaagggcaaggagtag

SEQ ID NO: 3907 - DNA, 603 bp, Artificial Sequence
  Description of Artificial Sequence: Synthetic coding sequence
atggcctggggcggcgtgcacacctgctgcttccacctgtgctgctgctgcagctggccccagggcgccgtgcccgaggagctgcacaagcaccccggccagaccctgctgctgcagtgccagtacagccccaagagaggcccctaccagcccaagagctggtgccagcagaccagccccagcagatgcaccctgctggtgaccagcagcaagccctggaccgccgtgcagaagagccactacaccatctgggacaagcccaacgccggcttcttcaacatcaccatgatccagctgacccagaacgacagcggcttctactggtgcggcatctacaacgccagcgagaacatcatcaccgtgctgagaaacatcagcctggtggtgagccccgcccccaccaccagccccatgtggaccctgccctggctgcccaccagcaccgtgctgatcaccagccccgagggcaccagcggccaccccagcatcaacggcagcgagaccagaaagagcagagcccccgcctgcctgggcagcggcggccccagattcctggtgctggtgctgtgcggcctgctgctggccaagggcctgatgctgtag

SEQ ID NO: 3908 - DNA, 1035 bp, Artificial Sequence
  Description of Artificial Sequence: Synthetic coding sequence
accacccccagcagagccctgcccggctggagcaactgcagacccagatggagagccggccccaccccccagagccccaccccccagagcagaatgagactgagccccggcccccccagcgagtggacctggctgctgccccacttcaacccctgccaccaccaccacagacaccaccaccccaaccccaccaccagcctgctgcccaccgagccccccagcggccccgaggtgagcagccagggcagagaggccagctgcgagggcaccctgagagccgtggacccccccgtgagacaccacagctacggcagacacgagggcgcctggatgaaggaccccgccgccagagacgacagaatctacgtgaccaactactactacggcaacagcctggtggagttcagaaacctggagaacttcaagcagggcagatggagcaacatgtacaagctgccctacaactggatcggcaccggccacgtggtgtaccagggcgccttctactacaacagagccttcaccaagaacatcatcaagtacgacctgagacagagattcgtggccagctgggccctgctgcccgacgtggtgtacgaggacaccaccccctggaagtggagaggccacagcgacatcgacttcgccgtggacgagagcggcctgtgggtgatctaccccgccgtggacgacagagacgaggcccagcccgaggtgatcgtgctgagcagactggaccccggcgacctgagcgtgcacagagagaccacctggaagaccagactgagaagaaacagctacggcaactgcttcctggtgtgcggcatcctgtacgccgtggacacctacaaccagcaggagggccaggtggcctacgccttcgacacccacaccggcaccgacgccagaccccagctgcccttcctgaacgagcacgcctacaccacccagatcgactacaaccccaaggagagagtgctgtacgcctgggacaacggccaccagctgacctacaccctgcacttcgtggtgtag

SEQ ID NO: 3909 - DNA, 2682 bp, Artificial Sequence
  Description of Artificial Sequence: Synthetic coding sequence
atggccgaggccgccctggaggccgtgagaagcgagctgagagagttccccgccgccgccagagagctgtgcgtgcccctggccgtgccctacctggacaagccccccacccccctgcacttctacagagactgggtgtgccccaacagaccctgcatcatcagaaacgccctgcagcactggcccgccctgcagaagtggagcctgccctacttcagagccaccgtgggcagcaccgaggtgagcgtggccgtgacccccgacggctacgccgacgccgtgagaggcgacagattcatgatgcccgccgagagaagactgcccctgagcttcgtgctggacgtgctggagggcagagcccagcaccccggcgtgctgtacgtgcagaagcagtgcagcaacctgcccagcgagctgccccagctgctgcccgacctggagagccacgtgccctgggccagcgaggccctgggcaagatgcccgacgccgtgaacttctggctgggcgaggccgccgccgtgaccagcctgcacaaggaccactacgagaacctgtactgcgtggtgagcggcgagaagcacttcctgttccacccccccagcgacagacccttcatcccctacgagctgtacacccccgccacctaccagctgaccgaggagggcaccttcaaggtggtggacgaggaggccatggagaaggccgaggtgagcagaacctgcctgctgaccgtgagagtgctgcaggcccacagactgcccagcaaggacctggtgacccccagcgactgctacgtgaccctgtggctgcccaccgcctgcagccacagactgcagaccagaaccgtgaagaacagcagcagccccgtgtggaaccagagcttccacttcagaatccacagacagctgaagaacgtgatggagctgaaggtgttcgaccaggacctggtgaccggcgacgaccccgtgctgagcgtgctgttcgacgccggcaccctgagagccggcgagttcagaagagagagcttcagcctgagcccccagggcgagggcagactggaggtggagttcagactgcagagcctggccgacagaggcgagtggctggtgagcaacggcgtgctggtggccagagagctgagctgcctgcacgtgcagctggaggagaccggcgaccagaagagcagcgagcacagagtgcagctggtggtgcccggcagctgcgagggcccccaggaggccagcgtgggcaccggcaccttcagattccactgccccgcctgctgggagcaggagctgagcatcagactgcaggacgcccccgaggagcagctgaaggcccccctgagcgccctgcccagcggccaggtggtgagactggtgttccccaccagccaggagcccctgatgagagtggagctgaagaaggaggccggcctgagagagctggccgtgagactgggcttcggcccctgcgccgaggagcaggccttcctgagcagaagaaagcaggtggtggccgccgccctgagacaggccctgcagctggacggcgacctgcaggaggacgagatccccgtggtggccatcatggccaccggcggcggcatcagagccatgaccagcctgtacggccagctggccggcctgaaggagctgggcctgctggactgcgtgagctacatcaccggcgccagcggcagcacctgggccctggccaacctgtacgaggaccccgagtggagccagaaggacctggccggccccaccgagctgctgaagacccaggtgaccaagaacaagctgggcgtgctggcccccagccagctgcagagatacagacaggagctggccgagagagccagactgggctaccccagctgcttcaccaacctgtgggccctgatcaacgaggccctgctgcacgacgagccccacgaccacaagctgagcgaccagagagaggccctgagccacggccagaaccccctgcccatctactgcgccctgaacaccaagggccagagcctgaccaccttcgagttcggcgagtggtgcgagttcagcccctacgaggtgggcttccccaagtacggcgccttcatccccagcgagctgttcggcagcgagttcttcatgggccagctgatgaagagactgcccgagagcagaatctgcttcctggagggcatctggagcaacctgtacgccgccaacctgcaggacagcctgtactgggccagcgagcccagccagttctgggacagatgggtgagaaaccaggccaacctggacaaggagcaggtgcccctgctgaagatcgaggagccccccagcaccgccggcagaatcgccgagttcttcaccgacctgctgacctggagacccctggcccaggccacccacaacttcctgagaggcctgcacttccacaaggactacttccagcacccccacttcagcacctggaaggccaccaccctggacggcctgcccaaccagctgacccccagcgagccccacctgtgcctgctggacgtgggctacctgatcaacaccagctgcctgcccctgctgcagcccaccagagacgtggacctgatcctgagcctggactacaacctgcacggcgccttccagggcagcggcggccaccccagaagaagacagctgggcagatag

SEQ ID NO: 3910 - DNA, 354 bp, Artificial Sequence
  Description of Artificial Sequence: Synthetic coding sequence
atgatcatcgacagcagcagaatccccagcttcacccagctgcacagcaccatgaccagagcccccctgctgctgctgtgcgtggccctggtgctgctgggccacgtgaacggcgccaccgtgagaaacgaggacaagtggaagcccctgaacaaccccagaaacagagacctgttcttcagaagactgcaggcctacttcaagggcagaggcctggacctgggcaccttccccaaccccttccccaccaacgagaaccccagacccctgagcttccagagcgagctgaccgccagcgccagcgccgactacgaggagcagaagaacagcttccacaactacctgaagggctag

SEQ ID NO: 3911 - DNA, 4143 bp, Artificial Sequence
  Description of Artificial Sequence: Synthetic coding sequence
atgagacacggcgtggcctgggccctgctggtggccgccgccctgggcctgggcgccagaggcgtgagaggcgccgtggccctggccgacttctaccccttcggcgccgagagaggcgacgccgtgacccccaagcaggacgacggcggcagcggcctgagacccctgagcgtgcccttccccttcttcggcgccgagcacagcggcctgtacgtgaacaacaacggcatcatcagcttcctgaaggaggtgagccagttcacccccgtggccttccccatcgccaaggacagatgcgtggtggccgccttctgggccgacgtggacaacagaagagccggcgacgtgtactacagagaggccaccgaccccgccatgctgagaagagccaccgaggacgtgagacactacttccccgagctgctggacttcaacgccacctgggtgttcgtggccacctggtacagagtgaccttcttcggcggcagcagcagcagccccgtgaacaccttccagaccgtgctgatcaccgacggcaagctgagcttcaccatcttcaactacgagagcatcgtgtggaccaccggcacccacgccagcagcggcggcaacgccaccggcctgggcggcatcgccgcccaggccggcttcaacgccggcgacggccagagatacttcagcatccccggcagcagaaccgccgacatggccgaggtggagaccaccaccaacgtgggcgtgcccggcagatgggccttcagaatcgacgacgcccaggtgagagtgggcggctgcggccacaccaccagcgtgtgcctggccctgagaccctgcctgaacggcggcaagtgcatcgacgactgcgtgaccggcaaccccagctacacctgcagctgcctgagcggcttcaccggcagaagatgccacctggacgtgaacgagtgcgccagccagccctgccagaacggcggcacctgcacccacggcatcaacagcttcagatgccagtgccccgccggcttcggcggccccacctgcgagaccgcccagagcccctgcgacaccaaggagtgccagcacggcggccagtgccaggtggagaacggcagcgccgtgtgcgtgtgccaggccggctacaccggcgccgcctgcgagatggacgtggacgactgcagccccgacccctgcctgaacggcggcagctgcgtggacctggtgggcaactacacctgcctgtgcgccgagcccttcaagggcctgagatgcgagaccggcgaccaccccgtgcccgacgcctgcctgagcgccccctgccacaacggcggcacctgcgtggacgccgaccagggctacgtgtgcgagtgccccgagggcttcatgggcctggactgcagagagagagtgcccgacgactgcgagtgcagaaacggcggcagatgcctgggcgccaacaccaccctgtgccagtgccccctgggcttcttcggcctgctgtgcgagttcgagatcaccgccatgccctgcaacatgaacacccagtgccccgacggcggctactgcatggagcacggcggcagctacctgtgcgtgtgccacaccgaccacaacgccagccacagcctgcccagcccctgcgacagcgacccctgcttcaacggcggcagctgcgacgcccacgacgacagctacacctgcgagtgccccagaggcttccacggcaagcactgcgagaaggccagaccccacctgtgcagcagcggcccctgcagaaacggcggcacctgcaaggaggccggcggcgagtaccactgcagctgcccctacagattcaccggcagacactgcgagatcggcaagcccgacagctgcgccagcggcccctgccacaacggcggcacctgcttccactacatcggcaagtacaagtgcgactgcccccccggcttcagcggcagacactgcgagatcgcccccagcccctgcttcagaagcccctgcgtgaacggcggcacctgcgaggacagagacaccgacttcttctgccactgccaggccggctacatgggcagaagatgccaggccgaggtggactgcggcccccccgaggaggtgaagcacgccaccctgagattcaacggcaccagactgggcgccgtggccctgtacgcctgcgacagaggctacagcctgagcgcccccagcagaatcagagtgtgccagccccacggcgtgtggagcgagcccccccagtgcctggagatcgacgagtgcagaagccagccctgcctgcacggcggcagctgccaggacagagtggccggctacctgtgcctgtgcagcaccggctacgagggcgcccactgcgagctggagagagacgagtgcagagcccacccctgcagaaacggcggcagctgcagaaacctgcccggcgcctacgtgtgcagatgccccgccggcttcgtgggcgtgcactgcgagaccgaggtggacgcctgcgacagcagcccctgccagcacggcggcagatgcgagagcggcggcggcgcctacctgtgcgtgtgccccgagagcttcttcggctaccactgcgagaccgtgagcgacccctgcttcagcagcccctgcggcggcagaggctactgcctggccagcaacggcagccacagctgcacctgcaaggtgggctacaccggcgaggactgcgccaaggagctgttcccccccaccgccctgaagatggagagagtggaggagagcggcgtgagcatcagctggaacccccccaacggccccgccgccagacagatgctggacggctacgccgtgacctacgtgagcagcgacggcagctacagaagaaccgacttcgtggacagaaccagaagcagccaccagctgcaggccctggccgccggcagagcctacaacatcagcgtgttcagcgtgaagagaaacagcaacaacaagaacgacatcagcagacccgccgtgctgctggccagaaccagacccagacccgtggagggcttcgaggtgaccaacgtgaccgccagcaccatcagcgtgcagtgggccctgcacagaatcagacacgccaccgtgagcggcgtgagagtgagcatcagacaccccgaggccctgagagaccaggccaccgacgtggacagaagcgtggacagattcaccttcagagccctgctgcccggcaagagatacaccatccagctgaccaccctgagcggcctgagaggcgaggagcaccccaccgagagcctggccaccgcccccacccacgtgtggaccagacccctgccccccgccaacctgaccgccgccagagtgaccgccaccagcgcccacgtggtgtgggacgcccccacccccggcagcctgctggaggcctacgtgatcaacgtgaccaccagccagagcaccaagagcagatacgtgcccaacggcaagctggccagctacaccgtgagagacctgctgcccggcagaagataccagctgagcgtgatcgccgtgcagagcaccgagctgggcccccagcacagcgagcccgcccacctgtacatcatcaccagccccagagacggcgccgacagaagatggcaccagggcggccaccaccccagagtgctgaagaacagacccccccccgccagactgcccgagctgagactgctgaacgaccacagcgcccccgagacccccacccagccccccagattcagcgagctggtggacggcagaggcagagtgagcgccagattcggcggcagccccagcaaggccgccaccgtgagaagccacgtgcccggcaactgcagcgagaacccctgccagaacggcggcacctgcgtgcccggcgccgacgcccacagctgcgactgcggccccggcttcaagggcagaagatgcgagctggcctgcatcaaggtgagcagaccctgcaccagactgttcagcgagaccaaggccttccccgtgtgggagggcggcgtgtgccaccacgtgtacaagagagtgtacagagtgcaccaggacatctgcttcaaggagagctgcgagagcaccagcctgaagaagacccccaacagaaagcagagcaagagccagaccctggagaagagctag

SEQ ID NO: 3912 - DNA, 474 bp, Artificial Sequence
  Description of Artificial Sequence: Synthetic coding sequence
atggaggccctgagaagagcccacgaggtggccctgagactgctgctgtgcagaccctgggccagcagagccgccgccagacccaagcccagcgccagcgaggtgctgaccagacacctgctgcagagaagactgccccactggaccagcttctgcgtgccctacagcgccgtgagaaacgaccagttcggcctgagccacttcaactggcccgtgcagggcgccaactaccacgtgctgagaaccggctgcttccccttcatcaagtaccactgcagcaaggccccctggcaggacctggccagacagaacagattcttcaccgccctgaaggtggtgaacctgggcatccccaccctgctgtacggcctgggcagctggctgttcgccagagtgaccgagaccgtgcacaccagctacggccccatcaccgtgtacttcctgaacaaggaggacgagggcgccatgtactag

SEQ ID NO: 3913 - DNA, 288 bp, Artificial Sequence
  Description of Artificial Sequence: Synthetic coding sequence
atgaagggcagcagagccctgctgctggtggccctgaccctgttctgcatctgcagaatggccaccggcgaggacaacgacgagttcttcatggacttcctgcagaccctgctggtgggcacccccgaggagctgtacgagggcaccctgggcaagtacaacgtgaacgaggacgccaaggccgccatgaccgagctgaagagctgcatcgacggcctgcagcccatgcacaaggccgagctggtgaagctgctggtgcaggtgctgggcagccaggacggcgcctag

SEQ ID NO: 3914 - DNA, 1053 bp, Artificial Sequence
  Description of Artificial Sequence: Synthetic coding sequence
atgaagtgcagcctgagagtgtggttcctgagcgtggccttcctgctggtgttcatcatgagcctgctgttcacctacagccaccacagcatggccaccctgccctacctggacagcggcgccctggacggcacccacagagtgaagctggtgcccggctacgccggcctgcagagactgagcaaggagagactgagcggcaagagctgcgcctgcagaagatgcatgggcgacgccggcgccagcgactggttcgacagccacttcgacggcaacatcagccccgtgtggaccagagagaacatggacctgccccccgacgtgcagagatggtggatgatgctgcagccccagttcaagagccacaacaccaacgaggtgctggagaagctgttccagatcgtgcccggcgagaacccctacagattcagagacccccaccagtgcagaagatgcgccgtggtgggcaacagcggcaacctgagaggcagcggctacggccaggacgtggacggccacaacttcatcatgagaatgaaccaggcccccaccgtgggcttcgagcaggacgtgggcagcagaaccacccaccacttcatgtaccccgagagcgccaagaacctgcccgccaacgtgagcttcgtgctggtgcccttcaaggtgctggacctgctgtggatcgccagcgccctgagcaccggccagatcagattcacctacgcccccgtgaagagcttcctgagagtggacaaggagaaggtgcagatctacaaccccgccttcttcaagtacatccacgacagatggaccgagcaccacggcagataccccagcaccggcatgctggtgctgttcttcgccctgcacgtgtgcgacgaggtgaacgtgtacggcttcggcgccgacagcagaggcaactggcaccactactgggagaacaacagatacgccggcgagttcagaaagaccggcgtgcacgacgccgacttcgaggcccacatcatcgacatgctggccaaggccagcaagatcgaggtgtacagaggcaactag

SEQ ID NO: 3915 - DNA, 600 bp, Artificial Sequence
  Description of Artificial Sequence: Synthetic coding sequence
atggccagccccgaggcccccgagagcgtggtgcagttcgccctggacaagctgggcggcctggactacctggtgctgaaccacatcggcggcgcccccgccggcaccagagccagaagcccccaggccaccagatggctgatgcaggtgaacttcgtgagctacgtgcagctgaccagcagagccctgcccagcctgaccgacagcaagggcagcctggtggtggtgagcagcctgctgggcagagtgcccaccagcttcagcaccccctacagcgccgccaagttcgccctggacggcttcttcggcagcctgagaagagagctggacgtgcaggacgtgaacgtggccatcaccatgtgcgtgctgggcctgagagacagagccagcgccgccgaggccgtgagaggcgtgaccagagtgaaggccgcccccggccccaaggccgccctggccgtgatcagaggcggcgccaccagagccgccggcgtgttctacccctggagattcagactgctgtgcctgctgagaagatggctgcccagacccagagcctggttcatcagacaggagctgaacgtgaccgccgccgccgcctag

SEQ ID NO: 3916 - DNA, 411 bp, Artificial Sequence
  Description of Artificial Sequence: Synthetic coding sequence
atggtgagaccctaccccctgatctacttcctgttcctgcccctgggcgcctgcttccccctgctggacagaagagagcccaccgacgccatgggcggcctgggcgccggcgagagatgggccgacctggccatgggccccagaccccacagcgtgtggggcagcagcagatggctgagagccagccagccccaggccctgctggtgatcgccagaggcctgcagaccagcggcagagagcacgccggctgcagattcagattcggcagacaggacgagggcagcgaggccaccggcttcctgcccgccgccggcgagaagaccagcggccccctgggcaacctggccgaggagctgaacggctacagcagaaagaagggcggcttcagcttcagattcggcagaagatag

SEQ ID NO: 3917 - DNA, 663 bp, Artificial Sequence
  Description of Artificial Sequence: Synthetic coding sequence
atgagaggccagggcagaaaggagagcctgagcgacagcagagacctggacggcagctacgaccagctgaccgacagcgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 3918 - DNA, 2175 bp, Artificial Sequence
  Description of Artificial Sequence: Synthetic coding sequence
atgctgagaaccagcacccccaacctgtgcggcggcctgcactgcagagccccctggctgagcagcggcatcctgtgcctgtgcctgatcttcctgctgggccaggtgggcctgctgcagggccacccccagtgcctggactacggcccccccttccagccccccctgcacctggagttctgcagcgactacgagagcttcggctgctgcgaccagcacaaggacagaagaatcgccgccagatactgggacatcatggagtacttcgacctgaagagacacgagctgtgcggcgactacatcaaggacatcctgtgccaggagtgcagcccctacgccgcccacctgtacgacgccgagaacacccagacccccctgagaaacctgcccggcctgtgcagcgactactgcagcgccttccacagcaactgccacagcgccatcagcctgctgaccaacgacagaggcctgcaggagagccacggcagagacggcaccagattctgccacctgctggacctgcccgacaaggactactgcttccccaacgtgctgagaaacgactacctgaacagacacctgggcatggtggcccaggacccccagggctgcctgcagctgtgcctgagcgaggtggccaacggcctgagaaaccccgtgagcatggtgcacgccggcgacggcacccacagattcttcgtggccgagcaggtgggcgtggtgtgggtgtacctgcccgacggcagcagactggagcagcccttcctggacctgaagaacatcgtgctgaccaccccctggatcggcgacgagagaggcttcctgggcctggccttccaccccaagttcagacacaacagaaagttctacatctactacagctgcctggacaagaagaaggtggagaagatcagaatcagcgagatgaaggtgagcagagccgaccccaacaaggccgacctgaagagcgagagagtgatcctggagatcgaggagcccgccagcaaccacaacggcggccagctgctgttcggcctggacggctacatgtacatcttcaccggcgacggcggccaggccggcgaccccttcggcctgttcggcaacgcccagaacaagagcagcctgctgggcaaggtgctgagaatcgacgtgaacagagccggcagccacggcaagagatacagagtgcccagcgacaaccccttcgtgagcgagcccggcgcccaccccgccatctacgcctacggcatcagaaacatgtggagatgcgccgtggacagaggcgaccccatcaccagacagggcagaggcagaatcttctgcggcgacgtgggccagaacagattcgaggaggtggacctgatcctgaagggcggcaactacggctggagagccaaggagggcttcgcctgctacgacaagaagctgtgccacaacgccagcctggacgacgtgctgcccatctacgcctacggccacgccgtgggcaagagcgtgaccggcggctacgtgtacagaggctgcgagagccccaacctgaacggcctgtacatcttcggcgacttcatgagcggcagactgatggccctgcaggaggacagaaagaacaagaagtggaagaagcaggacctgtgcctgggcagcaccaccagctgcgccttccccggcctgatcagcacccacagcaagttcatcatcagcttcgccgaggacgaggccggcgagctgtacttcctggccaccagctaccccagcgcctacgcccccagaggcagcatctacaagttcgtggaccccagcagaagagccccccccggcaagtgcaagtacaagcccgtgcccgtgagaaccaagagcaagagaatccccttcagacccctggccaagaccgtgctggacctgctgaaggagcagagcgagaaggccgccagaaagagcagcagcgccaccctggccagcggccccgcccagggcctgagcgagaagggcagcagcaagaagctggccagccccaccagcagcaagaacaccctgagaggccccggcaccaagaagaaggccagagtgggcccccacgtgagacagggcaagagaagaaagagcctgaagagccacagcggcagaatgagacccagcgccgagcagaagagagccggcagaagcctgccctag

SEQ ID NO: 3919 - DNA, 1218 bp, Artificial Sequence
  Description of Artificial Sequence: Synthetic coding sequence
atgtggtacgtgagcaccagaggcgtggcccccagagtgaacttcgagggcgccctgttcagcggctacgcccccgacggcggcctgttcatgcccgaggagctgccccagctggacagaggcaccctgtgccagtggagcaccctgagctaccccggcctggtgaaggagctgtgcgccctgttcatcggcagcgagctgctgcccaaggacgagctgaacgacctgatcgacagagccttcagcagattcagacacagagaggtggtgcacctgagcagactgagaaacggcctgaacgtgctggagctgtggcacggcgtgacctacgccttcaaggacctgagcctgagctgcaccacccagttcctgcagtacttcctggagaagagagagaagcacgtgaccgtggtggtgggcaccagcggcgacaccggcagcgccgccatcgagagcgtgcagggcgccaagaacatggacatcatcgtgctgctgcccaagggccactgcaccaagatccaggagctgcagatgaccaccgtgctgaagcagaacgtgcacgtgttcggcgtggagggcaacagcgacgagctggacgagcccatcaagaccgtgttcgccgacgtggccttcgtgaagaagcacaacctgatgagcctgaacagcatcaactggagcagagtgctggtgcagatggcccaccacttcttcgcctacttccagtgcacccccagcctggacacccaccccctgcccctggtggaggtggtggtgcccaccggcgccgccggcaacctggccgccggctacatcgcccagaagatcggcctgcccatcagactggtggtggccgtgaacagaaacgacatcatccacagaaccgtgcagcagggcgacttcagcctgagcgaggccgtgaagagcaccctggccagcgccatggacatccaggtgccctacaacatggagagagtgttctggctgctgagcggcagcgacagccaggtgaccagagccctgatggagcagttcgagagaacccagagcgtgaacctgcccaaggagctgcacagcaagtgggagagacaggactacgagaagatggccgtgatggagtgcgacggctgctgcgtggagctgtgcctgggcaactgcggccccagaagaggcagcgtgaccgacatccccggcaccgccatggtgagaggcggcggctag

SEQ ID NO: 3920 - DNA, 492 bp, Artificial Sequence
  Description of Artificial Sequence: Synthetic coding sequence
atgaccatgagacacaactggacccccgacctgagccccctgtgggtgctgctgctgtgcgcccacgtggtgaccctgctggtgagagccacccccgtgagccagaccaccaccgccgccaccgccagcgtgagaagcaccaaggacccctgccccagccagccccccgtgttccccgccgccaagcagtgccccgccctggaggtgacctggcccgaggtggaggtgcccctgaacggcaccctgagcctgagctgcgtggcctgcagcagattccccaacttcagcatcctgtactggctgggcaacggcagcttcatcgagcacctgcccggcagactgtgggagggcagcaccagcagagagagaggcagcaccggctgggccgagggcaacctggccccccaccccagaagccccgccctgcagccccagcagagcaccgccgccggcctgagactgagcaccggccccgccgccgcccagccctag

SEQ ID NO: 3921 - DNA, 1590 bp, Artificial Sequence
  Description of Artificial Sequence: Synthetic coding sequence
atggcccccgccagaaccatggccagagccagactggcccccgccggcatccccgccgtggccctgtggctgctgtgcaccctgggcctgcagggcacccaggccggccccccccccgccccccccggcctgcccgccggcgccgactgcctgaacagcttcaccgccggcgtgcccggcttcgtgctggacaccaacgccagcgtgagcaacggcgccaccttcctggagagccccaccgtgagaagaggctgggactgcgtgagagcctgctgcaccacccagaactgcaacctggccctggtggagctgcagcccgacagaggcgaggacgccatcgccgcctgcttcctgatcaactgcctgtacgagcagaacttcgtgtgcaagttcgcccccagagagggcttcatcaactacctgaccagagaggtgtacagaagctacagacagctgagaacccagggcttcggcggcagcggcatccccaaggcctgggccggcatcgacctgaaggtgcagccccaggagcccctggtgctgaaggacgtggagaacaccgactggagactgctgagaggcgacaccgacgtgagagtggagagaaaggaccccaaccaggtggagctgtggggcctgaaggagggcacctacctgttccagctgaccgtgaccagcagcgaccaccccgaggacaccgccaacgtgaccgtgaccgtgctgagcaccaagcagaccgaggactactgcctggccagcaacaaggtgggcagatgcagaggcagcttccccagatggtactacgaccccaccgagcagatctgcaagagcttcgtgtacggcggctgcctgggcaacaagaacaactacctgagagaggaggagtgcatcctggcctgcagaggcgtgcagggcggccccctgagaggcagcagcggcgcccaggccaccttcccccagggccccagcatggagagaagacaccccgtgtgcagcggcacctgccagcccacccagttcagatgcagcaacggctgctgcatcgacagcttcctggagtgcgacgacacccccaactgccccgacgccagcgacgaggccgcctgcgagaagtacaccagcggcttcgacgagctgcagagaatccacttccccagcgacaagggccactgcgtggacctgcccgacaccggcctgtgcaaggagagcatccccagatggtactacaaccccttcagcgagcactgcgccagattcacctacggcggctgctacggcaacaagaacaacttcgaggaggagcagcagtgcctggagagctgcagaggcatcagcaagaaggacgtgttcggcctgagaagagagatccccatccccagcaccggcagcgtggagatggccgtggccgtgttcctggtgatctgcatcgtggtggtggtggccatcctgggctactgcttcttcaagaaccagagaaaggacttccacggccaccaccaccaccccccccccacccccgccagcagcaccgtgagcaccaccgaggacaccgagcacctggtgtacaaccacaccaccagacccctgtag

SEQ ID NO: 3922 - DNA, 1803 bp, Artificial Sequence
  Description of Artificial Sequence: Synthetic coding sequence
atgcagggccccctgctgctgcccggcctgtgcttcctgctgagcctgttcggcgccgtgacccagaagaccaagaccagctgcgccaagtgcccccccaacgccagctgcgtgaacaacacccactgcacctgcaaccacggctacaccagcggcagcggccagaagctgttcaccttccccctggagacctgcaacgacaccaccagcagcaagaccaccgagggcagaaaggagctgcagaagatcgtggacaagttcgagagcctgctgaccaaccagaccctgtggagaaccgagggcagacaggagatcagcagcaccgccaccaccatcctgagagacgtggagagcaaggtgctggagaccgccctgaaggaccccgagcagaaggtgctgaagatccagaacgacagcgtggccatcgagacccaggccatcaccgacaactgcagcgaggagagaaagaccttcaacctgaacgtgcagatgaacagcatggacatcagatgcagcgacatcatccagggcgacacccagggccccagcgccatcgccttcatcagctacagcagcctgggcaacatcatcaacgccaccttcttcgaggagatggacaagaaggaccaggtgtacctgaacagccaggtggtgagcgccgccatcggccccaagagaaacgtgagcctgagcaagagcgtgaccctgaccttccagcacgtgaagatgacccccagcaccaagaaggtgttctgcgtgtactggaagagcaccggccagggcagccagtggagcagagacggctgcttcctgatccacgtgaacaagagccacaccatgtgcaactgcagccacctgagcagcttcgccgtgctgatggccctgaccagccaggaggaggaccccgtgctgaccgtgatcacctacgtgggcctgagcgtgagcctgctgtgcctgctgctggccgccctgaccttcctgctgtgcaaggccatcagaaacaccagcaccagcctgcacctgcagctgagcctgtgcctgttcctggcccacctgctgttcctggtgggcatcgacagaaccgagcccaaggtgctgtgcagcatcatcgccggcgccctgcactacctgtacctggccgccttcacctggatgctgctggagggcgtgcacctgttcctgaccgccagaaacctgaccgtggtgaactacagcagcatcaacagactgatgaagtggatcatgttccccgtgggctacggcgtgcccgccgtgaccgtggccatcagcgccgccagctggccccacctgtacggcaccgccgacagatgctggctgcacctggaccagggcttcatgtggagcttcctgggccccgtgtgcgccatcttcagcgccaacctggtgctgttcatcctggtgttctggatcctgaagagaaagctgagcagcctgaacagcgaggtgagcaccatccagaacaccagaatgctggccttcaaggccaccgcccagctgttcatcctgggctgcacctggtgcctgggcctgctgcaggtgggccccgccgcccaggtgatggcctacctgttcaccatcatcaacagcctgcagggcttcttcatcttcctggtgtactgcctgctgagccagcaggtgcagaagcagtaccagaagtggttcagagagatcgtgaagagcaagagcgagagcgagacctacaccctgagcagcaagatgggccccgacagcaagcccagcgagggcgacgtgttccccggccaggtgaagagaaagtactag

SEQ ID NO: 3923 - DNA, 660 bp, Artificial Sequence
  Description of Artificial Sequence: Synthetic coding sequence
atgaagctgctgctgtgggcctgcatcgtgtgcgtggccttcgccagaaagagaagattccccttcatcggcgaggacgacaacgacgacggccaccccctgcaccccagcctgaacatcccctacggcatcagaaacctgcccccccccctgtactacagacccgtgaacaccgtgcccagctaccccggcaacacctacaccgacaccggcctgcccagctacccctggatcctgaccagccccggcttcccctacgtgtaccacatcagaggcttccccctggccacccagctgaacgtgccccccctgccccccagaggcttccccttcgtgccccccagcagattcttcagcgccgccgccgcccccgccgccccccccatcgccgccgagcccgccgccgccgcccccctgaccgccacccccgtggccgccgagcccgccgccggcgcccccgtggccgccgagcccgccgccgaggcccccgtgggcgccgagcccgccgccgaggcccccgtggccgccgagcccgccgccgaggcccccgtgggcgtggagcccgccgccgaggagcccagccccgccgagcccgccaccgccaagcccgccgcccccgagccccaccccagccccagcctggagcaggccaaccagtag

SEQ ID NO: 3924 - DNA, 1743 bp, Artificial Sequence
  Description of Artificial Sequence: Synthetic coding sequence
atgcacctgagcgccgtgttcaacgccctgctggtgagcgtgctggccgccgtgctgtggaagcacgtgagactgagagagcacgccgccaccctggaggaggagctggccctgagcagacaggccaccgagcccgcccccgccctgagaatcgactaccccaaggccctgcagatcctgatggagggcggcacccacatggtgtgcaccggcagaacccacaccgacagaatctgcagattcaagtggctgtgctacagcaacgaggccgaggagttcatcttcttccacggcaacaccagcgtgatgctgcccaacctgggcagcagaagattccagcccgccctgctggacctgagcaccgtggaggaccacaacacccagtacttcaacttcgtggagctgcccgccgccgccctgagattcatgcccaagcccgtgttcgtgcccgacgtggccctgatcgccaacagattcaaccccgacaacctgatgcacgtgttccacgacgacctgctgcccctgttctacaccctgagacagttccccggcctggcccacgaggccagactgttcttcatggagggctggggcgagggcgcccacttcgacctgtacaagctgctgagccccaagcagcccctgctgagagcccagctgaagaccctgggcagactgctgtgcttcagccacgccttcgtgggcctgagcaagatcaccacctggtaccagtacggcttcgtgcagccccagggccccaaggccaacatcctggtgagcggcaacgagatcagacagttcgccagattcatgaccgagaagctgaacgtgagccacaccggcgtgcccctgggcgaggagtacatcctggtgttcagcagaacccagaacagactgatcctgaacgaggccgagctgctgctggccctggcccaggagttccagatgaagaccgtgaccgtgagcctggaggaccacaccttcgccgacgtggtgagactggtgagcaacgccagcatgctggtgagcatgcacggcgcccagctggtgaccaccctgttcctgcccagaggcgccaccgtggtggagctgttcccctacgccgtgaaccccgaccactacaccccctacaagaccctggccatgctgcccggcatggacctgcagtacgtggcctggagaaacatgatgcccgagaacaccgtgacccaccccgagagaccctgggaccagggcggcatcacccacctggacagagccgagcaggccagaatcctgcagagcagagaggtgcccagacacctgtgctgcagaaaccccgagtggctgttcagaatctaccaggacaccaaggtggacatccccagcctgatccagaccatcagaagagtggtgaagggcagacccggccccagaaagcagaagtggaccgtgggcctgtaccccggcaaggtgagagaggccagatgccaggccagcgtgcacggcgccagcgaggccagactgaccgtgagctggcagatcccctggaacctgaagtacctgaaggtgagagaggtgaagtacgaggtgtggctgcaggagcagggcgagaacacctacgtgccctacatcctggccctgcagaaccacaccttcaccgagaacatcaagcccttcaccacctacctggtgtgggtgagatgcatcttcaacaagatcctgctgggccccttcgccgacgtgctggtgtgcaacacctag

SEQ ID NO: 3925 - DNA, 5130 bp, Artificial Sequence
  Description of Artificial Sequence: Synthetic coding sequence
atgggcttcctgcccaagctgctgctgctggccagcttcttccccgccggccaggccagctggggcgtgagcagcccccaggacgtgcagggcgtgaagggcagctgcctgctgatcccctgcatcttcagcttccccgccgacgtggaggtgcccgacggcatcaccgccatctggtactacgactacagcggccagagacaggtggtgagccacagcgccgaccccaagctggtggaggccagattcagaggcagaaccgagttcatgggcaaccccgagcacagagtgtgcaacctgctgctgaaggacctgcagcccgaggacagcggcagctacaacttcagattcgagatcagcgaggtgaacagatggagcgacgtgaagggcaccctggtgaccgtgaccgaggagcccagagtgcccaccatcgccagccccgtggagctgctggagggcaccgaggtggacttcaactgcagcaccccctacgtgtgcctgcaggagcaggtgagactgcagtggcagggccaggaccccgccagaagcgtgaccttcaacagccagaagttcgagcccaccggcgtgggccacctggagaccctgcacatggccatgagctggcaggaccacggcagaatcctgagatgccagctgagcgtggccaaccacagagcccagagcgagatccacctgcaggtgaagtacgcccccaagggcgtgaagatcctgctgagccccagcggcagaaacatcctgcccggcgagctggtgaccctgacctgccaggtgaacagcagctaccccgccgtgagcagcatcaagtggctgaaggacggcgtgagactgcagaccaagaccggcgtgctgcacctgccccaggccgcctggagcgacgccggcgtgtacacctgccaggccgagaacggcgtgggcagcctggtgagcccccccatcagcctgcacatcttcatggccgaggtgcaggtgagccccgccggccccatcctggagaaccagaccgtgaccctggtgtgcaacacccccaacgaggcccccagcgacctgagatacagctggtacaagaaccacgtgctgctggaggacgcccacagccacaccctgagactgcacctggccaccagagccgacaccggcttctacttctgcgaggtgcagaacgtgcacggcagcgagagaagcggccccgtgagcgtggtggtgaaccacccccccctgacccccgtgctgaccgccttcctggagacccaggccggcctggtgggcatcctgcactgcagcgtggtgagcgagcccctggccaccctggtgctgagccacggcggccacatcctggccagcaccagcggcgacagcgaccacagccccagattcagcggcaccagcggccccaacagcctgagactggagatcagagacctggaggagaccgacagcggcgagtacaagtgcagcgccaccaacagcctgggcaacgccaccagcaccctggacttccacgccaacgccgccagactgctgatcagccccgccgccgaggtggtggagggccaggccgtgaccctgagctgcagaagcggcctgagccccacccccgacgccagattcagctggtacctgaacggcgccctgctgcacgagggccccggcagcagcctgctgctgcccgccgccagcagcaccgacgccggcagctaccactgcagagccagagacggccacagcgccagcggccccagcagccccgccgtgctgaccgtgctgtacccccccagacagcccaccttcaccaccagactggacctggacgccgccggcgccggcgccggcagaagaggcctgctgctgtgcagagtggacagcgacccccccgccagactgcagctgctgcacaaggacagagtggtggccaccagcctgcccagcggcggcggctgcagcacctgcggcggctgcagccccagaatgaaggtgaccaaggcccccaacctgctgagagtggagatccacaaccccctgctggaggaggagggcctgtacctgtgcgaggccagcaacgccctgggcaacgccagcaccagcgccaccttcaacggccaggccaccgtgctggccatcgcccccagccacaccctgcaggagggcaccgaggccaacctgacctgcaacgtgagcagagaggccgccggcagccccgccaacttcagctggttcagaaacggcgtgctgtgggcccagggccccctggagaccgtgaccctgctgcccgtggccagaaccgacgccgccctgtacgcctgcagaatcctgaccgaggccggcgcccagctgagcacccccgtgctgctgagcgtgctgtacccccccgacagacccaagctgagcgccctgctggacatgggccagggccacatggccctgttcatctgcaccgtggacagcagacccctggccctgctggccctgttccacggcgagcacctgctggccaccagcctgggcccccaggtgcccagccacggcagattccaggccaaggccgaggccaacagcctgaagctggaggtgagagagctgggcctgggcgacagcggcagctacagatgcgaggccaccaacgtgctgggcagcagcaacaccagcctgttcttccaggtgagaggcgcctgggtgcaggtgagccccagccccgagctgcaggagggccaggccgtggtgctgagctgccaggtgcacaccggcgtgcccgagggcaccagctacagatggtacagagacggccagcccctgcaggagagcaccagcgccaccctgagattcgccgccatcaccctgacccaggccggcgcctaccactgccaggcccaggcccccggcagcgccaccaccagcctggccgcccccatcagcctgcacgtgagctacgcccccagacacgtgaccctgaccaccctgatggacaccggccccggcagactgggcctgctgctgtgcagagtggacagcgacccccccgcccagctgagactgctgcacggcgacagactggtggccagcaccctgcagggcgtgggcggccccgagggcagcagccccagactgcacgtggccgtggcccccaacaccctgagactggagatccacggcgccatgctggaggacgagggcgtgtacatctgcgaggccagcaacaccctgggccaggccagcgccagcgccgacttcgacgcccaggccgtgaacgtgcaggtgtggcccggcgccaccgtgagagagggccagctggtgaacctgacctgcctggtgtggaccacccaccccgcccagctgacctacacctggtaccaggacggccagcagagactggacgcccacagcatccccctgcccaacgtgaccgtgagagacgccaccagctacagatgcggcgtgggcccccccggcagagcccccagactgagcagacccatcaccctggacgtgctgtacgcccccagaaacctgagactgacctacctgctggagagccacggcggccagctggccctggtgctgtgcaccgtggacagcagaccccccgcccagctggccctgagccacgccggcagactgctggccagcagcaccgccgccagcgtgcccaacaccctgagactggagctgagaggcccccagcccagagacgagggcttctacagctgcagcgccagaagccccctgggccaggccaacaccagcctggagctgagactggagggcgtgagagtgatcctggcccccgaggccgccgtgcccgagggcgcccccatcaccgtgacctgcgccgaccccgccgcccacgcccccaccctgtacacctggtaccacaacggcagatggctgcaggagggccccgccgccagcctgagcttcctggtggccaccagagcccacgccggcgcctacagctgccaggcccaggacgcccagggcaccagaagcagcagacccgccgccctgcaggtgctgtacgccccccaggacgccgtgctgagcagcttcagagacagcagagccagaagcatggccgtgatccagtgcaccgtggacagcgagccccccgccgagctggccctgagccacgacggcaaggtgctggccaccagcagcggcgtgcacagcctggccagcggcaccggccacgtgcaggtggccagaaacgccctgagactgcaggtgcaggacgtgcccgccggcgacgacacctacgtgtgcaccgcccagaacctgctgggcagcatcagcaccatcggcagactgcaggtggagggcgccagagtggtggccgagcccggcctggacgtgcccgagggcgccgccctgaacctgagctgcagactgctgggcggccccggccccgtgggcaacagcaccttcgcctggttctggaacgacagaagactgcacgccgagcccgtgcccaccctggccttcacccacgtggccagagcccaggccggcatgtaccactgcctggccgagctgcccaccggcgccgccgccagcgcccccgtgatgctgagagtgctgtacccccccaagacccccaccatgatggtgttcgtggagcccgagggcggcctgagaggcatcctggactgcagagtggacagcgagcccctggccagcctgaccctgcacctgggcagcagactggtggccagcagccagccccagggcgcccccgccgagccccacatccacgtgctggccagccccaacgccctgagagtggacatcgaggccctgagacccagcgaccagggcgagtacatctgcagcgccagcaacgtgctgggcagcgccagcaccagcacctacttcggcgtgagagccctgcacagactgcaccagttccagcagctgctgtgggtgctgggcctgctggtgggcctgctgctgctgctgctgggcctgggcgcctgctacacctggagaagaagaagagtgtgcaagcagagcatgggcgagaacagcgtggagatggccttccagaaggagaccacccagctgatcgaccccgacgccgccacctgcgagaccagcacctgcgccccccccctgggctag

SEQ ID NO: 3926 - DNA, 693 bp, Artificial Sequence
  Description of Artificial Sequence: Synthetic coding sequence
atgtgcgtgacctaccacaacggcaccggctactgcaagtgccccgagggcttcctgggcgagtactgccagcacagagacccctgcgagaagaacagatgccagaacggcggcacctgcgtggcccaggccatgctgggcaaggccacctgcagatgcgccagcggcttcaccggcgaggactgccagtacagcaccagccacccctgcttcgtgagcagaccctgcctgaacggcggcacctgccacatgctgagcagagacacctacgagtgcacctgccaggtgggcttcaccggcaaggagtgccagtggaccgacgcctgcctgagccacccctgcgccaacggcagcacctgcaccaccgtggccaaccagttcagctgcaagtgcctgaccggcttcaccggccagaagtgcgagaccgacgtgaacgagtgcgacatccccggccactgccagcacggcggcacctgcctgaacctgcccggcagctaccagtgccagtgcctgcagggcttcaccggccagtactgcgacagcctgtacgtgccctgcgcccccagcccctgcgtgaacggcggcacctgcagacagaccggcgacttcaccttcgagtgcaactgcctgcccgccacctggcccatcttccccaagctgctgagcctgcaggagaaggagagctactgctag

SEQ ID NO: 3927 - DNA, 660 bp, Artificial Sequence
  Description of Artificial Sequence: Synthetic coding sequence
atgttcgtgagctacctgatcctgaccctgctgcacgtgcagaccgccgtgctggccagacccggcggcgagagcatcggctgcgacgactacctgggcagcgacaaggtggtggacaagtgcggcgtgtgcggcggcgacaacaccggctgccaggtggtgagcggcgtgttcaagcacgccctgaccagcctgggctaccacagagtggtggagatccccgagggcgccaccaagatcaacatcaccgagatgtacaagagcaacaagaagaagagccacctgaagcccgccaccagaggcagccagttcagcagcgtgaaggtgtgcagcgtgcccgccgcctgcaagctgctgggcacccccggcagagccagacagcccgtgcccgcccccagagagctggagcacgacaagaacagcccccactgcgcctacctgagcctgtacctgaccagcctggcccagagcagctggagagtgttcagcctgttcagctacgtgctgatctacctgttcagcaagtacctggccttcaacaccctgttcgccctgaagagaatggccctgcagagagacagaaaggagaagaccagagcctggtgcatcttcatcaagctgtgcggcagagagatccagatcctgcccggccccgtgtag

SEQ ID NO: 3928 - DNA, 363 bp, Artificial Sequence
  Description of Artificial Sequence: Synthetic coding sequence
atggacaacgtgcagcccaagatcaagcacagacccttctgcttcagcgtgaagggccacgtgaagatgctgagactggccctgaccgtgaccagcatgaccttcttcatcatcgcccaggcccccgagccctacatcgtgatcaccggcttcgaggtgaccgtgatcctgttcttcatcctgctgtacgtgctgagactggacagactgatgaagtggctgttctggcccctgctggtgttcgccctggtgaccgccgtgtgctgcctggccgacggcgccctgatctacagaaagctgctgttcaaccccagcggcccctaccagaagaagcccgtgcacgagaagaaggaggtgctgtag

SEQ ID NO: 3929 - DNA, 864 bp, Artificial Sequence
  Description of Artificial Sequence: Synthetic coding sequence
atggccccctggagccaccccagcgcccagctgcagcccgtgggcggcgacgccgtgagccccgccctgatggtgctgctgtgcctgggcaacctgagcaaggccaccctgtgggccgagcccggcagcgtgatcagcagaggcaacagcgtgaccatcagatgccagggcaccctggaggcccaggagtacagactggtgaaggagggcagccccgagccctgggacacccagaaccccctggagcccaagaacaaggccagattcagcatccccagcatgaccgagcaccacgccggcagatacagatgctactactacagccccgccggctggagcgagcccagcgaccccctggagctggtggtgaccggcttctacaacaagcccaccctgagcgccctgcccagccccgtggtgaccagcggcgagaacgtgaccctgcagtgcggcagcagactgagattcgacagattcatcctgaccgaggagggcgaccacaagctgagctggaccctggacagccagctgacccccagcggccagttccaggccctgttccccgtgggccccgtgacccccagccacagatggatgctgagatgctacggcagcagaagacacatcctgcaggtgtggagcgagcccagcgacctgctggagatccccgtgagcggcgccgccgacaacctgagccccagccagaacaagagcgacagcggcaccgccagccacctgcaggactacgccgtggagaacctgatcagaatgggcatggccggcctgatcctggtggtgctgggcatcctgatcttccaggactggcacagccagagaagcccccaggccgccgccggcagatag

SEQ ID NO: 3930 - DNA, 438 bp, Artificial Sequence; identical to SEQ ID NO: 3551
  Description of Artificial Sequence: Synthetic coding sequence

SEQ ID NO: 3931 - DNA, 1776 bp, Artificial Sequence
  Description of Artificial Sequence: Synthetic coding sequence
atgcagcaggacggcctgggcgtgggcaccagaaacggcagcggcaagggcagaagcgtgcaccccagctggccctggtgcgcccccagacccctgagatacttcggcagagacgccagagccagaagagcccagaccgccgccatggccctggccatccaggtgaccgtgagcaacccctaccacgtggtgatcctgttccagcccgtgaccctgccctgcacctaccagatgaccagcacccccacccagcccatcgtgatctggaagtacaagagcttctgcagagacagaatcgccgacgccttcagccccgccagcgtggacaaccagctgaacgcccagctggccgccggcaaccccggctacaacccctacgtggagtgccaggacagcgtgagaaccgtgagagtggtggccaccaagcagggcaacgccgtgaccctgggcgactactaccagggcagaagaatcaccatcaccggcaacgccgacctgaccttcgaccagaccgcctggggcgacagcggcgtgtactactgcagcgtggtgagcgcccaggacctgcagggcaacaacgaggcctacgccgagctgatcgtgctgggcagaaccagcggcgtggccgagctgctgcccggcttccaggccggccccatcgaggactggctgttcgtggtggtggtgtgcctggccgccttcctgatcttcctgctgctgggcatctgctggtgccagtgctgcccccacacctgctgctgctacgtgagatgcccctgctgccccgacaagtgctgctgccccgaggccctgtacgccgccggcaaggccgccaccagcggcgtgcccagcatctacgcccccagcacctacgcccacctgagccccgccaagaccccccccccccccgccatgatccccatgggccccgcctacaacggctaccccggcggctaccccggcgacgtggacagaagcagcagcgtgagaagcggctacagaatccaggccagccagcaggacgacagcatgagagtgctgtactacatggagaaggagctggccaacttcgaccccagcagacccggcccccccagcggcagagtggagagagccatgagcgaggtgaccagcctgcacgaggacgactggagaagcagacccagcagaggccccgccctgacccccatcagagacgaggagtggggcggccacagccccagaagccccagaggctgggaccaggagcccgccagagagcaggccggcggcggctggagagccagaagacccagagccagaagcgtggacgccctggacgacctgaccccccccagcaccgccgagagcggcagcagaagccccaccagcaacggcggcagaagcagagcctacatgccccccagaagcagaagcagagacgacctgtacgaccaggacgacagcagagacttccccagaagcagagacccccactacgacgacttcagaagcagagagagaccccccgccgaccccagaagccaccaccacagaaccagagaccccagagacaacggcagcagaagcggcgacctgccctacgacggcagactgctggaggaggccgtgagaaagaagggcagcgaggagagaagaagaccccacaaggaggaggaggaggaggcctactacccccccgccccccccccctacagcgagaccgacagccaggccagcagagagagaagactgaagaagaacctggccctgagcagagagagcctggtggtgtag

SEQ ID NO: 3932 - DNA, 678 bp, Artificial Sequence
  Description of Artificial Sequence: Synthetic coding sequence
atgaacagatgccccagaagatgcagaagccccctgggccaggccgccagaagcctgtaccagctggtgaccggcagcctgagccccgacagcgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 3933 - DNA, 705 bp, Artificial Sequence
  Description of Artificial Sequence: Synthetic coding sequence
atgcccgccagcagccccttcctgctggcccccaagggcccccccggcaacatgggcggccccgtgagagagcccgccctgagcgtggccctgtggctgagctggggcgccgccctgggcgccgtggcctgcgccatggccctgctgacccagcagaccgagctgcagagcctgagaagagaggtgagcagactgcagggcaccggcggccccagccagaacggcgagggctacccctggcagagcctgcccgagcagagcagcgacgccctggaggcctgggagaacggcgagagaagcagaaagagaagagccgtgctgacccagaagcagaagaacgacagcgacgtgaccgaggtgatgtggcagcccgccctgagaagaggcagaggcctgcaggcccagggctacggcgtgagaatccaggacgccggcgtgtacctgctgtacagccaggtgctgttccaggacgtgaccttcaccatgggccaggtggtgagcagagagggccagggcagacaggagaccctgttcagatgcatcagaagcatgcccagccaccccgacagagcctacaacagctgctacagcgccggcgtgttccacctgcaccagggcgacatcctgagcgtgatcatccccagagccagagccaagctgaacctgagcccccacggcaccttcctgggcttcgtgaagctgtag

SEQ ID NO: 3934 - DNA, 2400 bp, Artificial Sequence
  Description of Artificial Sequence: Synthetic coding sequence
atgaagcccatgctgaaggacttcagcaacctgctgctggtggtgctgtgcgactacgtgctgggcgaggccgagtacctgctgctgagagagcccggccacgtggccctgagcaacgacaccgtgtacgtggacttccagtacttcgacggcgccaacggcaccctgagaaacgtgagcgtgctgctgctggaggccaacaccaaccagaccgtgaccaccaagtacctgctgaccaaccagagccagggcaccctgaagttcgagtgcttctacttcaaggaggccggcgactactggttcaccatgacccccgaggccaccgacaacagcacccccttcccctggtgggagaagagcgccttcctgaaggtggagtggcccgtgttccacgtggacctgaacagaagcgccaaggccgccgagggcaccttccaggtgggcctgttcaccagccagcccctgtgccccttccccgtggacaagcccaacatcgtggtggacgtgatcttcaccaacagcctgcccgaggccagaagaaacagcagacagcccctggagatcagaaccagcaagagaaccgagctggcccagggccagtgggtggagttcggctgcgcccccctgggccccgaggcctacgtgaccgtggtgctgaagctgctgggcagagacagcgtgatcaccagcaccggccccatcgacctggcccagaagttcggctacaagctggtgatggtgcccgagctgacctgcgagagcggcgtggaggtgaccgtgctgccccccccctgcaccttcgtgcagggcgtggtgaccgtgttcaaggaggcccccagataccccggcaagagaaccatccacctggccgagaacagcctgcccctgggcgagagaagaaccatcttcaactgcaccctgttcgacatgggcaagaacaagtactgcttcgacttcggcatcagcagcagaagccacttcagcgccaaggaggagtgcatgctgatccagagaaacaccgccttccagcccagcagccccagccccctgcagccccagggccccgtgaagagcaacaacatcgtgaccgtgaccggcatcagcctgtgcctgttcatcatcatcgccaccgtgctgatcaccctgtggagaagattcggcagacccgccaagtgcagcacccccgccagacacaacagcatccacagccccagcttcagaaagaacagcgacgaggagaacatctgcgagctgagcgagcagagaggcagcttcagcgacggcggcgacggccccaccggcagccccggcgacaccggcatccccctgacctacagaagaagcggccccgtgccccccgaggacgacgccagcggcagcgagagcttccagagcaacgcccagaagatcatcccccccctgttcagctacagactggcccagcagcagctgaaggagatgaagaagaagggcctgaccgagaccaccaaggtgtaccacgtgagccagagccccctgaccgacaccgccatcgacgccgcccccagcgcccccctggacctggagagccccgaggaggccgccgccaacaagttcagaatcaagagccccttccccgagcagcccgccgtgagcgccggcgagagaccccccagcagactggacctgaacgtgacccaggccagctgcgccatcagccccagccagaccctgatcagaaagagccaggccagacacgtgggcagcagaggcggccccagcgagagaagccacgccagaaacgcccacttcagaagaaccgccagcttccacgaggccagacaggccagacccttcagagagagaagcatgagcaccctgacccccagacaggcccccgcctacagcagcagaaccagaacctgcgagcaggccgaggacagattcagaccccagagcagaggcgcccacctgttccccgagaagctggagcacttccaggaggccagcggcaccagaggccccctgaaccccctgcccaagagctacaccctgggccagcccctgagaaagcccgacctgggcgaccaccaggccggcctggtggccggcatcgagagaaccgagccccacagagccagaagaggccccagccccagccacaagagcgtgagcagaaagcagagcagccccatcagccccaaggacaactaccagagagtgagcagcctgagccccagccagtgcagaaaggacaagtgccagagcttccccacccaccccgagttcgccttctacgacaacaccagcttcggcctgaccgaggccgagcagagaatgctggacctgcccggctacttcggcagcaacgaggaggacgagaccaccagcaccctgagcgtggagaagctggtgatctag

SEQ ID NO: 3935 - DNA, 927 bp, Artificial Sequence
  Description of Artificial Sequence: Synthetic coding sequence
atgagactgctgcccgagtggttcctgctgctgttcggcccctggctgctgagaaaggccgtgagcgcccagatccccgagagcggcagaccccagtacctgggcctgagacccgccgccgccggcgccggcgcccccggccagcagctgcccgagcccagaagcagcgacggcctgggcgtgggcagagcctggagctgggcctggcccaccaaccacaccggcgccctggccagagccggcgccgccggcgccctgcccgcccagagaaccaagagaaagcccagcatcaaggccgccagagccaagaagatcttcggctggggcgacttctacttcagagtgcacaccctgaagttcagcctgctggtgaccggcaagatcgtggaccacgtgaacggcaccttcagcgtgtacttcagacacaacagcagcagcctgggcaacctgagcgtgagcatcgtgccccccagcaagagagtggagttcggcggcgtgtggctgcccggccccgtgccccaccccctgcagagcaccctggccctggagggcgtgctgcccggcctgggcccccccctgggcatggccgccgccgccgccggccccggcctgggcggcagcctgggcggcgccctggccggccccctgggcggcgccctgggcgtgcccggcgccaaggagagcagagccttcaactgccacgtggagtacgagaagaccaacagagccagaaagcacagaccctgcctgtacgaccccagccaggtgtgcttcaccgagcacacccagagccaggccgcctggctgtgcgccaagcccttcaaggtgatctgcatcttcgtgagcttcctgagcttcgactacaagctggtgcagaaggtgtgccccgactacaacttccagagcgagcacccctacttcggctag

SEQ ID NO: 3936 - DNA, 795 bp, Artificial Sequence
  Description of Artificial Sequence: Synthetic coding sequence
atgaagctgggctgcgtgctgatggcctgggccctgtacctgagcctgggcgtgctgtgggtggcccagatgctgctggccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacgactggctgatcctgcagggccccgccaagcccgtgttcgagggcgacctgctggtgctgagatgccaggcctggcaggactggcccctgacccaggtgaccttctacagagacggcagcgccctgggcccccccggccccaacagagagttcagcatcaccgtggtgcagaaggccgacagcggccactaccactgcagcggcatcttccagagccccggccccggcatccccgagaccgccagcgtggtggccatcaccgtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 3937 - DNA, 1362 bp, Artificial Sequence
  Description of Artificial Sequence: Synthetic coding sequence
atgctgagaatcctgtgcctggccctgtgcagcctgctgaccggcaccagagccgaccccggcgccctgctgagactgggcatggacatcatgaaccaggtgcagagcgccatggacgagagccacatcctggagaagatggccgccgaggccggcaagaagcagcccggcatgaagcccatcaagggcatcaccaacctgaaggtgaaggacgtgcagctgcccgtgatcaccctgaacttcgtgcccggcgtgggcatcttccagtgcgtgagcaccggcatgaccgtgaccggcaagagcttcatgggcggcaacatggagatcatcgtggccctgaacatcaccgccaccaacagactgctgagagacgaggagaccggcctgcccgtgttcaagagcgagggctgcgaggtgatcctggtgaacgtgaagaccaacctgcccagcaacatgctgcccaagatggtgaacaagttcctggacagcaccctgcacaaggtgctgcccggcctgatgtgccccgccatcgacgccgtgctggtgtacgtgaacagaaagtggaccaacctgagcgaccccatgcccgtgggccagatgggcaccgtgaagtacgtgctgatgagcgcccccgccaccaccgccagctacatccagctggacttcagccccgtggtgcagcagcagaagggcaagaccatcaagctggccgacgccggcgaggccctgaccttccccgagggctacgccaagggcagcagccagctgctgctgcccgccaccttcctgagcgccgagctggccctgctgcagaagagcttccacgtgaacatccaggacaccatgatcggcgagctgcccccccagaccaccaagaccctggccagattcatccccgaggtggccgtggcctaccccaagagcaagcccctgaccacccagatcaagatcaagaagccccccaaggtgaccatgaagaccggcaagagcctgctgcacctgcacagcaccctggagatgttcgccgccagatggagaagcaaggcccccatgagcctgttcctgctggaggtgcacttcaacctgaaggtgcagtacagcgtgcacgagaaccagctgcagatggccaccagcctggacagactgctgagcctgagcagaaagagcagcagcatcggcaacttcaacgagagagagctgaccggcttcatcaccagctacctggaggaggcctacatccccgtggtgaacgacgtgctgcaggtgggcctgcccctgcccgacttcctggccatgaactacaacctggccgagctggacatcgtggagaacgccctgatgctggacctgaagctgggctag

SEQ ID NO: 3938 - DNA, 1323 bp, Artificial Sequence
  Description of Artificial Sequence: Synthetic coding sequence
atgagcgccagaggcagatgggagggcggcggcagaagagcctgcagaggcagcctgggcctggccagagcccagggcgccgagagagtgaccagcagcgagcagagacccgccatggccagcctgggcctgctgctgctgctgctgctgaccgccctgccccccctgtggagcagcagcctgcccggcctggacaccgccgagagcaaggccaccatcgccgacctgatcctgagcgccctggagagagccaccgtgttcctggagcagagactgcccgagatcaacctggacggcatggtgggcgtgagagtgctggaggagcagctgaagagcgtgagagagaagtgggcccaggagcccctgctgcagcccctgagcctgagagtgggcatgctgggcgagaagctggaggccgccatccagagaagcctgcactacctgaagctgagcgaccccaagtacctgagagagttccagctgaccctgcagcccggcttctggaagctgccccacgcctggatccacaccgacgccagcctggtgtaccccaccttcggcccccaggacagcttcagcgaggagagaagcgacgtgtgcctggtgcagctgctgggcaccggcaccgacagcagcgagccctgcggcctgagcgacctgtgcagaagcctgatgaccaagcccggctgcagcggctactgcctgagccaccagctgctgttcttcctgtgggccagaatgagaggctgcacccagggccccctgcagcagagccaggactacatcaacctgttctgcgccaacatgatggacctgaacagaagagccgaggccatcggctacgcctaccccaccagagacatcttcatggagaacatcatgttctgcggcatgggcggcttcagcgacttctacaagctgagatggctggaggccatcctgagctggcagaagcagcaggagggctgcttcggcgagcccgacgccgaggacgaggagctgagcaaggccatccagtaccagcagcacttcagcagaagagtgaagagaagagagaagcagttccccgacagcagaagcgtggcccaggccggcgtgcagtggagaaacctgggcagcctgcagcccctgccccccggcttcaagcagttcagctgcctgatcctgcccagcagctgggactacagaagcgtgcccccctacctggccaacttctacatcttcctggtggagaccggcttccaccacgtggcccacgccggcctggagctgctgatcagcagagacccccccaccagcggcagccagagcgtgggcctgtag

SEQ ID NO: 3939 - DNA, 708 bp, Artificial Sequence
  Description of Artificial Sequence: Synthetic coding sequence
atgaagtacgtgttctacctgggcgtgctggccggcaccttcttcttcgccgacagcagcgtgcagaaggaggaccccgccccctacctggtgtacctgaagagccacttcaacccctgcgtgggcgtgctgatcaagcccagctgggtgctggcccccgcccactgctacctgcccaacctgaaggtgatgctgggcaacttcaagagcagagtgagagacggcaccgagcagaccatcaaccccatccagatcgtgagatactggaactacagccacagcgccccccaggacgacctgatgctgatcaagctggccaagcccgccatgctgaaccccaaggtgcagcccctgaccctggccaccaccaacgtgagacccggcaccgtgtgcctgctgagcggcctggactggagccaggagaacagcggcagacaccccgacctgagacagaacctggaggcccccgtgatgagcgacagagagtgccagaagaccgagcagggcaagagccacagaaacagcctgtgcgtgaagttcgtgaaggtgttcagcagaatcttcggcgaggtggccgtggccaccgtgatctgcaaggacaagctgcagggcatcgaggtgggccacttcatgggcggcgacgtgggcatctacaccaacgtgtacaagtacgtgagctggatcgagaacaccgccaaggacaagtag

SEQ ID NO: 3940 - DNA, 426 bp, Artificial Sequence
  Description of Artificial Sequence: Synthetic coding sequence
atgctgaagaagatcagcgtgggcgtggccggcgacctgaacaccgtgaccatgaagctgggctgcgtgctgatggcctgggccctgtacctgagcctgggcgtgctgtgggtggcccagatgctgctgggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 3941 - DNA, 2886 bp, Artificial Sequence
  Description of Artificial Sequence: Synthetic coding sequence
atgctggcccccagaggcgccgccgtgctgctgctgcacctggtgctgcagagatggctggccgccggcgcccaggccaccccccaggtgttcgacctgctgcccagcagcagccagagactgaaccccggcgccctgctgcccgtgctgaccgaccccgccctgaacgacctgtacgtgatcagcaccttcaagctgcagaccaagagcagcgccaccatcttcggcctgtacagcagcaccgacaacagcaagtacttcgagttcaccgtgatgggcagactgaacaaggccatcctgagatacctgaagaacgacggcaaggtgcacctggtggtgttcaacaacctgcagctggccgacggcagaagacacagaatcctgctgagactgagcaacctgcagagaggcgccggcagcctggagctgtacctggactgcatccaggtggacagcgtgcacaacctgcccagagccttcgccggccccagccagaagcccgagaccatcgagctgagaaccttccagagaaagccccaggacttcctggaggagctgaagctggtggtgagaggcagcctgttccaggtggccagcctgcaggactgcttcctgcagcagagcgagcccctggccgccaccggcaccggcgacttcaacagacagttcctgggccagatgacccagctgaaccagctgctgggcgaggtgaaggacctgctgagacagcaggtgaaggagaccagcttcctgagaaacaccatcgccgagtgccaggcctgcggccccctgaagttccagagccccacccccagcaccgtggtgccccccgccccccccgccccccccaccagaccccccagaagatgcgacagcaacccctgcttcagaggcgtgcagtgcaccgacagcagagacggcttccagtgcggcccctgccccgagggctacaccggcaacggcatcacctgcatcgacgtggacgagtgcaagtaccacccctgctaccccggcgtgcactgcatcaacctgagccccggcttcagatgcgacgcctgccccgtgggcttcaccggccccatggtgcagggcgtgggcatcagcttcgccaagagcaacaagcaggtgtgcaccgacatcgacgagtgcagaaacggcgcctgcgtgcccaacagcatctgcgtgaacaccctgggcagctacagatgcggcccctgcaagcccggctacaccggcgaccagatcagaggctgcaaggccgagagaaactgcagaaaccccgagctgaacccctgcagcgtgaacgcccagtgcatcgaggagagacagggcgacgtgacctgcgtgtgcggcgtgggctgggccggcgacggctacatctgcggcaaggacgtggacatcgacagctaccccgacgaggagctgccctgcagcgccagaaactgcaagaaggacaactgcaagtacgtgcccaacagcggccaggaggacgccgacagagacggcatcggcgacgcctgcgacgaggacgccgacggcgacggcatcctgaacgagcaggacaactgcgtgctgatccacaacgtggaccagagaaacagcgacaaggacatcttcggcgacgcctgcgacaactgcctgagcgtgctgaacaacgaccagaaggacaccgacggcgacggcagaggcgacgcctgcgacgacgacatggacggcgacggcatcaagaacatcctggacaactgccccaagttccccaacagagaccagagagacaaggacggcgacggcgtgggcgacgcctgcgacagctgccccgacgtgagcaaccccaaccagagcgacgtggacaacgacctggtgggcgacagctgcgacaccaaccaggacagcgacggcgacggccaccaggacagcaccgacaactgccccaccgtgatcaacagcgcccagctggacaccgacaaggacggcatcggcgacgagtgcgacgacgacgacgacaacgacggcatccccgacctggtgccccccggccccgacaactgcagactggtgcccaaccccgcccaggaggacagcaacagcgacggcgtgggcgacatctgcgagagcgacttcgaccaggaccaggtgatcgacagaatcgacgtgtgccccgagaacgccgaggtgaccctgaccgacttcagagcctaccagaccgtggtgctggaccccgagggcgacgcccagatcgaccccaactgggtggtgctgaaccagggcatggagatcgtgcagaccatgaacagcgaccccggcctggccgtgggctacaccgccttcaacggcgtggacttcgagggcaccttccacgtgaacacccagaccgacgacgactacgccggcttcatcttcggctaccaggacagcagcagcttctacgtggtgatgtggaagcagaccgagcagacctactggcaggccacccccttcagagccgtggccgagcccggcatccagctgaaggccgtgaagagcaagaccggccccggcgagcacctgagaaacagcctgtggcacaccggcgacaccagcgaccaggtgagactgctgtggaaggacagcagaaacgtgggctggaaggacaaggtgagctacagatggttcctgcagcacagaccccaggtgggctacatcagagtgagattctacgagggcagcgagctggtggccgacagcggcgtgaccatcgacaccaccatgagaggcggcagactgggcgtgttctgcttcagccaggagaacatcatctggagcaacctgaagtacagatgcaacgacaccatccccgaggacttccaggagttccagacccagaacttcgacagattcgacaactag

SEQ ID NO: 3942 - DNA, 300 bp, Artificial Sequence
  Description of Artificial Sequence: Synthetic coding sequence
atggacaacgtgcagcccaagatcaagcacagacccttctgcttcagcgtgaagggccacgtgaagatgctgagactggacatcatcaacagcctggtgaccaccgtgttcatgctgatcgtgagcgtgctggccctgatccccgagaccaccaccctgaccgtgggcggcggcgtgttcgccctggtgaccgccgtgtgctgcctggccgacggcgccctgatctacagaaagctgctgttcaaccccagcggcccctaccagaagaagcccgtgcacgagaagaaggaggtgctgtag

SEQ ID NO: 3943 - DNA, 408 bp, Artificial Sequence
  Description of Artificial Sequence: Synthetic coding sequence
atgagcccccacctgaccgccctgctgggcctggtgctgtgcctggcccagaccatccacacccaggagggcgccctgcccagacccagcatcagcgccgagcccggcaccgtgatcagccccggcagccacgtgaccttcatgtgcagaggccccgtgggcgtgcagaccttcagactggagagagaggacagagccaagtacaaggacagctacaacgtgttcagactgggccccagcgagagcgaggccagattccacatcgacagcgtgagcgagggcaacgccggcctgtacagatgcctgtactacaagccccccggctggagcgagcacagcgacttcctggagctgctggtgaagggcaccgtgcccggcaccgaggccagcggcttcgacgccccctag

SEQ ID NO: 3944 - DNA, 231 bp, Artificial Sequence
  Description of Artificial Sequence: Synthetic coding sequence
atgctgccctgcctggccctgctgctgctgatggagctgagcgtgtgcaccgtggccggcgacggcggcgaggagcagaccctgagcaccgaggccgagacctgggagggcgccggccccagcatccagctgcagctgcaggaggtgaagaccggcaaggccagccagttcttcggcctgatgggcaagagagtgggcggcagagaggacgaggcccagggcagcgagtag

SEQ ID NO: 3945 - DNA, 684 bp, Artificial Sequence
  Description of Artificial Sequence: Synthetic coding sequence
atgagaggccagggcagaaaggagagcctgagcgacagcagagacctggacggcagctacgaccagctgaccgacagcgtggacgacgagttcgagctgagcaccgtgtgccacagacccgagggcctggagcagctgcaggagcagaccaagttcaccagaaaggagctgcaggtgctgtacagaggcttcaagaaccccggcgccctgagcttccaggagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 3946 - DNA, 876 bp, Artificial Sequence
  Description of Artificial Sequence: Synthetic coding sequence
atgatgagcgccaccggccccggcagaaagatgggcagcagaggccagggcctgctgctggcctactgcctgctgctggccttcgccagcggcctggtgctgagcagagtgccccacgtgcagggcgagcagcaggagtgggagggcaccgaggagctgcccagcccccccgaccacgccgagagagccgaggagcagcacgagaagtacagacccagccaggaccagggcctgcccgccagcagatgcctgagatgctgcgaccccggcaccagcatgtaccccgccaccgccgtgccccagatcaacatcaccatcctgaagggcgagaagggcgacagaggcgacagaggcctgcagggcaagtacggcaagaccggcagcgccggcgccagaggccacaccggccccaagggccagaagggcagcatgggcgcccccggcgagagatgcaagagccactacgccgccttcagcgtgggcagaaagaagcccatgcacagcaaccactactaccagaccgtgatcttcgacaccgagttcgtgaacctgtacgaccacttcaacatgttcaccggcaagttctactgctacgtgcccggcctgtacttcttcagcctgaacgtgcacacctggaaccagaaggagacctacctgcacatcatgaagaacgaggaggaggtggtgatcctgttcgcccaggtgggcgacagaagcatcatgcagagccagagcctgatgctggagctgagagagcaggaccaggtgtgggtgagactgtacaagggcgagagagagaacgccatcttcagcgaggagctggacacctacatcaccttcagcggctacctggtgaagcacgccaccgagccctag

SEQ ID NO: 3947 - DNA, 213 bp, Artificial Sequence
  Description of Artificial Sequence: Synthetic coding sequence
atggagagaggcgccggcgccaagctgctgcccctgctgctgctgctgagagccaccggcttcacctgcgcccagaccgacggcagaaacggctacaccgccgtgatcgaggtgaccagcggcggcccctggggcgactgggcctggcccgagatgtgccccgacggcttcttcgccagcggcttcagcctgaagctgggcagaatggagtag

SEQ ID NO: 3948 - DNA, 402 bp, Artificial Sequence
  Description of Artificial Sequence: Synthetic coding sequence
atgggcagcagcggcctgctgagcctgctggtgctgttcgtgctgctggccaacgtgcagggccccggcctgaccgactggctgttccccagaagatgccccaagatcagagaggagtgcgagttccaggagagagacgtgtgcaccaaggacagacagtgccaggacaacaagaagtgctgcgtgttcagctgcggcaagaagtgcctggacctgaagcaggacgtgtgcgagatgcccaaggagaccggcccctgcctggcctacttcctgcactggtggtacgacaagaaggacaacacctgcagcatgttcgtgtacggcggctgccagggcaacaacaacaacttccagagcaaggccaactgcctgaacacctgcaagaacaagagattcccctag

SEQ ID NO: 3949 - DNA, 771 bp, Artificial Sequence
  Description of Artificial Sequence: Synthetic coding sequence
atgttccagaccggcggcctgatcgtgttctacggcctgctggcccagaccatggcccagttcggcggcctgcccgtgcccctggaccagaccctgcccctgaacgtgaaccccgccctgcccctgagccccaccggcctggccggcagcctgaccaacgccctgagcaacggcctgctgagcggcggcctgctgggcatcctggagaacctgcccctgctggacatcctgaagcccggcggcggcaccagcggcggcctgctgggcggcctgctgggcaaggtgaccagcgtgatccccggcctgaacaacatcatcgacatcaaggtgaccgacccccagctgctggagctgggcctggtgcagagccccgacggccacagactgtacgtgaccatccccctgggcatcaagctgcaggtgaacacccccctggtgggcgccagcctgctgagactggccgtgaagctggacatcaccgccgagatcctggccgtgagagacaagcaggagagaatccacctggtgctgggcgactgcacccacagccccggcagcctgcagatcagcctgctggacggcctgggccccctgcccatccagggcctgctggacagcctgaccggcatcctgaacaaggtgctgcccgagctggtgcagggcaacgtgtgccccctggtgaacgaggtgctgagaggcctggacatcaccctggtgcacgacatcgtgaacatgctgatccacggcctgcagttcgtgatcaaggtgtag

SEQ ID NO: 3950 - DNA, 1386 bp, Artificial Sequence
  Description of Artificial Sequence: Synthetic coding sequence
atgagcctggacatccagagcctggacatccagtgcgaggagctgagcgacgccagatgggccgagctgctgcccctgctgcagcagtgccaggtggtgagactggacgactgcggcctgaccgaggccagatgcaaggacatcagcagcgccctgagagtgaaccccgccctggccgagctgaacctgagaagcaacgagctgggcgacgtgggcgtgcactgcgtgctgcagggcctgcagacccccagctgcaagatccagaagctgagcctgcagaactgctgcctgaccggcgccggctgcggcgtgctgagcagcaccctgagaaccctgcccaccctgcaggagctgcacctgagcgacaacctgctgggcgacgccggcctgcagctgctgtgcgagggcctgctggacccccagtgcagactggagaagctgcagctggagtactgcagcctgagcgccgccagctgcgagcccctggccagcgtgctgagagccaagcccgacttcaaggagctgaccgtgagcaacaacgacatcaacgaggccggcgtgagagtgctgtgccagggcctgaaggacagcccctgccagctggaggccctgaagctggagagctgcggcgtgaccagcgacaactgcagagacctgtgcggcatcgtggccagcaaggccagcctgagagagctggccctgggcagcaacaagctgggcgacgtgggcatggccgagctgtgccccggcctgctgcaccccagcagcagactgagaaccctgtggatctgggagtgcggcatcaccgccaagggctgcggcgacctgtgcagagtgctgagagccaaggagagcctgaaggagctgagcctggccggcaacgagctgggcgacgagggcgccagactgctgtgcgagaccctgctggagcccggctgccagctggagagcctgtgggtgaagagctgcagcttcaccgccgcctgctgcagccacttcagcagcgtgctggcccagaacagattcctgctggagctgcagatcagcaacaacagactggaggacgccggcgtgagagagctgtgccagggcctgggccagcccggcagcgtgctgagagtgctgtggctggccgactgcgacgtgagcgacagcagctgcagcagcctggccgccaccctgctggccaaccacagcctgagagagctggacctgagcaacaactgcctgggcgacgccggcatcctgcagctggtggagagcgtgagacagcccggctgcctgctggagcagctggtgctgtacgacatctactggagcgaggagatggaggacagactgcaggccctggagaaggacaagcccagcctgagagtgatcagctag

SEQ ID NO: 3951 - DNA, 534 bp, Artificial Sequence
  Description of Artificial Sequence: Synthetic coding sequence
atgagactgctgatcctgacctgcctggtggccgtggccctggccagacccaagctgcccctgagataccccgagagactgcagaaccccagcgagagcagcgagcccatccccctggagagcagagaggagtacatgaacggcatgaacagacagagaaacatcctgagagagaagcagaccgacgagatcaagaactgcgtggtggccgagcccgagaagatggagagcagcatcagcagcagcagcgaggagatgagcctgagcaagtgcgccgagcagttctgcagactgaacgagtacaaccagctgcagctgcagaagatgagcaagcaggagcagatcagaagaatgaacgagaacagccacgtgcaggtgcccttccagcagctgaaccagctggccgcctacccctacgccgtgtggtactacccccagatcatgcagtacgtgcccttcccccccttcagcgacatcagcaaccccaccgcccacgagaactacgagaagaacaacgtgatgctgcagtggtag

SEQ ID NO: 3952 - DNA, 3054 bp, Artificial Sequence
  Description of Artificial Sequence: Synthetic coding sequence
atggacctgatcagaggcgtgctgctgagactgctgctgctggccagcagcctgggccccggcgccgtgagcctgagagccgccatcagaaagcccggcaaggtgggcccccccctggacatcaagctgggcgccctgaactgcaccgccttcagcatccagtggaagatgcccagacaccccggcagccccatcctgggctacaccgtgttctacagcgaggtgggcgccgacaagagcctgcaggagcagctgcacagcgtgcccctgagcagagacatccccaccaccgaggaggtgatcggcgacctgaagcccggcaccgagtacagagtgagcatcgccgcctacagccaggccggcaagggcagactgagcagccccagacacgtgaccaccctgagccaggacagctgcctgccccccgccgccccccagcagccccacgtgatcgtggtgagcgacagcgaggtggccctgagctggaagcccggcgccagcgagggcagcgcccccatccagtactacagcgtggagttcatcagacccgacttcgacaagaagtggaccagcatccacgagagaatccagatggacagcatggtgatcaagggcctggaccccgacaccaactaccagttcgccgtgagagccatgaacagccacggccccagccccagaagctggcccagcgacatcatcagaaccctgtgccccgaggaggccggcagcggcagatacggccccagatacatcaccgacatgggcgccggcgaggacgacgagggcttcgaggacgacctggacctggacatcagcttcgaggaggtgaagcccctgcccgccaccaagggcggcaacaagaagttcctggtggagagcaagaagatgagcatcagcaaccccaagaccatcagcagactgatcccccccaccagcgccagcctgcccgtgaccaccgtggccccccagcccatccccatccagagaaagggcaagaacggcgtggccatcatgagcagactgttcgacatgccctgcgacgagaccctgtgcagcgccgacagcttctgcgtgaacgactacacctggggcggcagcagatgccagtgcaccctgggcaagggcggcgagagctgcagcgaggacatcgtgatccagtacccccagttcttcggccacagctacgtgaccttcgagcccctgaagaacagctaccaggccttccagatcaccctggagttcagagccgaggccgaggacggcctgctgctgtactgcggcgagaacgagcacggcagaggcgacttcatgagcctggccatcatcagaagaagcctgcagttcagattcaactgcggcaccggcgtggccatcatcgtgagcgagaccaagatcaagctgggcggctggcacaccgtgatgctgtacagagacggcctgaacggcctgctgcagctgaacaacggcacccccgtgaccggccagagccagggccagtacagcaagatcaccttcagaacccccctgtacctgggcggcgcccccagcgcctactggctggtgagagccaccggcaccaacagaggcttccagggctgcgtgcagagcctggccgtgaacggcagaagaatcgacatgagaccctggcccctgggcaaggccctgagcggcgccgacgtgggcgagtgcagcagcggcatctgcgacgaggccagctgcatccacggcggcacctgcaccgccatcaaggccgacagctacatctgcctgtgccccctgggcttcaagggcagacactgcgaggacgccttcaccctgaccatcccccagttcagagagagcctgagaagctacgccgccaccccctggcccctggagccccagcactacctgagcttcatggagttcgagatcaccttcagacccgacagcggcgacggcgtgctgctgtacagctacgacaccggcagcaaggacttcctgagcatcaacctggccggcggccacgtggagttcagattcgactgcggcagcggcaccggcgtgctgagaagcgaggaccccctgaccctgggcaactggcacgagctgagagtgagcagaaccgccaagaacggcatcctgcaggtggacaagcagaagatcgtggagggcatggccgagggcggcttcacccagatcaagtgcaacaccgacatcttcatcggcggcgtgcccaactacgacgacgtgaagaagaacagcggcgtgctgaagcccttcagcggcagcatccagaagatcatcctgaacgacagaaccatccacgtgaagcacgacttcaccagcggcgtgaacgtggagaacgccgcccacccctgcgtgagagccccctgcgcccacggcggcagctgcagacccagaaaggagggctacgactgcgactgccccctgggcttcgagggcctgcactgccagaaggagtgcggcaactactgcctgaacaccatcatcgaggccatcgagatcccccagttcatcggcagaagctacctgacctacgacaaccccgacatcctgaagagagtgagcggcagcagaagcaacgtgttcatgagattcaagaccaccgccaaggacggcctgctgctgtggagaggcgacagccccatgagacccaacagcgacttcatcagcctgggcctgagagacggcgccctggtgttcagctacaacctgggcagcggcgtggccagcatcatggtgaacggcagcttcaacgacggcagatggcacagagtgaaggccgtgagagacggccagagcggcaagatcaccgtggacgactacggcgccagaaccggcaagagccccggcatgatgagacagctgaacatcaacggcgccctgtacgtgggcggcatgaaggagatcgccctgcacaccaacagacagtacatgagaggcctggtgggctgcatcagccacttcaccctgagcaccgactaccacatcagcctggtggaggacgccgtggacggcaagaacatcaacacctgcggcgccaagtag

SEQ ID NO: 3953 - DNA, 1893 bp, Artificial Sequence
  Description of Artificial Sequence: Synthetic coding sequence
atgcagcaggacggcctgggcgtgggcaccagaaacggcagcggcaagggcagaagcgtgcaccccagctggccctggtgcgcccccagacccctgagatacttcggcagagacgccagagccagaagagcccagaccgccgccatggccctgctggccggcggcctgagcagaggcctgggcagccaccccgccgccgccggcagagacgccgtggtgttcgtgtggctgctgctgagcacctggtgcaccgcccccgccagagccatccaggtgaccgtgagcaacccctaccacgtggtgatcctgttccagcccgtgaccctgccctgcacctaccagatgaccagcacccccacccagcccatcgtgatctggaagtacaagagcttctgcagagacagaatcgccgacgccttcagccccgccagcgtggacaaccagctgaacgcccagctggccgccggcaaccccggctacaacccctacgtggagtgccaggacagcgtgagaaccgtgagagtggtggccaccaagcagggcaacgccgtgaccctgggcgactactaccagggcagaagaatcaccatcaccggcaacgccgacctgaccttcgaccagaccgcctggggcgacagcggcgtgtactactgcagcgtggtgagcgcccaggacctgcagggcaacaacgaggcctacgccgagctgatcgtgctggactggctgttcgtggtggtggtgtgcctggccgccttcctgatcttcctgctgctgggcatctgctggtgccagtgctgcccccacacctgctgctgctacgtgagatgcccctgctgccccgacaagtgctgctgccccgaggccctgtacgccgccggcaaggccgccaccagcggcgtgcccagcatctacgcccccagcacctacgcccacctgagccccgccaagaccccccccccccccgccatgatccccatgggccccgcctacaacggctaccccggcggctaccccggcgacgtggacagaagcagcagcgccggcggccagggcagctacgtgcccctgctgagagacaccgacagcagcgtggccagcgaggtgagaagcggctacagaatccaggccagccagcaggacgacagcatgagagtgctgtactacatggagaaggagctggccaacttcgaccccagcagacccggcccccccagcggcagagtggagagagccatgagcgaggtgaccagcctgcacgaggacgactggagaagcagacccagcagaggccccgccctgacccccatcagagacgaggagtggggcggccacagccccagaagccccagaggctgggaccaggagcccgccagagagcaggccggcggcggctggagagccagaagacccagagccagaagcgtggacgccctggacgacctgaccccccccagcaccgccgagagcggcagcagaagccccaccagcaacggcggcagaagcagagcctacatgccccccagaagcagaagcagagacgacctgtacgaccaggacgacagcagagacttccccagaagcagagacccccactacgacgacttcagaagcagagagagaccccccgccgaccccagaagccaccaccacagaaccagagaccccagagacaacggcagcagaagcggcgacctgccctacgacggcagactgctggaggaggccgtgagaaagaagggcagcgaggagagaagaagaccccacaaggaggaggaggaggaggcctactacccccccgccccccccccctacagcgagaccgacagccaggccagcagagagagaagactgaagaagaacctggccctgagcagagagagcctggtggtgtag

SEQ ID NO: 3954 - DNA, 750 bp, Artificial Sequence; identical to SEQ ID NO: 3566
  Description of Artificial Sequence: Synthetic coding sequence

SEQ ID NO: 3955 - DNA, 3057 bp, Artificial Sequence; identical to SEQ ID NO: 3590
  Description of Artificial Sequence: Synthetic coding sequence

SEQ ID NO: 3956 - DNA, 1311 bp, Artificial Sequence
  Description of Artificial Sequence: Synthetic coding sequence
atgcagggcacccccggcggcggcaccagacccggccccagccccgtggacagaagaaccctgctggtgttcagcttcatcctggccgccgccctgggccagatgaacttcaccggcgaccaggtgctgagagtgctggccaaggacgagaagcagctgagcctgctgggcgacctggagggcctgaagccccagaaggtggacttctggagaggccccgccagacccagcctgcccgtggacatgagagtgcccttcagcgagctgaaggacatcaaggcctacctggagagccacggcctggcctacagcatcatgatcaaggacatccaggtgctgctggacgaggagagacaggccatggccaagagcagaagactggagagaagcaccaacagcttcagctacagcagctaccacaccctggaggagatctacagctggatcgacaacttcgtgatggagcacagcgacatcgtgagcaagatccagatcggcaacagcttcgagaaccagagcatcctggtgctgaagttcagcaccggcggcagcagacaccccgccatctggatcgacaccggcatccacagcagagagtggatcacccacgccaccggcatctggaccgccaacaagatcgtgagcgactacggcaaggacagagtgctgaccgacatcctgaacgccatggacatcttcatcgagctggtgaccaaccccgacggcttcgccttcacccacagcatgaacagactgtggagaaagaacaagagcatcagacccggcatcttctgcatcggcgtggacctgaacagaaactggaagagcggcttcggcggcaacggcagcaacagcaacccctgcagcgagacctaccacggccccagcccccagagcgagcccgaggtggccgccatcgtgaacttcatcaccgcccacggcaacttcaaggccctgatcagcatccacagctacagccagatgctgatgtacccctacggcagactgctggagcccgtgagcaaccagagagagctgtacgacctggccaaggacgccgtggaggccctgtacaaggtgcacggcatcgagtacatcttcggcagcatcagcaccaccctgtacgtggccagcggcatcaccgtggactgggcctacgacagcggcatcaagtacgccttcagcttcgagctgagagacaccggccagtacggcttcctgctgcccgccacccagatcatccccaccgcccaggagacctggatggccctgagaaccatcatggagcacaccctgaaccacccctactag

SEQ ID NO: 3957 - DNA, 492 bp, Artificial Sequence
  Description of Artificial Sequence: Synthetic coding sequence
atgttccagggcctgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggacagcagcagcagcaaggcccccccccccagcctgcccagccccagcagactgcccggccccagcgacacccccatcctgccccagtag

SEQ ID NO: 3958 - DNA, 213 bp, Artificial Sequence; identical to SEQ ID NO: 3856
  Description of Artificial Sequence: Synthetic coding sequence

SEQ ID NO: 3959 - DNA, 1098 bp, Artificial Sequence
  Description of Artificial Sequence: Synthetic coding sequence
atgtggctgctgctgaccatggccagcctgatcagcgtgctgggcaccacccacggcctgttcggcaagctgcaccccggcagccccgaggtgaccatgaacatcagccagatgatcacctactggggctaccccaacgaggagtacgaggtggtgaccgaggacggctacatcctggaggtgaacagaatcccctacggcaagaagaacagcggcaacaccgacgccggctacgacgtgtggctgggcaacagcagaggcaacacctgggccagaagaaacctgtactacagccccgacagcgtggagttctgggccttcagcttcgacgagatggccaagtacgacctgcccgccaccatcgacttcatcgtgaagaagaccggccagaagcagctgcactacgtgggccacagccagggcaccaccatcggcttcatcgccttcagcaccaaccccagcctggccaagagaatcaagaccttctacgccctggcccccgtggccaccgtgaagtacaccaagagcctgatcaacaagctgagattcgtgccccagagcctgttcaagttcatcttcggcgacaagatcttctacccccacaacttcttcgaccagttcctggccaccgaggtgtgcagcagagagatgctgaacctgctgtgcagcaacgccctgttcatcatctgcggcttcgacagcaagaacttcaacaccagcagactggacgtgtacctgagccacaaccccgccggcaccagcgtgcagaacatgttccactggacccaggccgtgaagagcggcaagttccaggcctacgactggggcagccccgtgcagaacagaatgcactacgaccagagccagcccccctactacaacgtgaccgccatgaacgtgcccatcgccgtgtggaacggcggcaaggacctgctggccgacccccaggacgtgggcctgctgctgcccaagctgcccaacctgatctaccacaaggagatccccttctacaaccacctggacttcatctgggccatggacgccccccaggaggtgtacaacgacatcgtgagcatgatcagcgaggacaagaagtag

SEQ ID NO: 3960 - DNA, 2535 bp, Artificial Sequence
  Description of Artificial Sequence: Synthetic coding sequence
atgggccccggcgcccccttcgccagagtgggctggcccctgcccctgctggtggtgatggccgccggcgtggcccccgtgtgggccagccacagcccccacctgcccagaccccacagcagagtgcccccccaccccagcagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcggcggcagcccccccgccgaccagaccctggtgatcaagaccttcagattcctgagccagaagctgttcatcagcgtgagcgtgctgagcagcctgggcatcgtgctggccgtggtgtgcctgagcttcaacatctacaacagccacgtgagatacatccagaacagccagcccaacctgaacaacctgaccgccgtgggctgcagcctggccctggccgccgtgttccccctgggcctggacggctaccacatcggcagaaaccagttccccttcgtgtgccaggccagactgtggctgctgggcctgggcttcagcctgggctacggcagcatgttcaccaagatctggtgggtgcacaccgtgttcaccaagaaggaggagaagaaggagtggagaaagaccctggagccctggaagctgtacgccaccgtgggcctgctggtgggcatggacgtgctgaccctggccatctggcagatcgtggaccccctgcacagaaccatcgagaccttcgccaaggaggagcccaaggaggacatcgacgtgagcatcctgccccagctggagcactgcagcagcagaaagatgaacacctggctgggcatcttctacggctacaagggcctgctgctgctgctgggcatcttcctggcctacgagaccaagagcgtgagcaccgagaagatcaacgaccacagagccgtgggcatggccatctacaacgtggccgtgctgtgcctgatcaccgcccccgtgaccatgatcctgagcagccagcaggacgccgccttcgccttcgccagcctggccatcgtgttcagcagctacatcaccctggtggtgctgttcgtgcccaagatgagaagactgatcaccagaggcgagtggcagagcgaggcccaggacaccatgaagaccggcagcagcaccaacaacaacgaggaggagaagagcagactgctggagaaggagaacagagagctggagaagatcatcgccgagaaggaggagagagtgagcgagctgagacaccagctgcagagcagacagcagctgagaagcagaagacacccccccaccccccccgagcccagcggcggcctgcccagaggcccccccgagccccccgacagactgagctgcgacggcagcagagtgcacctgctgtacaagtag

SEQ ID NO: 3961 - DNA, 1020 bp, Artificial Sequence
  Description of Artificial Sequence: Synthetic coding sequence
atggtgagcaagagcagatggaagctgctggccatgctggccctggtgctggtggtgatggtgtggtacagcatcagcagagaggacagatacatcgagctgttctacttccccatccccgagaagaaggagccctgcctgcagggcgaggccgagagcaaggccagcaagctgttcggcaagctgagccccctgtgcagctacagcagagaccagcccatcttcctgagactggaggactacttctgggtgaagacccccagcgcctacgagctgccctacggcaccaagggcagcgaggacctgctgctgagagtgctggccatcaccagcagcagcatccccaagaacatccagagcctgagatgcagaagatgcgtggtggtgggcaacggccacagactgagaaacagcagcctgggcgacgccatcaacaagtacgacgtggtgatcagactgaacaacgcccccgtggccggctacgagggcgacgtgggcagcaagaccaccatgagactgttctaccccgagagcgcccacttcgaccccaaggtggagaacaaccccgacaccctgctggtgctggtggccttcaaggccatggacttccactggatcgagaccatcctgagcgacaagaagagagtgagaaagggcttctggaagcagccccccctgatctgggacgtgaaccccaagcagatcagaatcctgaaccccttcttcatggagatcgccgccgacaagctgctgagcctgcccatgcagcagcccagaaagatcaagcagaagcccaccaccggcctgctggccatcaccctggccctgcacctgtgcgacctggtgcacatcgccggcttcggctaccccgacgcctacaacaagaagcagaccatccactactacgagcagatcaccctgaagagcatggccggcagcggccacaacgtgagccaggaggccctggccatcaagagaatgctggagatgggcgccatcaagaacctgaccagcttctag

SEQ ID NO: 3962 - DNA, 1386 bp, Artificial Sequence; identical to SEQ ID NO: 3950
  Description of Artificial Sequence: Synthetic coding sequence

SEQ ID NO: 3963 - DNA, 1695 bp, Artificial Sequence
  Description of Artificial Sequence: Synthetic coding sequence
atggcccccaagaagctgagctgcctgagaagcctgctgctgcccctgagcctgaccctgctgctgccccaggccgacaccagaagcttcgtggtggacagaggccacgacagattcctgctggacggcgcccccttcagatacgtgagcggcagcctgcactacttcagagtgcccagagtgctgtgggccgacagactgctgaagatgagatggagcggcctgaacgccatccagttctacgtgccctggaactaccacgagccccagcccggcgtgtacaacttcaacggcagcagagacctgatcgccttcctgaacgaggccgccctggccaacctgctggtgatcctgagacccggcccctacatctgcgccgagtgggagatgggcggcctgcccagctggctgctgagaaagcccgagatccacctgagaaccagcgaccccgccgacaacatgaccaagatcttcaccctgctgagaaagtacgagccccacggccccctggtgaacagcgagtactacaccggctggctggactactggggccagaaccacagcaccagaagcgtgagcgccgtgaccaagggcctggagaacatgctgaagctgggcgccagcgtgaacatgtacatgttccacggcggcaccaacttcggctactggaacggcgccgacaagaagggcagattcctgcccatcaccaccagctacgactacgacgcccccatcagcgaggccggcgaccccacccccaagctgttcgccctgagagacgtgatcagcaagttccaggaggtgcccctgggccccctgcccccccccagccccaagatgatgctgggccccgtgaccctgcacctggtgggccacctgctggccttcctggacctgctgtgccccagaggccccatccacagcatcctgcccatgaccttcgaggccgtgaagcaggaccacggcttcatgctgtacagaacctacatgacccacaccatcttcgagcccacccccttctgggtgcccaacaacggcgtgcacgacagagcctacgtgatggtggacggcgtgttccagggcgtggtggagagaaacatgagagacaagctgttcctgaccggcaagctgggcagcaagctggacatcctggtggagaacatgggcagactgagcttcggcagcaacagcagcgacttcaagggcctgctgaagccccccatcctgggccagaccatcctgacccagtggatgatgttccccctgaagatcgacaacctggtgaagtggtggttccccctgcagctgcccaagtggccctacccccaggcccccagcggccccaccttctacagcaagaccttccccatcctgggcagcgtgggcgacaccttcctgtacctgcccggctggaccaagggccaggtgtggatcaacggcttcaacctgggcagatactggaccaagcagggcccccagcagaccctgtacgtgcccagattcctgctgttccccagaggcgccctgaacaagatcaccctgctggagctggaggacgtgcccctgcagccccaggtgcagttcctggacaagcccatcctgaacagcaccagcaccctgcacagaacccacatcaacagcctgagcgccgacaccctgagcgccagcgagcccatggagctgagcggccactag

SEQ ID NO: 3964 - DNA, 1317 bp, Artificial Sequence
  Description of Artificial Sequence: Synthetic coding sequence
atgatgtacgcccccgtggagttcagcgaggccgagttcagcagagccgagtaccagagaaagcagcagttctgggacagcgtgagactggccctgttcaccctggccatcgtggccatcatcggcatcgccatcggcatcgtgacccacttcgtggtggaggacgacaagagcttctactacctggccagcttcaaggtgaccaacatcaagtacaaggagaactacggcatcagaagcagcagagagttcatcgagagaagccaccagatcgagagaatgatgagcagaatcttcagacacagcagcgtgggcggcagattcatcaagagccacgtgatcaagctgagccccgacgagcagggcgtggacatcctgatcgtgctgatcttcagataccccagcaccgacagcgccgagcagatcaagaagaagatcgagaaggccctgtaccagagcctgaagaccaagcagctgagcctgaccatcaacaagcccagcttcagactgacccccatcgacagcaagaagatgagaaacctgctgaacagcagatgcggcatcagaatgaccagcagcaacatgcccctgcccgccagcagcagcacccagagaatcgtgcagggcagagagaccgccatggagggcgagtggccctggcaggccagcctgcagctgatcggcagcggccaccagtgcggcgccagcctgatcagcaacacctggctgctgaccgccgcccactgcttctggaagaacaaggaccccacccagtggatcgccaccttcggcgccaccatcaccccccccgccgtgaagagaaacgtgagaaagatcatcctgcacgagaactaccacagagagaccaacgagaacgacatcgccctggtgcagctgagcaccggcgtggagttcagcaacatcgtgcagagagtgtgcctgcccgacagcagcatcaagctgccccccaagaccagcgtgttcgtgaccggcttcggcagcatcgtggacgacggccccatccagaacaccctgagacaggccagagtggagaccatcagcaccgacgtgtgcaacagaaaggacgtgtacgacggcctgatcacccccggcatgctgtgcgccggcttcatggagggcaagatcgacgcctgcaagggcgacagcggcggccccctggtgtacgacaaccacgacatctggtacatcgtgggcatcgtgagctggggccagagctgcgccctgcccaagaagcccggcgtgtacaccagagtgaccaagtacagagactggatcgccagcaagaccggcatgtag

SEQ ID NO: 3965 - DNA, 4392 bp, Artificial Sequence
  Description of Artificial Sequence: Synthetic coding sequence
atggagcccagactgttctgctggaccaccctgttcctgctggccggctggtgcctgcccggcctgccctgccccagcagatgcctgtgcttcaagagcaccgtgagatgcatgcacctgatgctggaccacatcccccaggtgccccagcagaccaccgtgctggacctgagattcaacagaatcagagagatccccggcagcgccttcaagaagctgaagaacctgaacaccctgctgctgaacaacaaccacatcagaaagatcagcagaaacgccttcgagggcctggagaacctgctgtacctgtacctgtacaagaacgagatccacgccctggacaagcagaccttcaagggcctgatcagcctggagcacctgtacatccacttcaaccagctggagatgctgcagcccgagaccttcggcgacctgctgagactggagagactgttcctgcacaacaacaagctgagcaagatccccgccggcagcttcagcaacctggacagcctgaagagactgagactggacagcaacgccctggtgtgcgactgcgacctgatgtggctgggcgagctgctgcagggcttcgcccagcacggccacacccaggccgccgccacctgcgagtaccccagaagactgcacggcagagccgtggccagcgtgaccgtggaggagttcaactgccagagccccagaatcaccttcgagccccaggacgtggaggtgcccagcggcaacaccgtgtacttcacctgcagagccgagggcaaccccaagcccgagatcatctggatccacaacaaccacagcctggacctggaggacgacaccagactgaacgtgttcgacgacggcaccctgatgatcagaaacaccagagagagcgaccagggcgtgtaccagtgcatggccagaaacagcgccggcgaggccaagacccagagcgccatgctgagatacagcagcctgcccgccaagcccagcttcgtgatccagccccaggacaccgaggtgctgatcggcaccagcaccaccctggagtgcatggccaccggccacccccaccccctgatcacctggaccagagacaacggcctggagctggacggcagcagacacgtggccaccagcagcggcctgtacctgcagaacatcacccagagagaccacggcagattcacctgccacgccaacaacagccacggcaccgtgcaggccgccgccaacatcatcgtgcaggcccccccccagttcaccgtgacccccaaggaccaggtggtgctggaggagcacgccgtggagtggctgtgcgaggccgacggcaaccccccccccgtgatcgtgtggaccaagaccggcggccagctgcccgtggagggccagcacaccgtgctgagcagcggcaccctgagaatcgacagagccgcccagcacgaccagggccagtacgagtgccaggccgtgagcagcctgggcgtgaagaaggtgagcgtgcagctgaccgtgaagcccaaggccctggccgtgttcacccagctgccccaggacaccagcgtggaggtgggcaagaacatcaacatcagctgccacgcccagggcgagccccagcccatcatcacctggaacaaggagggcgtgcagatcaccgagagcggcaagttccacgtggacgacgagggcaccctgaccatctacgacgccggcttccccgaccagggcagatacgagtgcgtggccagaaacagcttcggcctggccgtgaccaacatgttcctgaccgtgaccgccatccagggcagacaggccggcgacgacttcgtggagagcagcatcctggacgccgtgcagagagtggacagcgccatcaacagcaccagaagacacctgttcagccagaagccccacaccagcagcgacctgctggcccagttccactaccccagagaccccctgatcgtggagatggccagagccggcgagatcttcgagcacaccctgcagctgatcagagagagagtgaagcagggcctgaccgtggacctggagggcaaggagttcagatacaacgacctggtgagccccagaagcctgagcctgatcgccaacctgagcggctgcaccgccagaagacccctgcccaactgcagcaacagatgcttccacgccaagtacagagcccacgacggcacctgcaacaacctgcagcagcccacctggggcgccgccctgaccgccttcgccagactgctgcagcccgcctacagagacggcatcagagcccccagaggcctgggcctgcccgtgggcagcagacagcccctgcccccccccagactggtggccaccgtgtgggccagagccgccgccgtgacccccgaccacagctacaccagaatgctgatgcactggggctggttcctggagcacgacctggaccacaccgtgcccgccctgagcaccgccagattcagcgacggcagaccctgcagcagcgtgtgcaccaacgaccccccctgcttccccatgaacaccagacacgccgaccccagaggcacccacgccccctgcatgctgttcgccagaagcagccccgcctgcgccagcggcagacccagcgccaccgtggacagcgtgtacgccagagagcagatcaaccagcagaccgcctacatcgacggcagcaacgtgtacggcagcagcgagagagagagccaggccctgagagaccccagcgtgcccagaggcctgctgaagaccggcttcccctggccccccagcggcaagcccctgctgcccttcagcaccggcccccccaccgagtgcgccagacaggagcaggagagcccctgcttcctggccggcgaccacagagccaacgagcacctggccctggccgccatgcacaccctgtggttcagagagcacaacagaatggccaccgagctgagcgccctgaacccccactgggagggcaacaccgtgtaccaggaggccagaaagatcgtgggcgccgagctgcagcacatcacctacagccactggctgcccaaggtgctgggcgaccccggcaccagaatgctgagaggctacagaggctacaaccccaacgtgaacgccggcatcatcaacagcttcgccaccgccgccttcagattcggccacaccctgatcaaccccatcctgtacagactgaacgccaccctgggcgagatcagcgagggccacctgcccttccacaaggccctgttcagccccagcagaatcatcaaggagggcggcatcgaccccgtgctgagaggcctgttcggcgtggccgccaagtggagagcccccagctacctgctgagccccgagctgacccagagactgttcagcgccgcctacagcgccgccgtggacagcgccgccaccatcatccagagaggcagagaccacggcatccccccctacgtggacttcagagtgttctgcaacctgaccagcgtgaagaacttcgaggacctgcagaacgagatcaaggacagcgagatcagacagaagctgagaaagctgtacggcagccccggcgacatcgacctgtggcccgccctgatggtggaggacctgatccccggcaccagagtgggccccaccctgatgtgcctgttcgtgacccagttccagagactgagagacggcgacagattctggtacgagaaccccggcgtgttcacccccgcccagctgacccagctgaagcaggccagcctgagcagagtgctgtgcgacaacggcgacagcatccagcaggtgcaggccgacgtgttcgtgaaggccgagtacccccaggactacctgaactgcagcgagatccccaaggtggacctgagagtgtggcaggactgctgcgccgactgcagaagcagaggccagttcagagccgtgacccaggagagccagaagaagagaagcgcccagtacagctaccccgtggacaaggacatggagctgagccacctgagaagcagacagcaggacaagatctacgtgggcgaggacgccagaaacgtgaccgtgctggccaagaccaagttcagccaggacttcagcaccttcgccgccgagatccaggagaccatcaccgccctgagagagcagatcaacaagctggaggccagactgagacaggccggctgcaccgacgtgagaggcgtgcccagaaaggccgaggagagatggatgaaggaggactgcacccactgcatctgcgagagcggccaggtgacctgcgtggtggagatctgcccccccgccccctgccccagccccgagctggtgaagggcacctgctgccccgtgtgcagagacagaggcatgcccagcgacagccccgagaagagatag

SEQ ID NO: 3966 - DNA, 1206 bp, Artificial Sequence
  Description of Artificial Sequence: Synthetic coding sequence
atgggcctgaaggccctgtgcctgggcctgctgtgcgtgctgttcgtgagccacttctacacccccatgcccgacaacatcgaggagagctggaagatcatggccctggacgccatcgccaagacctgcaccttcaccgccatgtgcttcgagaacatgagaatcatgagatacgaggagttcatcagcatgatcttcagactggactacacccagcccctgagcgacgagtacatcaccgtgaccgacaccaccttcgtggacatccccgtgagactgtacctgcccaagagaaagagcgagaccagaagaagagccgtgatctacttccacggcggcggcttctgcttcggcagcagcaagcagagagccttcgacttcctgaacagatggaccgccaacaccctggacgccgtggtggtgggcgtggactacagactggccccccagcaccacttccccgcccagttcgaggacggcctggccgccgtgaagttcttcctgctggagaagatcctgaccaagtacggcgtggaccccaccagaatctgcatcgccggcgacagcagcggcggcaacctggccaccgccgtgacccagcaggtgcagaacgacgccgagatcaagcacaagatcaagatgcaggtgctgctgtaccccggcctgcagatcaccgacagctacctgcccagccacagagagaacgagcacggcatcgtgctgaccagagacgtggccatcaagctggtgagcctgtacttcaccaaggacgaggccctgccctgggccatgagaagaaaccagcacatgcccctggagagcagacacctgttcaagttcgtgaactggagcatcctgctgcccgagaagtacagaaaggactacgtgtacaccgagcccatcctgggcggcctgagctacagcctgcccggcctgaccgacagcagagccctgcccctgctggccaacgacagccagctgcagaacctgcccctgacctacatcctgacctgccagcacgacctgctgagagacgacggcctgatgtacgtgaccagactgagaaacgtgggcgtgcaggtggtgcacgagcacatcgaggacggcatccacggcgccctgagcttcatgaccagccccttctacctgagactgggcctgagaatcagagacatgtacgtgagctggctggacaagaacctgtag

SEQ ID NO: 3967 - DNA, 264 bp, Artificial Sequence; identical to SEQ ID NO: 3796
  Description of Artificial Sequence: Synthetic coding sequence

SEQ ID NO: 3968 - DNA, 813 bp, Artificial Sequence
  Description of Artificial Sequence: Synthetic coding sequence
atgagaggccagggcagaaaggagagcctgagcgacagcagagacctggacggcagctacgaccagctgaccggccacccccccggccccaccaagaaggccctgaagcagagattcctgaagctgctgccctgctgcggcccccaggccctgcccagcgtgagcgagaccctggccgcccccgccagcctgagaccccacagacccagactgctggaccccgacagcgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 3969 - DNA, 819 bp, Artificial Sequence
  Description of Artificial Sequence: Synthetic coding sequence
atgcacctgagactgatcagctggctgttcatcatcctgaacttcatggagtacatcggcagccagaacgccagcagaggcagaagacagagaagaatgcaccccaacgtgagccagggctgccagggcggctgcgccacctgcagcgactacaacggctgcctgagctgcaagcccagactgttcttcgccctggagagaatcggcatgaagcagatcggcgtgtgcctgagcagctgccccagcggctactacggcaccagataccccgacatcaacaagtgcaccaagtgcaaggccgactgcgacacctgcttcaacaagaacttctgcaccaagtgcaagagcggcttctacctgcacctgggcaagtgcctggacaactgccccgagggcctggaggccaacaaccacaccatggagtgcgtgagcatcgtgcactgcgaggtgagcgagtggaacccctggagcccctgcaccaagaagggcaagacctgcggcttcaagagaggcaccgagaccagagtgagagagatcatccagcaccccagcgccaagggcaacctgtgcccccccaccaacgagaccagaaagtgcaccgtgcagagaaagaagtgccagaagggcgagagaggcaagaagggcagagagagaaagagaaagaagcccaacaagggcgagagcaaggaggccatccccgacagcaagagcctggagagcagcaaggagatccccgagcagagagagaacaagcagcagcagaagaagagaaaggtgcaggacaagcagaagagcgtgagcgtgagcaccgtgcactag

SEQ ID NO: 3970 - DNA, 294 bp, Artificial Sequence
  Description of Artificial Sequence: Synthetic coding sequence
atggccaagagcttccccgtgttcagcctgctgagcttcatcctgatccacctggtgctgagcagcgtgagcggccccagacactggtggccccccagaggcatcatcaaggtgaagtgcccctacgagaaggtgaacctgagctggtacaacggcaccgtgaacccctgccccggcctgtaccagcccatctgcggcaccaacttcatcacctacgacaacccctgcatcctgtgcgtggagagcctgaagagccacggcagaatcagattctaccacgacggcaagtgctag

SEQ ID NO: 3971 - DNA, 726 bp, Artificial Sequence; identical to SEQ ID NO: 3658
  Description of Artificial Sequence: Synthetic coding sequence

SEQ ID NO: 3972 - DNA, 1827 bp, Artificial Sequence
  Description of Artificial Sequence: Synthetic coding sequence
atggccagagccagagccggcgccctgctggccctgtgggtgctgggcgccgccgcccacccccagtgcctggacttcagaccccccttcagacccacccagcccctgagactgtgcgcccagtacagcgacttcggctgctgcgacgagggcagagacgccgagctgaccagaagattctgggccctggccagcagagtggacgccgccgagtgggccgcctgcgccggctacgccagagacctgctgtgccaggagtgcagcccctacgccgcccacctgtacgacgccgaggaccccttcacccccctgagaaccgtgcccggcctgtgccaggactactgcctggacatgtggcacaagtgcagaggcctgttcagacacctgagcaccgaccaggagctgtgggccctggagggcaacctggccagattctgcagatacctgagcctggacgacaccgactactgcttcccctacctgctggtgaacaagaacctgaacagcaacctgggccacgtggtggccgacgccaagggctgcctgcagctgtgcctggaggaggtggccaacggcctgagaaaccccgtggccatggtgcacgccagagacggcacccacagattcttcgtggccgagcaggtgggcctggtgtgggcctacctgcccgacagaagcagactgggcaagcccttcctgaacatcagcagagtggtgctgaccagcccctgggagggcgacgagagaggcttcctgggcatcgccttccaccccagcttccagcacaacagaagactgtacgtgtactacagcgtgggcatcagaagcagcgagtggatcagaatcagcgagttcagagtgagcgaggacgacgagaacgccgtggaccacagcagcgagagaatcatcctggaggtgaaggagcccgccagcaaccacaacggcggccagctgctgttcggcgacgacggctacctgtacatcttcaccggcgacggcggcatggccggcgaccccttcggcaccttcggcaacgcccagaacaagagcgccctgctgggcaaggtgctgagaatcgacgtggacagaaaggagagaggcctgccctacggcatcccccccgacaaccccttcgtgggcgaccccgccgcccagcccgaggtgtacgccctgggcgtgagaaacatgtggagatgcagcttcgacagaggcgaccccagcagcggcaccggcagaggcagactgttctgcggcgacgtgggccagaacaagttcgaggaggtggacgtggtggagagaggcggcaactacggctggagagccagagagggcttcgagtgctacgacagaagcctgtgcgccaacaccagcctgaacgacctgctgcccatcttcgcctacccccacaccgtgggcaagagcgtgaccggcggctacgtgtacagaggctgcgagtaccccaacctgaacggcctgtacatcttcggcgacttcatgagcggcagactgatgagcctgcaggagaaccccggcaccggccagtggcagtacagcgagatctgcatgggccacggccagacctgcgagttccccggcctgatcaacaactactacccctacatcatcagcttcggcgaggacgaggccggcgagctgtacttcatgagcaccggcgagcccagcgccaccgcccccagaggcgtggtgtacaagatcatcgacgccagcagctgcaaggccagaagcgccatgcccggctacgtgcccgcccccagcgtgtgcagcagcctgaccagccagcccttcatcctgcagtggtggaagtag

SEQ ID NO: 3973 - DNA, 351 bp, Artificial Sequence
  Description of Artificial Sequence: Synthetic coding sequence
atggccccccccagcgtgcccctggtgctgctgctggtgctgctgctgagcctggccgagacccccgccagcgcccccgcccacagaggcagaggcggctggaccctgaacagcgccggctacctgctgggccccgtgctgcacctgccccagatgggcgaccaggacggcaagagagagaccgccctggagatcctggacctgtggaaggccatcgacggcctgccctacagccaccccccccagcccagcaagagaaacgtgatggagaccttcgccaagcccgagatcggcgacctgggcatgctgagcatgaagatccccaaggaggaggacgtgctgaagagctag

SEQ ID NO: 3974 - DNA, 3618 bp, Artificial Sequence
  Description of Artificial Sequence: Synthetic coding sequence
atgagaaagcccagaagaaagagcagacagaacgccgagggcagaagaagccccagcccctacagcctgaagtgcagccccaccagagagaccctgacctacgcccaggcccagagaatcgtggaggtggacatcgacggcagactgcacagaatcagcatctacgaccccctgaagatcatcaccgaggacgagctgaccgcccaggacatcaccgagtgcaacagcaacaaggagaacagcgagcagccccagttccccggcaagagcaagaagcccagcagcaagggcaagaagaaggagagctgcagcaagcacgccagcggcaccagcttccacctgccccagcccagcttcagaatggtggacagcggcatccagcccgaggccccccccctgcccgccgcctactacagatacatcgagaagccccccgaggacctggacgccgaggtggagtacgacatggacgaggaggacctggcctggctggacatggtgaacgagaagagaagagtggacggccacagcctggtgagcgccgacaccttcgagctgctggtggacagactggagaaggagagctacctggagagcagaagcagcggcgcccagcagagcctgatcgacgaggacgccttctgctgcgtgtgcctggacgacgagtgccacaacagcaacgtgatcctgttctgcgacatctgcaacctggccgtgcaccaggagtgctacggcgtgccctacatccccgagggccagtggctgtgcagatgctgcctgcagagccccagcagacccgtggactgcatcctgtgccccaacaagggcggcgccttcaagcagaccagcgacggccactgggcccacgtggtgtgcgccatctggatccccgaggtgtgcttcgccaacaccgtgttcctggagcccatcgagggcatcgacaacatcccccccgccagatggaagctgacctgctacatctgcaagcagaagggcctgggcgccgccatccagtgccacaaggtgaactgctacaccgccttccacgtgacctgcgcccagagagccggcctgttcatgaagatcgagcccatgagagagaccagcctgaacggcaccatcttcaccgtgagaaagaccgcctactgcgaggcccacagcccccccggcgccgccaccgccagaagaaagggcgacagccccagaagcatcagcgagaccggcgacgaggagggcctgaaggagggcgacggcgaggaggaggaggaggaggaggtggaggaggaggagcaggaggcccagggcggcgtgagcggcagcctgaagggcgtgcccaagaagagcaagatgagcctgaagcagaagatcaagaaggagcccgaggaggccggccaggacacccccagcaccctgcccatgctggccgtgccccagatccccagctacagactgaacaagatctgcagcggcctgagcttccagagaaagaaccagttcatgcagagactgcacaactactggctgctgaagagacaggccagaaacggcgtgcccctgatcagaagactgcacagccacctgcagagccagagaaacgccgagcagagagagcaggacgagaagaccagcgccgtgaaggaggagctgaagtactggcagaagctgagacacgacctggagagagccagactgctgatcgagctgatcagaaagagagagaagctgaagagagagcaggtgaaggtgcagcaggccgccatggagctggagctgatgcccttcaacgtgctgctgagaaccaccctggacctgctgcaggagaaggaccccgcccacatcttcgccgagcccgtgaacctgagcgaggtgcccgactacctggagttcatcagcaagcccatggacttcagcaccatgagaagaaagctggagagccacctgtacagaaccctggaggagttcgaggaggacttcaacctgatcgtgaccaactgcatgaagtacaacgccaaggacaccatcttccacagagccgccgtgagactgagagacctgggcggcgccatcctgagacacgccagaagacaggccgagaacatcggctacgaccccgagagaggcacccacctgcccgagagccccaagctggaggacttctacagattcagctgggaggacgtggacaacatcctgatccccgagaacagagcccacctgagccccgaggtgcagctgaaggagctgctggagaagctggacctggtgagcgccatgagaagcagcggcgccagaaccagaagagtgagactgctgagaagagagatcaacgccctgagacagaagctggcccagcccccccccccccagccccccagcctgaacaagaccgtgagcaacggcgagctgcccgccggcccccagggcgacgccgccgtgctggagcaggccctgcaggaggagcccgaggacgacggcgacagagacgacagcaagctgccccccccccccaccctggagcccaccggccccgcccccagcctgagcgagcaggagagcccccccgagccccccaccctgaagcccatcaacgacagcaagccccccagcagattcctgaagcccagaaaggtggaggaggacgagctgctggagaagagccccctgcagctgggcaacgagcccctgcagagactgctgagcgacaacggcatcaacagactgagcctgatggcccccgacacccccgccggcacccccctgagcggcgtgggcagaagaaccagcgtgctgttcaagaaggccaagaacggcgtgaagctgcagagaagccccgacagagtgctggagaacggcgaggaccacggcgtggccggcagccccgccagccccgccagcatcgaggaggagagacacagcagaaagagacccagaagcagaagctgcagcgagagcgagggcgagagaagcccccagcaggaggaggagaccggcatgaccaacggcttcggcaagcacaccgagagcggcagcgacagcgagtgcagcctgggcctgagcggcggcctggccttcgaggcctgcagcggcctgaccccccccaagagaagcagaggcaagcccgccctgagcagagtgcccttcctggagggcgtgaacggcgacagcgactacaacggcagcggcagaagcctgctgctgcccttcgaggacagaggcgacctggagcccctggagctggtgtgggccaagtgcagaggctaccccagctaccccgccctgatcatcgaccccaagatgcccagagagggcctgctgcacaacggcgtgcccatccccgtgccccccctggacgtgctgaagctgggcgagcagaagcaggccgaggccggcgagaagctgttcctggtgctgttcttcgacaacaagagaacctggcagtggctgcccagagacaaggtgctgcccctgggcgtggaggacaccgtggacaagctgaagatgctggagggcagaaagaccagcatcagaaagagcgtgcaggtggcctacgacagagccatgatccacctgagcagagtgagaggcccccacagcttcgtgaccagcagctacctgtag

SEQ ID NO: 3975 - DNA, 1977 bp, Artificial Sequence
  Description of Artificial Sequence: Synthetic coding sequence
atgttcgtgagctacctgatcctgaccctgctgcacgtgcagaccgccgtgctggccagacccggcggcgagagcatcggctgcgacgactacctgggcagcgacaaggtggtggacaagtgcggcgtgtgcggcggcgacaacaccggctgccaggtggtgagcggcgtgttcaagcacgccctgaccagcctgggctaccacagagtggtggagatccccgagggcgccaccaagatcaacatcaccgagatgtacaagagcaacaactacctggccctgagaagcagaagcggcagaagcatcatcaacggcaactgggccatcgacagacccggcaagtacgagggcggcggcaccatgttcacctacaagagacccaacgagatcagcagcaccgccggcgagagcttcctggccgagggccccaccaacgagatcctggacgtgtacatgatccaccagcagcccaaccccggcgtgcactacgagtacgtgatcatgggcaccaacgccatcagcccccaggtgcccccccacagaagacccggcgagcccttcaacggccagatggtgaccgagggcagaagccaggaggagggcgagcagaagggcagaaacgaggagaaggaggacctgagaggcgaggcccccgagatgttcaccagcgagagcgcccagaccttccccgtgagacaccccgacagattcagcccccacagacccgacaacctggtgccccccgccccccagccccccagaagaagcagagaccacaactggaagcagctgggcaccaccgagtgcagcaccacctgcggcaagggcagccagtaccccatcttcagatgcgtgcacagaagcacccacgaggaggcccccgagagctactgcgacagcagcatgaagcccacccccgaggaggagccctgcaacatcttcccctgccccgccttctgggacatcggcgagtggagcgagtgcagcaagacctgcggcctgggcatgcagcacagacaggtgctgtgcagacaggtgtacgccaacagaagcctgaccgtgcagccctacagatgccagcacctggagaagcccgagaccaccagcacctgccagctgaagatctgcagcgagtggcagatcagaaccgactggaccagctgcagcgtgccctgcggcgtgggccagagaaccagagacgtgaagtgcgtgagcaacatcggcgacgtggtggacgacgaggagtgcaacatgaagctgagacccaacgacatcgagaactgcgacatgggcccctgcgccaagagctggttcctgaccgagtggagcgagagatgcagcgccgagtgcggcgccggcgtgagaaccagaagcgtggtgtgcatgaccaaccacgtgagcagcctgcccctggagggctgcggcaacaacagacccgccgaggccaccccctgcgacaacggcccctgcaccggcaaggtggagtggttcgccggcagctggagccagtgcagcatcgagtgcggcagcggcacccagcagagagaggtgatctgcgtgagaaagaacgccgacaccttcgaggtgctggaccccagcgagtgcagcttcctggagaagccccccagccagcagagctgccacctgaagccctgcggcgccaagtggttcagcaccgagtggagcatgtgcagcaagagctgccagggcggcttcagagtgagagaggtgagatgcctgagcgacgacatgaccctgagcaacctgtgcgacccccagctgaagcccgaggagagagagagctgcaacccccaggactgcgtgcccgaggtggacgagaactgcaaggacaagtactacaactgcaacgtggtggtgcaggccagactgtgcgtgtacaactactacaagaccgcctgctgcgccagctgcaccagagtggccaacagacagaccggcttcctgggcagcagatag

SEQ ID NO: 3976 - DNA, 708 bp, Artificial Sequence
  Description of Artificial Sequence: Synthetic coding sequence
atgagacccctggccggcggcctgctgaaggtggtgttcgtggtgttcgccagcctgtgcgcctggtacagcggctacctgctggccgagctgatccccgacgcccccctgagcagcgccgcctacagcatcagaagcatcggcgagagacccgtgctgaaggcccccgtgcccaagagacagaagtgcgaccactggaccccctgccccagcgacacctacgcctacagactgctgagcggcggcggcagaagcaagtacgccaagatctgcttcgaggacaacctgctgatgggcgagcagctgggcaacgtggccagaggcatcaacatcgccatcgtgaactacgtgaccggcaacgtgaccgccaccagatgcttcgacatgtacgagggcgacaacagcggccccatgaccaagttcatccagagcgccgcccccaagagcctgctgttcatggtgacctacgacgacggcagcaccagactgaacaacgacgccaagaacgccatcgaggccctgggcagcaaggagatcagaaacatgaagttcagaagcagctgggtgttcatcgccgccaagggcctggagctgcccagcgagatccagagagagaagatcaaccacagcgacgccaagaacaacagatacagcggctggcccgccgagatccagatcgagggctgcatccccaaggagagaagctag

SEQ ID NO: 3977 - DNA, 759 bp, Artificial Sequence
  Description of Artificial Sequence: Synthetic coding sequence
atgagaggccagggcagaaaggagagcctgagcgacagcagagacctggacggcagctacgaccagctgaccggccacccccccggccccaccaagaaggccctgaagcagagattcctgaagctgctgccctgctgcggcccccaggccctgcccagcgtgagcgagaacagcgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 3978 - DNA, 312 bp, Artificial Sequence
  Description of Artificial Sequence: Synthetic coding sequence
atgagcggcagaggcaagggcggcaagggcctgggcaagggcggcgccaagagacacagaaaggtgctgagagacaacatccagggcatcaccaagcccgccatcagaagactggccagaagaggcggcgtgaagagaatcagcggcctgatctacgaggagaccagaggcgtgctgaaggtgttcctggagaacgtgatcagagacgccgtgacctacaccgagcacgccaagagaaagaccgtgaccgccatggacgtggtgtacgccctgaagagacagggcagaaccctgtacggcttcggcggctag

SEQ ID NO: 3979 - DNA, 3120 bp, Artificial Sequence
  Description of Artificial Sequence: Synthetic coding sequence
atggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacagactggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagctacctggacctgaacttcgagatcagcttcggcggcatccccacccccggcagaagcagagccttcagaagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgagaagaggcagcggcagcttcgtgctgttcctgaaggacggcaagctgaagctgagcctgttccagcccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcggctgcctggacaacagcagcggcagcggctgcaagagccccctgggcggcttccagggctgcctgagactgatcaccatcggcgacaaggccgtggaccccatcctggtgcagcagggcgccctgggcagcttcagagacctgcagatcgacagctgcggcatcaccgacagatgcctgcccagctactgcgagcacggcggcgagtgcagccagagctgggacaccttcagctgcgactgcctgggcaccggctacaccggcgagacctgccacagcagcctgtacgagcagagctgcgaggcccacaagcacagaggcaaccccagcggcctgtactacatcgacgccgacggcagcggccccctgggccccttcctggtgtactgcaacatgaccgccgacgccgcctggaccgtggtgcagcacggcggccccgacgccgtgaccctgagaggcgcccccagcggccaccccagaagcgccgtgagcttcgcctacgccgccggcgccggccagctgagaagcgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggcagaaacgagtggaccagcgacaccatcgtgctgagccagaaggagcacctgcccgtgacccagatcgtgatgaccgacgccggcagaccccacagcgaggccgcctacaccctgggccccctgctgtgcagaggcgaccagagcttctggaacagcgccagcttcaacaccgagaccagctacctgcacttccccgccttccacggcgagctgaccgccgacgtgtgcttcttcttcaagaccaccgtgagcagcggcgtgttcatggagaacctgggcatcaccgacttcatcagaatcgagctgagagcccccaccgaggtgaccttcagcttcgacgtgggcaacggcccctgcgaggtgaccgtgcagagccccacccccttcaacgacaaccagtggcaccacgtgagagccgagagaaacgtgaagggcgccagcctgcaggtggaccagctgccccagaagatgcagcccgcccccgccgacggccacgtgagactgcagctgaacagccagctgttcatcggcggcaccgccaccagacagagaggcttcctgggctgcatcagaagcctgcagctgaacggcgtggccctggacctggaggagagagccaccgtgacccccggcgtggagcccggctgcgccggccactgcagcacctacggccacctgtgcagaaacggcggcagatgcagagagaagagaagaggcgtgacctgcgactgcgccttcagcgcctacgacggccccttctgcagcaacgagatcagcgcctacttcgccaccggcagcagcatgacctaccacttccaggagcactacaccctgagcgagaacagcagcagcctggtgagcagcctgcacagagacgtgaccctgaccagagagatgatcaccctgagcttcagaaccaccagaacccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgatcccccagatgcagaagagcaactag

SEQ ID NO: 3980 - DNA, 1257 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttcagagacaagagaagcgccctgcagagcatcaacgagtgggccgcccagaccaccgacggcaagctgcccgaggtgaccaaggacgtggagagaaccgacggcgccctgctggtgaacgccatgttcttcaagccccactgggacgagaagttccaccacaagatggtggacaacagaggcttcatggtgaccagaagctacaccgtgggcgtgatgatgatgcacagaaccggcctgtacaactactacgacgacgagaaggagaagctgcagatcgtggagatgcccctggcccacaagctgagcagcctgatcatcctgatgccccaccacgtggagcccctggagagactggagaagctgctgaccaaggagcagctgaagatctggatgggcaagatgcagaagaaggccgtggccatcagcctgcccaagggcgtggtggaggtgacccacgacctgcagaagcacctggccggcctgggcctgaccgaggccatcgacaagaacaaggccgacctgagcagaatgagcggcaagaaggacctgtacctggccagcgtgttccacgccaccgccttcgagctggacaccgacggcaaccccttcgaccaggacatctacggcagagaggagctgagaagccccaagctgttctacgccgaccaccccttcatcttcctggtgagagacacccagagcggcagcctgctgttcatcggcagactggtgagacccaagggcgacaagatgagagacgagctgtag

SEQ ID NO: 3981 - DNA, 378 bp, Artificial Sequence
  Description of Artificial Sequence: Synthetic coding sequence
atgcagctgctgaaggccctgtgggccctggccggcgccgccctgtgctgcttcctggtgctggtgatccacgcccagttcctgaaggagggccagctggccgccggcacctgcgagatcgtgaccctggacagagacagcagccagcccagaagaaccatcgccagacagaccgccagatgcgcctgcagaaagggccagatcgccggcaccaccagagccagacccgcctgcgtggacgccagaatcatcaagaccaagcagtggtgcgacatgctgccctgcctggagggcgagggctgcgacctgctgatcaacagaagcggctggacctgcacccagcccggcggcagaatcaagaccaccaccgtgagctag

SEQ ID NO: 3982 - DNA, 5859 bp, Artificial Sequence
  Description of Artificial Sequence: Synthetic coding sequence
atgcccgccctgggccccgccctgctgcaggccctgtgggccggctgggtgctgaccctgcagcccctgccccccaccgccttcacccccaacggcacctacctgcagcacctggccagagaccccaccagcggcaccctgtacctgggcgccaccaacttcctgttccagctgagccccggcctgcagctggaggccaccgtgagcaccggccccgtgctggacagcagagactgcctgccccccgtgatgcccgacgagtgcccccaggcccagcccaccaacaaccccaaccagctgctgctggtgagccccggcgccctggtggtgtgcggcagcgtgcaccagggcgtgtgcgagcagagaagactgggccagctggagcagctgctgctgagacccgagagacccggcgacacccagtacgtggccgccaacgaccccgccgtgagcaccgtgggcctggtggcccagggcctggccggcgagcccctgctgttcgtgggcagaggctacaccagcagaggcgtgggcggcggcatcccccccatcaccaccagagccctgtggccccccgacccccaggccgccttcagctacgaggagaccgccaagctggccgtgggcagactgagcgagtacagccaccacttcgtgagcgccttcgccagaggcgccagcgcctacttcctgttcctgagaagagacctgcaggcccagagcagagccttcagagcctacgtgagcagagtgtgcctgagagaccagcactactacagctacgtggagctgcccctggcctgcgagggcggcagatacggcctgatccaggccgccgccgtggccaccagcagagaggtggcccacggcgaggtgctgttcgccgccttcagcagcgccgccccccccaccgtgggcagaccccccagcgccgccgccggcgccagcggcgccagcgccctgtgcgccttccccctggacgaggtggacagactggccaacagaaccagagacgcctgctacaccagagagggcagagccgaggacggcaccgaggtggcctacatcgagtacgacgtgaacagcgactgcgcccagctgcccgtggacaccctggacgcctacccctgcggcagcgaccacacccccagccccatggccagcagagtgcccctggaggccacccccatcctggagtggcccggcatccagctgaccgccgtggccgtgaccatggaggacggccacaccatcgccttcctgggcgacagccagggccagctgcacagagtgtacctgggccccggcagcgacggccacccctacagcacccagagcatccagcagggcagcgccgtgagcagagacctgaccttcgacggcaccttcgagcacctgtacgtgatgacccagagcaccctgctgaaggtgcccgtggccagctgcgcccagcacctggactgcgccagctgcctggcccacagagacccctactgcggctggtgcgtgctgctgggcagatgcagcagaagaagcgagtgcagcagaggccagggccccgagcagtggctgtggagcttccagcccgagctgggctgcctgcaggtggccgccatgagccccgccaacatcagcagagaggagaccagagaggtgttcctgagcgtgcccgacctgccccccctgtggcccggcgagagctacagctgccacttcggcgagcaccagagccccgccctgctgaccggcagcggcgtgatgtgccccagccccgaccccagcgaggcccccgtgctgcccagaggcgccgactacgtgagcgtgagcgtggagctgagattcggcgccgtggtgatcgccaagaccagcctgagcttctacgactgcgtggccgtgaccgagctgagacccagcgcccagtgccaggcctgcgtgagcagcagatggggctgcaactggtgcgtgtggcagcacctgtgcacccacaaggccagctgcgacgccggccccatggtggccagccaccagagccccctggtgagccccgacccccccgccagaggcgacggcgacagcgccgagctggagggcccccccgcccccctgatcctgcccagcagcctggactaccagtacgacacccccggcctgtgggagctggaggaggccaccctgggcgccagcagctgcccctgcgtggagagcgtgcagggcagcaccctgatgcccgtgcacgtggagagagagatcagactgctgggcagaaacctgcacctgttccaggacggccccggcgacaacgagtgcgtgatggagctggagggcctggaggtggtggtggaggccagagtggagtgcgagcccccccccgacacccagtgccacgtgacctgccagcagcaccagctgagctacgaggccctgcagcccgagctgagagtgggcctgttcctgagaagagccggcagactgagagtggacagcgccgagggcctgcacgtggtgctgtacgactgcagcgtgggccacggcgactgcagcagatgccagaccgccatgccccagtacggctgcgtgtggtgcgagggcgagagacccagatgcgtgaccagagaggcctgcggcgaggccgaggccgtggccacccagtgccccgcccccctgatccacagcgtggagcccctgaccggccccgtggacggcggcaccagagtgaccatcagaggcagcaacctgggccagcacgtgcaggacgtgctgggcatggtgaccgtggccggcgtgccctgcgccgtggacgcccaggagtacgaggtgagcagcagcctggtgtgcatcaccggcgccagcggcgaggaggtggccggcgccaccgccgtggaggtgcccggcagaggcagaggcgtgagcgagcacgacttcgcctaccaggaccccaaggtgcacagcatcttccccgccagaggccccagagccggcggcaccagactgaccctgaacggcagcaagctgctgaccggcagactggaggacatcagagtggtggtgggcgaccagccctgccacctgctgcccgagcagcagagcgagcagctgagatgcgagaccagccccagacccacccccgccaccctgcccgtggccgtgtggttcggcgccaccgagagaagactgcagagaggccagttcaagtacaccctggaccccaacatcaccagcgccggccccaccaagagcttcctgagcggcggcagagagatctgcgtgagaggccagaacctggacgtggtgcagacccccagaatcagagtgaccgtggtgagcagaatgctgcagcccagccagggcctgggcagaagaagaagagtggtgcccgagaccgcctgcagcctgggccccagctgcagcagccagcagttcgaggagccctgccacgtgaacagcagccagctgatcacctgcagaacccccgccctgcccggcctgcccgaggacccctgggtgagagtggagttcatcctggacaacctggtgttcgacttcgccaccctgaaccccacccccttcagctacgaggccgaccccaccctgcagcccctgaaccccgaggaccccaccatgcccttcagacacaagcccggcagcgtgttcagcgtggagggcgagaacctggacctggccatgagcaaggaggaggtggtggccatgatcggcgacggcccctgcgtggtgaagaccctgaccagacaccacctgtactgcgagccccccgtggagcagcccctgcccagacaccacgccctgagagaggcccccgacagcctgcccgagttcaccgtgcagatgggcaacctgagattcagcctgggccacgtgcagtacgacggcgagagccccggcgccttccccgtggccgcccaggtgggcctgggcgtgggcaccagcctgctggccctgggcgtgatcatcatcgtgctgatgtacagaagaaagagcaagcaggccctgagagactacaagaaggtgcagatccagctggagaacctggagagcagcgtgagagacagatgcaagaaggagttcaccgacctgatgaccgagatgaccgacctgaccagcgacctgctgggcagcggcatccccttcctggactacaaggtgtacgccgagagaatcttcttccccggccacagagagagccccctgcacagagacctgggcgtgcccgagagcagaagacccaccgtggagcagggcctgggccagctgagcaacctgctgaacagcaagctgttcctgaccaagttcatccacaccctggagagccagagaaccttcagcgccagagacagagcctacgtggccagcctgctgaccgtggccctgcacggcaagctggagtacttcaccgacatcctgagaaccctgctgagcgacctggtggcccagtacgtggccaagaaccccaagctgatgctgagaagaaccgagaccgtggtggagaagctgctgaccaactggatgagcatctgcctgtacaccttcgtgagagacagcgtgggcgagcccctgtacatgctgttcagaggcatcaagcaccaggtggacaagggccccgtggacagcgtgaccggcaaggccaagtacaccctgaacgacaacagactgctgagagaggacgtggagtacagacccctgaccctgaacgccctgctggccgtgggccccggcgccggcgaggcccagggcgtgcccgtgaaggtgctggactgcgacaccatcagccaggccaaggagaagatgctggaccagctgtacaagggcgtgcccctgacccagagacccgaccccagaaccctggacgtggagtggagaagcggcgtggccggccacctgatcctgagcgacgaggacgtgaccagcgaggtgcagggcctgtggagaagactgaacaccctgcagcactacaaggtgcccgacggcgccaccgtggccctggtgccctgcctgaccaagcacgtgctgagagagaaccaggactacgtgcccggcgagagaacccccatgctggaggacgtggacgagggcggcatcagaccctggcacctggtgaagcccagcgacgagcccgagccccccagacccagaagaggcagcctgagaggcggcgagagagagagagccaaggccatccccgagatctacctgaccagactgctgagcatgaagggcaccctgcagaagttcgtggacgacctgttccaggtgatcctgagcaccagcagacccgtgcccctggccgtgaagtacttcttcgacctgctggacgagcaggcccagcagcacggcatcagcgaccaggacaccatccacatctggaagaccaacagcctgcccctgagattctggatcaacatcatcaagaacccccagttcgtgttcgacgtgcagaccagcgacaacatggacgccgtgctgctggtgatcgcccagaccttcatggacgcctgcaccctggccgaccacaagctgggcagagacagccccatcaacaagctgctgtacgccagagacatccccagatacaagagaatggtggagagatactacgccgacatcagacagaccgtgcccgccagcgaccaggagatgaacagcgtgctggccgagctgagctggaactacagcggcgacctgggcgccagagtggccctgcacgagctgtacaagtacatcaacaagtactacgaccagatcatcaccgccctggaggaggacggcaccgcccagaagatgcagctgggctacagactgcagcagatcgccgccgccgtggagaacaaggtgaccgacctgtag

SEQ ID NO: 3983 - DNA, 342 bp, Artificial Sequence
  Description of Artificial Sequence: Synthetic coding sequence
atgctggtgctgttcctgctgggcaccgtgttcctgctgtgcccctactggggcgagctgcacgaccccatcaaggccaccgagatcatgtgctacgagtgcaagaagtaccacctgggcctgtgctacggcgtgatgaccagctgcagcctgaagcacaagcagagctgcgccgtggagaacttctacatcctgaccagaaagggccagagcatgtaccactacagcaagctgagctgcatgaccagctgcgaggacatcaacttcctgggcttcaccaagagagtggagctgatctgctgcgaccacagcaactactgcaacctgcccgagggcgtgtag

SEQ ID NO: 3984 - DNA, 6408 bp, Artificial Sequence; identical to SEQ ID NO: 3686
  Description of Artificial Sequence: Synthetic coding sequence

SEQ ID NO: 3985 - DNA, 390 bp, Artificial Sequence
  Description of Artificial Sequence: Synthetic coding sequence
atgagacccctgaagcccggcgcccccctgcccgccctgttcctgctggccctggccctgagcccccacggcgcccacggcagacccagaggcagaagaggcgccagagtgaccgacaaggagcccaagcccctgctgttcctgcccgccgccggcgccggcagaacccccagcggcagcagaagcgccgagatcttccccagagacagcaacctgaaggacaagttcatcaagcacttcaccggccccgtgaccttcagccccgagtgcagcaagcacttccacagactgtactacaacaccagagagtgcagcacccccgcctactacaagagatgcgccagactgctgaccagactggccgtgagccccctgtgcagccagacctag

SEQ ID NO: 3986 - DNA, 252 bp, Artificial Sequence
  Description of Artificial Sequence: Synthetic coding sequence
atgagactgagcgtgtgcctgctgatggtgagcctggccctgtgctgctaccaggcccacgccctggtgtgccccgccgtggccagcgagatcaccgtgttcctgttcctgagcgacgccgccgtgaacctgcaggtggccaagctgaaccccccccccgaggccctggccgccaagctggaggtgaagcactgcaccgaccagatcagcttcaagaagagactgagcctgaagaagagctggtggaagtag

SEQ ID NO: 3987 - DNA, 1455 bp, Artificial Sequence; identical to SEQ ID NO: 3795
  Description of Artificial Sequence: Synthetic coding sequence

SEQ ID NO: 3988 - DNA, 159 bp, Artificial Sequence
  Description of Artificial Sequence: Synthetic coding sequence
atgaagctgtgcgtgaccgtgctgagcctgctggtgctggtggccgccttctgcagcctggccctgagcgcccccagcaacaagcccctggaggccagcaagagcgccctgacccccgtgagccccggcagcagaagcacctgcatgacctggaactag

SEQ ID NO: 3989 - DNA, 675 bp, Artificial Sequence
  Description of Artificial Sequence: Synthetic coding sequence
atgagagtgagcggcgtgctgagactgctggccctgatcttcgccatcgtgaccacctggatgttcatcagaagctacatgagcttcagcatgaagaccatcagactgcccagatggctggccgccagccccaccaaggagatccaggtgaagaagtacaagtgcggcctgatcaagccctgccccgccaactacttcgccttcaagatctgcagcggcgccgccaacgtggtgggccccaccatgtgcttcgaggacagaatgatcatgagccccgtgaagaacaacgtgggcagaggcctgaacatcgccctggtgaacggcaccaccggcgccgtgctgggccagaaggccttcgacatgtacagcggcgacgtgatgcacctggtgaagttcctgaaggagatccccggcggcgccctggtgctggtggccagctacgacgaccccggcaccaagatgaacgacgagagcagaaagctgttcagcgacctgggcagcagctacgccaagcagctgggcttcagagacagctgggtgttcatcggcgccaaggacctgagaggcaagagccccttcgagcagttcctgaagaacagccccgacaccaacaagtacgagggctggcccgagctgctggagatggagggctgcatgccccccaagcccttctag

SEQ ID NO: 3990 - DNA, 1404 bp, Artificial Sequence
  Description of Artificial Sequence: Synthetic coding sequence
atgctgatcttctggaccatcaccctgttcctgctgggcgccgccaagggcaaggaggtgtgctacgaggacctgggctgcttcagcgacaccgagccctggggcggcaccgccatcagacccctgaagatcctgccctggagccccgagaagatcggcaccagattcctgctgtacaccaacgagaaccccaacaacttccagatcctgctgctgagcgaccccagcaccatcgaggccagcaacttccagatggacagaaagaccagattcatcatccacggcttcatcgacaagggcgacgagagctgggtgaccgacatgtgcaagaagctgttcgaggtggaggaggtgaactgcatctgcgtggactggaagaagggcagccaggccacctacacccaggccgccaacaacgtgagagtggtgggcgcccaggtggcccagatgctggacatcctgctgaccgagtacagctacccccccagcaaggtgcacctgatcggccacagcctgggcgcccacgtggccggcgaggccggcagcaagacccccggcctgagcagaatcaccggcctggaccccgtggaggccagcttcgagagcacccccgaggaggtgagactggaccccagcgacgccgacttcgtggacgtgatccacaccgacgccgcccccctgatccccttcctgggcttcggcaccaaccagcagatgggccacctggacttcttccccaacggcggcgagagcatgcccggctgcaagaagaacgccctgagccagatcgtggacctggacggcatctgggccggcaccagagacttcgtggcctgcaaccacctgagaagctacaagtactacctggagagcatcctgaaccccgacggcttcgccgcctacccctgcaccagctacaagagcttcgagagcgacaagtgcttcccctgccccgaccagggctgcccccagatgggccactacgccgacaagttcgccggcagaaccagcgaggagcagcagaagttcttcctgaacaccggcgaggccagcaacttcgccagatggagatacggcgtgagcatcaccctgagcggcagaaccgccaccggccagatcaaggtggccctgttcggcaacaagggcaacacccaccagtacagcatcttcagaggcatcctgaagcccggcagcacccacagctacgagttcgacgccaagctggacgtgggcaccatcgagaaggtgaagttcctgtggaacaacaacgtgatcaaccccaccctgcccaaggtgggcgccaccaagatcaccgtgcagaagggcgaggagaagaccgtgtacaacttctgcagcgaggacaccgtgagagaggacaccctgctgaccctgaccccctgctag

SEQ ID NO: 3991 - DNA, 237 bp, Artificial Sequence
  Description of Artificial Sequence: Synthetic coding sequence
atgggcagcggcctgcccctggtgctgctgctgaccctgctgggcagcagccacggcaccggccccggcatgaccctgcagctgaagctgaaggagagcttcctgaccaacagcagctacgagagcagcttcctggagctgctggagaagctgtgcctgctgctgcacctgcccagcggcaccagcgtgaccctgcaccacgccagaagccagcaccacgtggtgtgcaacacctag

SEQ ID NO: 3992 - DNA, 291 bp, Artificial Sequence
  Description of Artificial Sequence: Synthetic coding sequence
atggagcacaaggaggtggtgctgctgctgctgctgttcctgaagagcggccagggcgagcccctggacgactacgtgaacacccagggccccagcctgttcagcgtgaccaagaagcagctgggcgccggcagcagagaggagtgcgccgccaagtgcgaggaggacaaggagttcacctgcagagccttccagtaccacagcaaggagcagcagtgcgtgatcatggccgagaacagaaagagcagcatcatcatcagaatgagagacgccgtgctgttcgagaagtag

SEQ ID NO: 3993 - DNA, 1083 bp, Artificial Sequence
  Description of Artificial Sequence: Synthetic coding sequence
atgggcctgctgctgctggtgcccctgctgctgctgcccggcagctacggcctgcccttctacaacggcttctactacagcaacagcgccaacgaccagaacctgggcaacggccacggcaaggacctgctgaacggcgtgaagctggtggtggagacccccgaggagaccctgttcacctaccagggcgccagcgtgatcctgccctgcagatacagatacgagcccgccctggtgagccccagaagagtgagagtgaagtggtggaagctgagcgagaacggcgcccccgagaaggacgtgctggtggccatcggcctgagacacagaagcttcggcgactaccagggcagagtgcacctgagacaggacaaggagcacgacgtgagcctggagatccaggacctgagactggaggactacggcagatacagatgcgaggtgatcgacggcctggaggacgagagcggcctggtggagctggagctgagaggcgtggtgttcccctaccagagccccaacggcagataccagttcaacttccacgagggccagcaggtgtgcgccgagcaggccgccgtggtggccagcttcgagcagctgttcagagcctgggaggagggcctggactggtgcaacgccggctggctgcaggacgccaccgtgcagtaccccatcatgctgcccagacagccctgcggcggccccggcctggcccccggcgtgagaagctacggccccagacacagaagactgcacagatacgacgtgttctgcttcgccaccgccctgaagggcagagtgtactacctggagcaccccgagaagctgaccctgaccgaggccagagaggcctgccaggaggacgacgccaccatcgccaaggtgggccagctgttcgccgcctggaagttccacggcctggacagatgcgacgccggctggctggccgacggcagcgtgagataccccgtggtgcacccccaccccaactgcggcccccccgagcccggcgtgagaagcttcggcttccccgacccccagagcagactgtacggcgtgtactgctacagacagcactag

SEQ ID NO: 3994 - DNA, 810 bp, Artificial Sequence
  Description of Artificial Sequence: Synthetic coding sequence
atgatcagaaccctgctgctgagcaccctggtggccggcgccctgagctgcggcgaccccacctaccccccctacgtgaccagagtggtgggcggcgaggaggccagacccaacagctggccctggcaggtgagcctgcagtacagcagcaacggcaagtggtaccacacctgcggcggcagcctgatcgccaacagctgggtgctgaccgccgcccactgcatcagcagcagcagaacctacagagtgggcctgggcagacacaacctgtacgtggccgagagcggcagcctggccgtgagcgtgagcaagatcgtggtgcacaaggactggaacagcaaccagatcagcaagggcaacgacatcgccctgctgaagctggccaaccccgtgagcctgaccgacaagatccagctggcctgcctgccccccgccggcaccatcctgcccaacaactacccctgctacgtgaccggctggggcagactgcagaccaacggcgccgtgcccgacgtgctgcagcagggcagactgctggtggtggactacgccacctgcagcagcagcgcctggtggggcagcagcgtgaagaccagcatgatctgcgccggcggcgacggcgtgatcagcagctgcaacggcgacagcggcggccccctgaactgccaggccagcgacggcagatggcaggtgcacggcatcgtgagcttcggcagcagactgggctgcaactactaccacaagcccagcgtgttcaccagagtgagcaactacatcgactggatcaacagcgtgatcgccaacaactag

SEQ ID NO: 3995 - DNA, 1122 bp, Artificial Sequence
  Description of Artificial Sequence: Synthetic coding sequence
atgctgccctggctgctggtgttcagcgccctgggcatccaggcctggggcgacagcagctggaacaagacccaggccaagcaggtgagcgagggcctgcagtacctgttcgagaacatcagccagctgaccgagaagggcctgcccaccgacgtgagcaccaccgtgagcagaaaggcctggggcgccgaggccgtgggctgcagcatccagctgaccacccccgtgaacgtgctggtgatccaccacgtgcccggcctggagtgccacgaccagaccgtgtgcagccagagactgagagagctgcaggcccaccacgtgcacaacaacagcggctgcgacgtggcctacaacttcctggtgggcgacgacggcagagtgtacgagggcgtgggctggaacatccagggcgtgcacacccagggctacaacaacatcagcctgggcttcgccttcttcggcaccaagaagggccacagccccagccccgccgccctgagcgccatggagaacctgatcacctacgccgtgcagaagggccacctgagcagcagctacgtgcagcccctgctgggcaagggcgagaactgcctggcccccagacagaagaccagcctgaagaaggcctgccccggcgtggtgcccagaagcgtgtggggcgccagagagacccactgccccagaatgaccctgcccgccaagtacggcatcatcatccacaccgccggcagaacctgcaacatcagcgacgagtgcagactgctggtgagagacatccagagcttctacatcgacagactgaagagctgcgacatcggctacaacttcctggtgggccaggacggcgccatctacgagggcgtgggctggaacgtgcagggcagcagcacccccggctacgacgacatcgccctgggcatcaccttcatgggcaccttcaccggcatcccccccaacgccgccgccctggaggccgcccaggacctgatccagtgcgccatggtgaagggctacctgacccccaactacctgctggtgggccacagcgacgtggccagaaccctgagccccggccaggccctgtacaacatcatcagcacctggccccacttcaagcactag

SEQ ID NO: 3996 - DNA, 327 bp, Artificial Sequence
  Description of Artificial Sequence: Synthetic coding sequence
atgagacagagactgctgcccagcgtgaccagcctgctgctggtggccctgctgttccccggcagcagccaggccagacacgtgaaccacagcgccaccgaggccctgggcgagctgagagagagagcccccggccagggcaccaacggcttccagctgctgagacacgccgtgaagagagacctgctgccccccagaacccccccctaccagggcgacgtgccccccggcatcagaaacaccatctgccacatgcagcagggcatctgcagactgttcttctgccacagcggcaccggccagcagcacagacagagatgcggctag

SEQ ID NO: 3997 - DNA, 708 bp, Artificial Sequence
  Description of Artificial Sequence: Synthetic coding sequence
atgagcccccccctgctgaagctgggcgccgtgctgagcaccatggccatgatcagcaactggatgagccagaccctgcccagcctggtgggcctgaacaccaccagactgagcacccccgacaccctgacccagatcagccccaaggagggctggcaggtgtacagcagcgcccaggaccccgacggcagatgcatctgcaccgtggtggcccccgagcagaacctgtgcagcagagacgccaagagcagacagctgagacagctgctggagaaggtgcagaacatgagccagagcatcgaggtgctgaacctgagaacccagagagacttccagtacgtgctgaagatggagacccagatgaagggcctgaaggccaagttcagacagatcgaggacgacagaaagaccctgatgaccaagcacttccaggagctgaaggagaagatggacgagctgctgcccctgatccccgtgctggagcagtacaagaccgacgccaagctgatcacccagttcaaggaggagatcagaaacctgagcgccgtgctgaccggcatccaggaggagatcggcgcctacgactacgaggagctgcaccagagagtgctgagcctggagaccagactgagagactgcatgaagaagctgatcgacctgaagaagagaaaggaggaggagaagagacagcagaagggcgaggcctag

SEQ ID NO: 3998 - DNA, 606 bp, Artificial Sequence
  Description of Artificial Sequence: Synthetic coding sequence
atgaacctgaactgccccccctgcgtgaccggcctgagagtgtggagcagctgcagaagcaagcccaacagcagagccagaagctgcagaagctgcaccggcgccagcagaaccctgcccagccaccacatgagccacgtggagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 3999 - DNA, 693 bp, Artificial Sequence
  Description of Artificial Sequence: Synthetic coding sequence
atgagactggccggccccctgagaatcgtggtgctggtggtgagcgtgggcgtgacctggatcgtggtgagcatcctgctgggcggccccggcagcggcttccccagaatccagcagctgttcaccagccccgagagcagcgtgaccgccgcccccagagccagaaagtacaagtgcggcctgccccagccctgccccgaggagcacctggccttcagagtggtgagcggcgccgccaacgtgatcggccccaagatctgcctggaggacaagatgctgatgagcagcgtgaaggacaacgtgggcagaggcctgaacatcgccctggtgaacggcgtgagcggcgagctgatcgaggccagagccttcgacatgtgggccggcgacgtgaacgacctgctgaagttcatcagacccctgcacgagggcaccctggtgttcgtggccagctacgacgaccccgccaccaagatgaacgaggagaccagaaagctgttcagcgagctgggcagcagaaacgccaaggagctggccttcagagacagctgggtgttcgtgggcgccaagggcgtgcagaacaagagccccttcgagcagcacgtgaagaacagcaagcacagcaacaagtacgagggctggcccgaggccctggagatggagggctgcatccccagaagaagcaccgccagctag

SEQ ID NO: 4000 - DNA, 684 bp, Artificial Sequence
  Description of Artificial Sequence: Synthetic coding sequence
atgagagtggccggcgccgccaagctggtggtggccgtggccgtgttcctgctgaccttctacgtgatcagccaggtgttcgagatcaagatggacgccagcctgggcaacctgttcgccagaagcgccctggacaccgccgccagaagcaccaagccccccagatacaagtgcggcatcagcaaggcctgccccgagaagcacttcgccttcaagatggccagcggcgccgccaacgtggtgggccccaagatctgcctggaggacaacgtgctgatgagcggcgtgaagaacaacgtgggcagaggcatcaacgtggccctggccaacggcaagaccggcgaggtgctggacaccaagtacttcgacatgtggggcggcgacgtggcccccttcatcgagttcctgaaggccatccaggacggcaccatcgtgctgatgggcacctacgacgacggcgccaccaagctgaacgacgaggccagaagactgatcgccgacctgggcagcaccagcatcaccaacctgggcttcagagacaactgggtgttctgcggcggcaagggcatcaagaccaagagccccttcgagcagcacatcaagaacaacaaggacaccaacaagtacgagggctggcccgaggtggtggagatggagggctgcatcccccagaagcaggactag

SEQ ID NO: 4001 - DNA, 1656 bp, Artificial Sequence
  Description of Artificial Sequence: Synthetic coding sequence
atggaggacagcgacagcgccgccaagcagctgggcctggccgaggccgccgccgccggcggcgaggccgaggagcccgtgctgagcagagacgaggacagcgaggaggacgccgacagcgaggccgagagagagacccccagagtgaccgccgtggccgtgatggccgccgagcccggccacatggacatgggcgccgaggccctgcccggccccgacgaggccgccgccgccgccgccttcgccgaggtgaccaccgtgaccgtggccaacgtgggcgccgccgccgacaacgtgttcaccaccagcgtggccaacgccgccagcatcagcggccacgtgctgagcggcagaaccgccctgcagatcggcgacagcctgaacaccgagaaggccaccctgatcgtggtgcacaccgacggcagcatcgtggagaccaccggcctgaagggccccgccgcccccctgacccccggcccccagagcccccccacccccctggcccccggccaggagaagggcggcaccaagtacaactgggaccccagcgtgtacgacagcgagctgcccgtgagatgcagaaacatcagcggcaccctgtacaagaacagactgggcagcggcggcagaggcagatgcatcaagcagggcgagaactggtacagccccaccgagttcgaggccatggccggcagagccagcagcaaggactggaagagaagcatcagatacgccggcagacccctgcagtgcctgatccaggacggcatcctgaacccccacgccgccagctgcacctgcgccgcctgctgcgacgacatgaccctgagcggccccgtgagactgttcgtgccctacaagagaagaaagaaggagaacgagctgcccaccacccccgtgaagaaggacagccccaagaacatcaccctgctgcccgccaccgccgccaccaccttcaccgtgacccccagcggccagatcaccaccagcggcgccctgaccttcgacagagccagcaccgtggaggccaccgccgtgatcagcgagagccccgcccagggcgacgtgttcgccggcgccaccgtgcaggaggccagcgtgcagcccccctgcagagccagccaccccgagccccactaccccggctaccaggacagctgccagatcgcccccttccccgaggccgccctgcccaccagccaccccaagatcgtgctgaccagcctgcccgccctggccgtgcccccccccacccccaccaaggccgccccccccgccctggtgaacggcctggagctgagcgagcccagaagctggctgtacctggaggagatggtgaacagcctgctgaacaccgcccagcagctgaagaccctgttcgagcaggccaagcacgccagcacctacagagaggccgccaccaaccaggccaagatccacgccgacgccgagagaaaggagcagagctgcgtgaactgcggcagagaggccatgagcgagtgcaccggctgccacaaggtgaactactgcagcaccttctgccagagaaaggactggaaggaccaccagcacatctgcggccagagcgccgccgtgaccgtgcaggccgacgaggtgcacgtggccgagagcgtgatggagaaggtgaccgtgtag

SEQ ID NO: 4002 - DNA, 2022 bp, Artificial Sequence
  Description of Artificial Sequence: Synthetic coding sequence
atgaagcccggcggcttctggctgcacctgaccctgctgggcgccagcctgcccgccgccctgggctggatggaccccggcaccagcagaggccccgacgtgggcgtgggcgagagccaggccgaggagcccagaagcttcgaggtgaccagaagagagggcctgagcagccacaacgagctgctggccagctgcggcaagaagttctgcagcagaggcagcagatgcgtgctgagcctggcccccgaggacagagtgagcgtgaccaccgtgaccgtgggcctgagcaccgtgctgacctgcgccgtgcacggcgacctgagaccccccatcatctggaagagaaacggcctgaccctgaacttcctggacctggaggacatcaacgacttcggcgaggacgacagcctgtacatcaccaaggtgaccaccatccacatgggcaactacacctgccacgccagcggccacgagcagctgttccagacccacgtgctgcaggtgaacgtgccccccgtgatcagagtgtaccccgagagccaggcccaggagcccggcgtggccgccagcctgagatgccacgccgagggcatccccatgcccagaatcacctggctgaagaacggcgtggacgtgagcacccagatgagcaagcagctgagcctgctggccaacggcagcgagctgcacatcagcagcgtgagatacgaggacaccggcgcctacacctgcatcgccaagaacgaggtgggcgtggacgaggacatcagcagcctgttcatcgaggacagcgccagaaagaccctggccaacatcctgtggagagaggagggcctgagcgtgggcaacatgttctacgtgttcagcgacgacggcatcatcgtgatccaccccgtggactgcgagatccagagacacctgaagcccaccgagaagatcttcatgagctacgaggagatctgcccccagagagagaagaacgccacccagccctgccagtgggtgagcgccgtgaacgtgagaaacagatacatctacgtggcccagcccgccctgagcagagtgctggtggtggacatccaggcccagaaggtgctgcagagcatcggcgtggaccccctgcccgccaagctgagctacgacaagagccacgaccaggtgtgggtgctgagctggggcgacgtgcacaagagcagacccagcctgcaggtgatcaccgaggccagcaccggccagagccagcacctgatcagaacccccttcgccggcgtggacgacttcttcatcccccccaccaacctgatcatcaaccacatcagattcggcttcatcttcaacaagagcgaccccgccgtgcacaaggtggacctggagaccatgatgcccctgaagaccatcggcctgcaccaccacggctgcgtgccccaggccatggcccacacccacctgggcggctacttcttcatccagtgcagacaggacagccccgccagcgccgccagacagctgctggtggacagcgtgaccgacagcgtgctgggccccaacggcgacgtgaccggcaccccccacaccagccccgacggcagattcatcgtgagcgccgccgccgacagcccctggctgcacgtgcaggagatcaccgtgagaggcgagatccagaccctgtacgacctgcagatcaacagcggcatcagcgacctggccttccagagaagcttcaccgagagcaaccagtacaacatctacgccgccctgcacaccgagcccgacctgctgttcctggagctgagcaccggcaaggtgggcatgctgaagaacctgaaggagccccccgccggccccgcccagccctggggcggcacccacagaatcatgagagacagcggcctgttcggccagtacctgctgacccccgccagagagagcctgttcctgatcaacggcagacagaacaccctgagatgcgaggtgagcggcatcaagggcggcaccaccgtggtgtgggtgggcgaggtgtag

SEQ ID NO: 4003 - DNA, 2007 bp, Artificial Sequence
  Description of Artificial Sequence: Synthetic coding sequence
atggacctggtgctgaagagatgcctgctgcacctggccgtgatcggcgccctgctggccgtgggcgccaccaaggtgcccagaaaccaggactggctgggcgtgagcagacagctgagaaccaaggcctggaacagacagctgtaccccgagtggaccgaggcccagagactggactgctggagaggcggccaggtgagcctgaaggtgagcaacgacggccccaccctgatcggcgccaacgccagcttcagcatcgccctgaacttccccggcagccagaaggtgctgcccgacggccaggtgatctgggtgaacaacaccatcatcaacggcgaccaggtgtggggcggccagcccgtgtacccccaggagaccgacgacgcctgcatcttccccgacggcggcccctgccccagcggcagctggagccagaagagaagcttcgtgtacgtgtggaagacctggggccagtactggcaggtgctgggcggccccgtgagcggcctgagcatcggcaccggcagagccatgctgggcacccacaccatggaggtgaccgtgtaccacagaagaggcagcagaagctacgtgcccctggcccacagcagcagcgccttcaccatcaccgaccaggtgcccttcagcgtgagcgtgagccagctgagagccctggacggcggcaacaagcacttcctgagaaaccagcccctgaccttcgccctgcagctgcacgaccccagcggctacctggccgaggccgacctgagctacacctgggacttcggcgacagcagcggcaccctgatcagcagagccctggtggtgacccacacctacctggagcccggccccgtgaccgcccaggtggtgctgcaggccgccatccccctgaccagctgcggcagcagccccgtgcccggcaccaccgacggccacagacccaccgccgaggcccccaacaccaccgccggccaggtgcccaccaccgaggtggtgggcaccacccccggccaggcccccaccgccgagcccagcggcaccaccagcgtgcaggtgcccaccaccgaggtgatcagcaccgcccccgtgcagatgcccaccgccgagagcaccggcatgacccccgagaaggtgcccgtgagcgaggtgatgggcaccaccctggccgagatgagcacccccgaggccaccggcatgacccccgccgaggtgagcatcgtggtgctgagcggcaccaccgccgcccaggtgaccaccaccgagtgggtggagaccaccgccagagagctgcccatccccgagcccgagggccccgacgccagcagcatcatgagcaccgagagcatcaccggcagcctgggccccctgctggacggcaccgccaccctgagactggtgaagagacaggtgcccctggactgcgtgctgtacagatacggcagcttcagcgtgaccctggacatcgtgcagggcatcgagagcgccgagatcctgcaggccgtgcccagcggcgagggcgacgccttcgagctgaccgtgagctgccagggcggcctgcccaaggaggcctgcatggagatcagcagccccggctgccagccccccgcccagagactgtgccagcccgtgctgcccagccccgcctgccagctggtgctgcaccagatcctgaagggcggcagcggcacctactgcctgaacgtgagcctggccgacaccaacagcctggccgtggtgagcacccagctgatcatgcccgtgcccggcatcctgctgaccggccaggaggccggcctgggccaggtgcccctgatcgtgggcatcctgctggtgctgatggccgtggtgctggccagcctgatctacagaagaagactgatgaagcaggacttcagcgtgccccagctgccccacagcagcagccactggctgagactgcccagaatcttctgcagctgccccatcggcgagaacagccccctgctgagcggccagcaggtgtag

SEQ ID NO: 4004 - DNA, 1746 bp, Artificial Sequence
  Description of Artificial Sequence: Synthetic coding sequence
atgcagcaggacggcctgggcgtgggcaccagaaacggcagcggcaagggcagaagcgtgcaccccagctggccctggtgcgcccccagacccctgagatacttcggcagagacgccagagccagaagagcccagaccgccgccatggccctgctggccggcggcctgagcagaggcctgggcagccaccccgccgccgccggcagagacgccgtggtgttcgtgtggctgctgctgagcacctggtgcaccgcccccgccagagccatccaggtgaccgtgagcaacccctaccacgtggtgatcctgttccagcccgtgaccctgccctgcacctaccagatgaccagcacccccacccagcccatcgtgatctggaagtacaagagcttctgcagagacagaatcgccgacgccttcagccccgccagcgtggacaaccagctgaacgcccagctggccgccggcaaccccggctacaacccctacgtggagtgccaggacagcgtgagaaccgtgagagtggtggccaccaagcagggcaacgccgtgaccctgggcgactactaccagggcagaagaatcaccatcaccggcaacgccgacctgaccttcgaccagaccgcctggggcgacagcggcgtgtactactgcagcgtggtgagcgcccaggacctgcagggcaacaacgaggcctacgccgagctgatcgtgctggtgtacgccgccggcaaggccgccaccagcggcgtgcccagcatctacgcccccagcacctacgcccacctgagccccgccaagaccccccccccccccgccatgatccccatgggccccgcctacaacggctaccccggcggctaccccggcgacgtggacagaagcagcagcgccggcggccagggcagctacgtgcccctgctgagagacaccgacagcagcgtggccagcgaggtgagaagcggctacagaatccaggccagccagcaggacgacagcatgagagtgctgtactacatggagaaggagctggccaacttcgaccccagcagacccggcccccccagcggcagagtggagagagccatgagcgaggtgaccagcctgcacgaggacgactggagaagcagacccagcagaggccccgccctgacccccatcagagacgaggagtggggcggccacagccccagaagccccagaggctgggaccaggagcccgccagagagcaggccggcggcggctggagagccagaagacccagagccagaagcgtggacgccctggacgacctgaccccccccagcaccgccgagagcggcagcagaagccccaccagcaacggcggcagaagcagagcctacatgccccccagaagcagaagcagagacgacctgtacgaccaggacgacagcagagacttccccagaagcagagacccccactacgacgacttcagaagcagagagagaccccccgccgaccccagaagccaccaccacagaaccagagaccccagagacaacggcagcagaagcggcgacctgccctacgacggcagactgctggaggaggccgtgagaaagaagggcagcgaggagagaagaagaccccacaaggaggaggaggaggaggcctactacccccccgccccccccccctacagcgagaccgacagccaggccagcagagagagaagactgaagaagaacctggccctgagcagagagagcctggtggtgtag

SEQ ID NO: 4005 - DNA, 1959 bp, Artificial Sequence
  Description of Artificial Sequence: Synthetic coding sequence
atgcccccccccctgcccctgctgctgctgaccgtgctggtggtggccgccgccagacccggctgcgagttcgagagaaaccccgccggcgagtgccacagaccccccgccgccgacagcgccacctgcgtggacctgcagctgagaacctgcagcgacgccgcctacaaccacaccaccttccccaacctgctgcagcacagaagctgggaggtggtggaggccagcagcgagtacatcctgctgagcgtgctgcaccagctgctggagggccagtgcaaccccgacctgagactgctgggctgcgccgtgctggcccccagatgcgagggcggctgggtgagaagaccctgcagacacatctgcgagggcctgagagaggtgtgccagcccgccttcgacgccatcgacatggcctggccctacttcctggactgccacagatacttcaccagagaggacgagggctgctacgaccccctggagaagctgagaggcggcctggaggccgacgaggccctgcccagcggcctgccccccaccttcatcagattcagccaccacagctacgcccagatggtgagagtgctgagaagaaccgccagcagatgcgcccacgtggccagaacctacagcatcggcagaagcttcgacggcagagagctgctggtgatcgagttcagcagcagacccggccagcacgagctgatggagcccgaggtgaagctgatcggcaacatccacggcaacgaggtggccggcagagagatgctgatctacctggcccagtacctgtgcagcgagtacctgctgggcaaccccagaatccagagactgctgaacaccaccagaatccacctgctgcccagcatgaaccccgacggctacgaggtggccgccgccgagggcgccggctacaacggctggaccagcggcagacagaacgcccagaacctggacctgaacagaaacttccccgacctgaccagcgagtactacagactggccgagaccagaggcgccagaagcgaccacatccccatcccccagcactactggtggggcaaggtggcccccgagaccaaggccatcatgaagtggatgcagaccatccccttcgtgctgagcgccagcctgcacggcggcgacctggtggtgagctaccccttcgacttcagcaagcacccccaggaggagaagatgttcagccccacccccgacgagaagatgttcaagctgctgagcagagcctacgccgacgtgcaccccatgatgatggacagaagcgagaacagatgcggcggcaacttcctgaagagaggcagcatcatcaacggcgccgactggtacagcttcaccggcggcatgagcgacttcaactacctgcacaccaactgcttcgagatcaccgtggagctgggctgcgtgaagttcccccccgaggaggccctgtacatcctgtggcagcacaacaaggagagcctgctgaacttcgtggagaccgtgcacagaggcatcaagggcgtggtgaccgacaagttcggcaagcccgtgaagaacgccagaatcagcgtgaagggcatcagacacgacatcaccaccgcccccgacggcgactactggagactgctgccccccggcatccacatcgtgatcgcccaggcccccggctacgccaaggtgatcaagaaggtgatcatccccgccagaatgaagagagccggcagagtggacttcatcctgcagcccctgggcatgggccccaagaacttcatccacggcctgagaagaaccggcccccacgaccccctgggcggcgccagcagcctgggcgaggccaccgagcccgaccccctgagagccagaagacagcccagcgccgacggcagcaagccctggtggtggagctacttcaccagcctgagcacccacagacccagatggctgctgaagtactag

SEQ ID NO: 4006 - DNA, 279 bp, Artificial Sequence
  Description of Artificial Sequence: Synthetic coding sequence
atgaagctgtgcgtgaccgtgctgagcctgctggtgctggtggccgccttctgcagcctggccctgagcgcccccatgggcagcgacccccccaccgcctgctgcttcagctacaccgccagaaagctgcccagaaacttcgtggtggactactacgagaccagcagcctgtgcagccagcccgccgtggtgggcttcctgggcagaaagggcaagcaggtgtgcgccgaccccagcgagagctgggtgcaggagtacgtgtacgacctggagctgtag

SEQ ID NO: 4007 - DNA, 249 bp, Artificial Sequence
  Description of Artificial Sequence: Synthetic coding sequence
atgagacagagactgctgcccagcgtgaccagcctgctgctggtggccctgctgttccccggcagcagccaggccagacacgtgaaccacagcgccaccgaggccctgggcgagctgagagagagagcccccggccagggcaccaacggcttccagctgctgagacacgccgtgaagagagacctgctgccccccagaacccccccctaccagggcaccggccagcagcacagacagagatgcggctag

SEQ ID NO: 4008 - DNA, 411 bp, Artificial Sequence
  Description of Artificial Sequence: Synthetic coding sequence
atggacaacgtgcagcccaagatcaagcacagacccttctgcttcagcgtgaagggccacgtgaagatgctgagactggccctgaccgtgaccagcatgaccttcttcatcatcgcccaggcccccgagccctacatcgtgatcaccggcttcgaggtgaccgtgatcctgttcttcatcctgctgtacgtgctgagactggacagactgatgaagtggctgttctggcccctgctggacatcatcaacagcctggtgaccaccgtgttcatgctgatcgtgagcgtgctggccctgatccccgagaccaccaccctgaccgtgggcggcggcgtgttcgccctggtgaccgccgtgtgctgcctggccgacggcgccctgatctacagaaagctgctgttcctgagatag

SEQ ID NO: 4009 - DNA, 1068 bp, Artificial Sequence
  Description of Artificial Sequence: Synthetic coding sequence
atgcagctgaccacctgcctgagagagaccctgttcaccggcgccagccagaagaccagcctgtggtggctgggcatcgccagcttcggcgtgcccgagaagctgggctgcgccaacctgcccctgaacagcagacagaaggagctgtgcaagagaaagccctacctgctgcccagcatcagagagggcgccagactgggcatccaggagtgcggcagccagttcagacacgagagatggaactgcatgatcaccgccgccgccaccaccgcccccatgggcgccagccccctgttcggctacgagctgagcagcggcaccaaggagaccgccttcatctacgccgtgatggccgccggcctggtgcacagcgtgaccagaagctgcagcgccggcaacatgaccgagtgcagctgcgacaccaccctgcagaacggcggcagcgccagcgagggctggcactggggcggctgcagcgacgacgtgcagtacggcatgtggttcagcagaaagttcctggacttccccatcggcaacaccaccggcaaggagaacaaggtgctgctggccatgaacctgcacaacaacgaggccggcagacaggccgtggccaagctgatgagcgtggactgcagatgccacggcgtgagcggcagctgcgccgtgaagacctgctggaagaccatgagcagcttcgagaagatcggccacctgctgaaggacaagtacgagaacagcatccagatcagcgacaagaccaagagaaagatgagaagaagagagaaggaccagagaaagatccccatccacaaggacgacctgctgtacgtgaacaagagccccaactactgcgtggaggacaagaagctgggcatccccggcacccagggcagagagtgcaacagaaccagcgagggcgccgacggctgcaacctgctgtgctgcggcagaggctacaacacccacgtggtgagacacgtggagagatgcgagtgcaagttcatctggtgctgctacgtgagatgcagaagatgcgagagcatgaccgacgtgcacacctgcaagtag

SEQ ID NO: 4010 - DNA, 2916 bp, Artificial Sequence
  Description of Artificial Sequence: Synthetic coding sequence
atgctgagaagacccgcccccgccctggcccccgccgccagactgctgctggccggcctgctgtgcggcggcggcgtgtgggccgccagagtgaacaagcacaagccctggctggagcccacctaccacggcatcgtgaccgagaacgacaacaccgtgctgctggacccccccctgatcgccctggacaaggacgcccccctgagattcgccggcgagatctgcggcttcaagatccacggccagaacgtgcccttcgacgccgtggtggtggacaagagcaccggcgagggcgtgatcagaagcaaggagaagctggactgcgagctgcagaaggactacagcttcaccatccaggcctacgactgcggcaagggccccgacggcaccaacgtgaagaagagccacaaggccaccgtgcacatccaggtgaacgacgtgaacgagtacgcccccgtgttcaaggagaagagctacaaggccaccgtgatcgagggcaagcagtacgacagcatcctgagagtggaggccgtggacgccgactgcagcccccagttcagccagatctgcagctacgagatcatcacccccgacgtgcccttcaccgtggacaaggacggctacatcaagaacaccgagaagctgaactacggcaaggagcaccagtacaagctgaccgtgaccgcctacgactgcggcaagaagagagccaccgaggacgtgctggtgaagatcagcatcaagcccacctgcacccccggctggcagggctggaacaacagaatcgagtacgagcccggcaccggcgccctggccgtgttccccaacatccacctggagacctgcgacgagcccgtggccagcgtgcaggccaccgtggagctggagaccagccacatcggcaagggctgcgacagagacacctacagcgagaagagcctgcacagactgtgcggcgccgccgccggcaccgccgagctgctgcccagccccagcggcagcctgaactggaccatgggcctgcccaccgacaacggccacgacagcgaccaggtgttcgagttcaacggcacccaggccgtgagaatccccgacggcgtggtgagcgtgagccccaaggagcccttcaccatcagcgtgtggatgagacacggccccttcggcagaaagaaggagaccatcctgtgcagcagcgacaagaccgacatgaacagacaccactacagcctgtacgtgcacggctgcagactgatcttcctgttcagacaggaccccagcgaggagaagaagtacagacccgccgagttccactggaagctgaaccaggtgtgcgacgaggagtggcaccactacgtgctgaacgtggagttccccagcgtgaccctgtacgtggacggcaccagccacgagcccttcagcgtgaccgaggactaccccctgcaccccagcaagatcgagacccagctggtggtgggcgcctgctggcaggagttcagcggcgtggagaacgacaacgagaccgagcccgtgaccgtggccagcgccggcggcgacctgcacatgacccagttcttcagaggcaacctggccggcctgaccctgagaagcggcaagctggccgacaagaaggtgatcgactgcctgtacacctgcaaggagggcctggacctgcaggtgctggaggacagcggcagaggcgtgcagatccaggcccaccccagccagctggtgctgaccctggagggcgaggacctgggcgagctggacaaggccatgcagcacatcagctacctgaacagcagacagttccccacccccggcatcagaagactgaagatcaccagcaccatcaagtgcttcaacgaggccacctgcatcagcgtgccccccgtggacggctacgtgatggtgctgcagcccgaggagcccaagatcagcctgagcggcgtgcaccacttcgccagagccgccagcgagttcgagagcagcgagggcgtgttcctgttccccgagctgagaatcatcagcaccatcaccagagaggtggagcccgagggcgacggcgccgaggaccccaccgtgcaggagagcctggtgagcgaggagatcgtgcacgacctggacacctgcgaggtgaccgtggagggcgaggagctgaaccacgagcaggagagcctggaggtggacatggccagactgcagcagaagggcatcgaggtgagcagcagcgagctgggcatgaccttcaccggcgtggacaccatggccagctacgaggaggtgctgcacctgctgagatacagaaactggcacgccagaagcctgctggacagaaagttcaagctgatctgcagcgagctgaacggcagatacatcagcaacgagttcaaggtggaggtgaacgtgatccacaccgccaaccccatggagcacgccaaccacatggccgcccagccccagttcgtgcaccccgagcacagaagcttcgtggacctgagcggccacaacctggccaacccccaccccttcgccgtggtgcccagcaccgccaccgtggtgatcgtggtgtgcgtgagcttcctggtgttcatgatcatcctgggcgtgttcagaatcagagccgcccacagaagaaccatgagagaccaggacaccggcaaggagaacgagatggactgggacgacagcgccctgaccatcaccgtgaaccccatggagacctacgaggaccagcacagcagcgaggaggaggaggaggaggaggaggaggaggagagcgaggacggcgaggaggaggacgacatcaccagcgccgagagcgagagcagcgaggaggaggagggcgagcagggcgacccccagaacgccaccagacagcagcagctggagtgggacgacagcaccctgagctactag

SEQ ID NO: 4011 - DNA, 564 bp, Artificial Sequence
  Description of Artificial Sequence: Synthetic coding sequence
atggtggccgccaccgtggccgccgcctggctgctgctgtgggccgccgcctgcgcccagcaggagcaggacttctacgacttcaaggccgtgaacatcagaggcaagctggtgagcctggagaagtacagaggcagcgtgagcctggtggtgaacgtggccagcgagtgcggcttcaccgaccagcactacagagccctgcagcagctgcagagagacctgggcccccaccacttcaacgtgctggccttcccctgcaaccagttcggccagcaggagcccgacagcaacaaggagatcgagagcttcgccagaagaacctacagcgtgagcttccccatgttcagcaagatcgccgtgaccggcaccggcgcccaccccgccttcaagtacctggcccagaccagcggcaaggagcccacctggaacttctggaagtacctggtggcccccgacggcaaggtggtgggcgcctgggaccccaccgtgagcgtggaggaggtgagaccccagatcaccgccctggtgagaaagctgatcctgctgaagagagaggacctgtag

SEQ ID NO: 4012 - DNA, 303 bp, Artificial Sequence
  Description of Artificial Sequence: Synthetic coding sequence
atgtggggcttcctggtgctgaaggccagatggctggtgacccccgtgagaaccctggccaccgaggccggccagaagcccagcctgagaggcctgctggacgtgggcaacatccagcacagagccgccagagccagaggcctgaccagaggcgtgatcagagtgagcccccaggagagaagccagcagaaccagagcgcccccaagggccccacccccagcaccagacccaagcccagaaccctgggcccccaggcccacagcctggccctgcagagcgtggacctgctgttcagaccctag

SEQ ID NO: 4013 - DNA, 2352 bp, Artificial Sequence
  Description of Artificial Sequence: Synthetic coding sequence
atgagatggcagtgcggcaccagattcagaggcctgagacccgccgtggccccctggaccgccctgctggccctgggcctgcccggctgggtgctggccgtgagcgccaccgccgccgccgtggtgcccgagcagcacgccagcgtggccggccagcaccccctggactggctgctgaccgacagaggccccttccacagagcccaggagtacgccgacttcatggagagatacagacagggcttcaccaccagatacagaatctacagagagttcgccagatggaaggtgaacaacctggccctggagagaaaggacttcttcagcctgcccctgcccctggcccccgagttcatcagaaacatcagactgctgggcagaagacccaacctgcagcaggtgaccgagaacctgatcaagaagtacggcacccacttcctgctgagcgccaccctgggcggcgaggagagcctgaccatcttcgtggacaagcagaagctgggcagaaagaccgagaccaccggcggcgccagcatcatcggcggcagcggcaacagcaccgccgtgagcctggagaccctgcaccagctggccgccagctacttcatcgacagagagagcaccctgagaagactgcaccacatccagatcgccaccggcgccatcaaggtgaccgagaccagaaccggccccctgggctgcagcaactacgacaacctggacagcgtgagcagcgtgctggtgcagagccccgagaacaaggtgcagctgctgggcctgcaggtgctgctgcccgagtacctgagagagagattcgtggccgccgccctgagctacatcacctgcagcagcgagggcgagctggtgtgcaaggagaacgactgctggtgcaagtgcagccccaccttccccgagtgcaactgccccgacgccgacatccaggccatggaggacagcctgctgcagatccaggacagctgggccacccacaacagacagttcgaggagagcgaggagttccaggccctgctgaagagactgcccgacgacagattcctgaacagcaccgccatcagccagttctgggccatggacaccagcctgcagcacagataccagcagctgggcgccggcctgaaggtgctgttcaagaagacccacagaatcctgagaagactgttcaacctgtgcaagagatgccacagacagcccagattcagactgcccaaggagagaagcctgagctactggtggaacagaatccagagcctgctgtactgcggcgagagcaccttccccggcaccttcctggagcagagccacagctgcacctgcccctacgaccagagcagctgccagggccccatcccctgcgccctgggcgagggccccgcctgcgcccactgcgcccccgacaacagcaccagatgcggcagctgcaaccccggctacgtgctggcccagggcctgtgcagacccgaggtggccgagagcctggagaacttcctgggcctggagaccgacctgcaggacctggagctgaagtacctgctgcagaagcaggacagcagaatcgaggtgcacagcatcttcatcagcaacgacatgagactgggcagctggttcgaccccagctggagaaagagaatgctgctgaccctgaagagcaacaagtacaagcccggcctggtgcacgtgatgctggccctgagcctgcagatctgcctgaccaagaacagcaccctggagcccgtgatggccatctacgtgaaccccttcggcggcagccacagcgagagctggttcatgcccgtgaacgagggcagcttccccgactgggagagaaccaacgtggacgccgccgcccagtgccagaactggaccatcaccctgggcaacagatggaagaccttcttcgagaccgtgcacgtgtacctgagaagcagaatcaagagcctggacgacagcagcaacgagaccatctactacgagcccctggagatgaccgaccccagcaagaacctgggctacatgaagatcaacaccctgcaggtgttcggctacagcctgcccttcgaccccgacgccatcagagacctgatcctgcagctggactacccctacacccagggcagccaggacagcgccctgctgcagctgatcgagctgagagacagagtgaaccagctgagcccccccggcaaggtgagactggacctgttcagctgcctgctgagacacagactgaagctggccaacaacgaggtgggcagaatccagagcagcctgagagccttcaacagcaagctgcccaaccccgtggagtacgagaccggcaagctgtgcagctag

SEQ ID NO: 4014 - DNA, 2016 bp, Artificial Sequence
  Description of Artificial Sequence: Synthetic coding sequence
atggcccagctgttcctgcccctgctggccgccctggtgctggcccaggcccccgccgccctggccgacgtgctggagggcgacagcagcgaggacagagccttcagagtgagaatcgccggcgacgcccccctgcagggcgtgctgggcggcgccctgaccatcccctgccacgtgcactacctgagacccccccccagcagaagagccgtgctgggcagccccagagtgaagtggaccttcctgagcagaggcagagaggccgaggtgctggtggccagaggcgtgagagtgaaggtgaacgaggcctacagattcagagtggccctgcccgcctaccccgccagcctgaccgacgtgagcctggccctgagcgagctgagacccaacgacagcggcatctacagatgcgaggtgcagcacggcatcgacgacagcagcgacgccgtggaggtgaaggtgaagggcgtggtgttcctgtacagagagggcagcgccagatacgccttcagcttcagcggcgcccaggaggcctgcgccagaatcggcgcccacatcgccacccccgagcagctgtacgccgcctacctgggcggctacgagcagtgcgacgccggctggctgagcgaccagaccgtgagataccccatccagacccccagagaggcctgctacggcgacatggacggcttccccggcgtgagaaactacggcgtggtggaccccgacgacctgtacgacgtgtactgctacgccgaggacctgaacggcgagctgttcctgggcgacccccccgagaagctgaccctggaggaggccagagcctactgccaggagagaggcgccgagatcgccaccaccggccagctgtacgccgcctgggacggcggcctggaccactgcagccccggctggctggccgacggcagcgtgagataccccatcgtgacccccagccagagatgcggcggcggcctgcccggcgtgaagaccctgttcctgttccccaaccagaccggcttccccaacaagcacagcagattcaacgtgtactgcttcagagacagcgcccagcccagcgccatccccgaggccagcaaccccgccagcaaccccgccagcgacggcctggaggccatcgtgaccgtgaccgagaccctggaggagctgcagctgccccaggaggccaccgagagcgagagcagaggcgccatctacagcatccccatcatggaggacggcggcggcggcagcagcacccccgaggaccccgccgaggcccccagaaccctgctggagttcgagacccagagcatggtgccccccaccggcttcagcgaggaggagggcaaggccctggaggaggaggagaagtacgaggacgaggaggagaaggaggaggaggaggaggaggaggaggtggaggacgaggccctgtgggcctggcccagcgagctgagcagccccggccccgaggccagcctgcccaccgagcccgccgcccaggaggagagcctgagccaggcccccgccagagccgtgctgcagcccggcgccagccccctgcccgacggcgagagcgaggccagcagaccccccagagtgcacggcccccccaccgagaccctgcccacccccagagagagaaacctggccagccccagccccagcaccctggtggaggccagagaggtgggcgaggccaccggcggccccgagctgagcggcgtgcccagaggcgagagcgaggagaccggcagcagcgagggcgcccccagcctgctgcccgccaccagagcccccgagggcaccagagagctggaggcccccagcgaggacaacagcggcagaaccgcccccgccggcaccagcgtgcaggcccagcccgtgctgcccaccgacagcgccagcagaggcggcgtggccgtggtgcccgccagcggcaacagcgcccagggcagcaccgccctgagcatcctgctgctgttcttccccctgcagctgtgggtgacctag

SEQ ID NO: 4015 - DNA, 375 bp, Artificial Sequence
  Description of Artificial Sequence: Synthetic coding sequence
atgtacaagctggccagctgctgcctgctgttcatcggcttcctgaaccccctgctgagcctgcccctgctggacagcagagagatcagcttccagctgagcgccccccacgaggacgccagactgacccccgaggagctggagagagccagcctgctgcagatcctgcccgagatgctgggcgccgagagaggcgacatcctgagaaaggccgacagcagcaccaacatcttcaaccccagaggcaacctgagaaagttccaggacttcagcggccaggaccccaacatcctgctgagccacctgctggccagaatctggaagccctacaagaagagagagacccccgactgcttctggaagtactgcgtgtag

SEQ ID NO: 4016 - DNA, 1326 bp, Artificial Sequence
  Description of Artificial Sequence: Synthetic coding sequence
atggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggtgctggagagccaccccagaaccagaagccccggcctggtgggcatcagacccacccccctgcccgtgagccccatggccctgagatgctgcagccccatccagcccaccgccagcttctggcccctgacccccgtgcccctggaggccagagcccccccccacccccccggccccaacccccccacccccagaggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaacttcgtgcacttctggggcgagagacacagattcctgcactag

SEQ ID NO: 4017 - DNA, 1950 bp, Artificial Sequence
  Description of Artificial Sequence: Synthetic coding sequence
atgcagcaggacggcctgggcgtgggcaccagaaacggcagcggcaagggcagaagcgtgcaccccagctggccctggtgcgcccccagacccctgagatacttcggcagagacgccagagccagaagagcccagaccgccgccatggccctgctggccggcggcctgagcagaggcctgggcagccaccccgccgccgccggcagagacgccgtggtgttcgtgtggctgctgctgagcacctggtgcaccgcccccgccagagccatccaggtgaccgtgagcaacccctaccacgtggtgatcctgttccagcccgtgaccctgccctgcacctaccagatgaccagcacccccacccagcccatcgtgatctggaagtacaagagcttctgcagagacagaatcgccgacgccttcagccccgccagcgtggacaaccagctgaacgcccagctggccgccggcaaccccggctacaacccctacgtggagtgccaggacagcgtgagaaccgtgagagtggtggccaccaagcagggcaacgccgtgaccctgggcgactactaccagggcagaagaatcaccatcaccggcaacgccgacctgaccttcgaccagaccgcctggggcgacagcggcgtgtactactgcagcgtggtgagcgcccaggacctgcagggcaacaacgaggcctacgccgagctgatcgtgctgggcagaaccagcggcgtggccgagctgctgcccggcttccaggccggccccatcgaggactggctgttcgtggtggtggtgtgcctggccgccttcctgatcttcctgctgctgggcatctgctggtgccagtgctgcccccacacctgctgctgctacgtgagatgcccctgctgccccgacaagtgctgctgccccgaggccctgtacgccgccggcaaggccgccaccagcggcgtgcccagcatctacgcccccagcacctacgcccacctgagccccgccaagaccccccccccccccgccatgatccccatgggccccgcctacaacggctaccccggcggctaccccggcgacgtggacagaagcagcagcgccggcggccagggcagctacgtgcccctgctgagagacaccgacagcagcgtggccagcgaggtgagaagcggctacagaatccaggccagccagcaggacgacagcatgagagtgctgtactacatggagaaggagctggccaacttcgaccccagcagacccggcccccccagcggcagagtggagagagccatgagcgaggtgaccagcctgcacgaggacgactggagaagcagacccagcagaggccccgccctgacccccatcagagacgaggagtggggcggccacagccccagaagccccagaggctgggaccaggagcccgccagagagcaggccggcggcggctggagagccagaagacccagagccagaagcgtggacgccctggacgacctgaccccccccagcaccgccgagagcggcagcagaagccccaccagcaacggcggcagaagcagagcctacatgccccccagaagcagaagcagagacgacctgtacgaccaggacgacagcagagacttccccagaagcagagacccccactacgacgacttcagaagcagagagagaccccccgccgaccccagaagccaccaccacagaaccagagaccccagagacaacggcagcagaagcggcgacctgccctacgacggcagactgctggaggaggccgtgagaaagaagggcagcgaggagagaagaagaccccacaaggaggaggaggaggaggcctactacccccccgccccccccccctacagcgagaccgacagccaggccagcagagagagaagactgaagaagaacctggccctgagcagagagagcctggtggtgtag

SEQ ID NO: 4018 - DNA, 402 bp, Artificial Sequence
  Description of Artificial Sequence: Synthetic coding sequence
atgagcgagagagtggagagaaactggagcaccggcggctggctgctggccctgtgcctggcctggctgtggacccacctgaccctggccgccctgcagccccccaccgccaccgtgctggtgcagcagggcacctgcgaggtgatcgccgcccacagatgctgcaacagaaacagaatcgaggagagaagccagaccgtgaagtgcagctgcttcagcggccaggtggccggcaccaccagagccaagcccagctgcgtggacgccagcatcgtgctgcagagatggtggtgccagatggagccctgcctgcccggcgaggagtgcaaggtgctgcccgacctgagcggctggagctgcagcagcggccacaaggtgaagaccaccaaggtgaccagatag

SEQ ID NO: 4019 - DNA, 699 bp, Artificial Sequence
  Description of Artificial Sequence: Synthetic coding sequence
atggtggccgccaacaccagagcccccgaggacaccagagcccccgccggccccaagcccagcagctgcgagtgggccgtgtgctgggcccccgccagatgcagaatcagcgccaccgcctgcggcaacagctgggacagacccgccggcagaacccagctgctgtggacccccgccgcccccaccgccatggccgaggtgggccccggccacacccccgcccaccccagccagggcgccgtgccccccagcagagccgccgccgagccccacctgaagcccagccccagcgagctgcagaccgccggccccgccgccaccatccccgccagactgtgcaccagaaagcccagactggtgtacacccagtgctggtacgtgaaggagcccaagcaccccgagatcgtgaccccctggggcaccgccgccagacacagctggagacagcaccagatgctgagcgccagcgagagaagatgcctgcccagagacgtggagcagaagctgggccccgagcacaccggcccctgcctggacgagcagggcagagaggccgagctggccagaagcggccccagcgccgccggccccgtgagactgaagcccggcctggtgcccggcctgttcctgctgagctgcaccaccagccccagcacctgcctgcccgtgggccaggagggcgagagaggcatgctgtag

SEQ ID NO: 4020 - DNA, 711 bp, Artificial Sequence
  Description of Artificial Sequence: Synthetic coding sequence
atgtgcgtgacctaccacaacggcaccggctactgcaagtgccccgagggcttcctgggcgagtactgccagcacagagacccctgcgagaagaacagatgccagaacggcggcacctgcgtggcccaggccatgctgggcaaggccacctgcagatgcgccagcggcttcaccggcgaggactgccagtacagcaccagccacccctgcttcgtgagcagaccctgcctgaacggcggcacctgccacatgctgagcagagacacctacgagtgcacctgccaggtgggcttcaccggcaaggagtgccagtggaccgacgcctgcctgagccacccctgcgccaacggcagcacctgcaccaccgtggccaaccagttcagctgcaagtgcctgaccggcttcaccggccagaagtgcgagaccgacgtgaacgagtgcgacatccccggccactgccagcacggcggcacctgcctgaacctgcccggcagctaccagtgccagtgcctgcagggcttcaccggccagtactgcgacagcctgtacgtgccctgcgcccccagcccctgcgtgaacggcggcacctgcagacagaccggcgacttcaccttcgagtgcaactgcctgcccgagaccgtgagaagaggcaccgagctgtgggagagagacagagaggtgtggaacggcaaggagcacgacgagaactag

SEQ ID NO: 4021 - DNA, 204 bp, Artificial Sequence
  Description of Artificial Sequence: Synthetic coding sequence
atggacaacgtgcagcccaagatcaagcacagacccttctgcttcagcgtgaagggccacgtgaagatgctgagactggtgttcgccctggtgaccgccgtgtgctgcctggccgacggcgccctgatctacagaaagctgctgttcaaccccagcggcccctaccagaagaagcccgtgcacgagaagaaggaggtgctgtag

SEQ ID NO: 4022 - DNA, 75 bp, Artificial Sequence
  Description of Artificial Sequence: Synthetic coding sequence
atgctggtggacggccccagcgagagacccgccctgtgcttcctgctgctggccgtggccatgagcttcttctag

SEQ ID NO: 4023 - DNA, 3345 bp, Artificial Sequence
  Description of Artificial Sequence: Synthetic coding sequence
atgctggccagcagcagcagaatcagagccgcctggaccagagccctgctgctgcccctgctgctggccggccccgtgggctgcctgagcagacaggagctgttccccttcggccccggccagggcgacctggagctggaggacggcgacgacttcgtgagccccgccctggagctgagcggcgccctgagattctacgacagaagcgacatcgacgccgtgtacgtgaccaccaacggcatcatcgccaccagcgagccccccgccaaggagagccaccccggcctgttcccccccaccttcggcgccgtggcccccttcctggccgacctggacaccaccgacggcctgggcaaggtgtactacagagaggacctgagccccagcatcacccagagagccgccgagtgcgtgcacagaggcttccccgagatcagcttccagcccagcagcgccgtggtggtgacctgggagagcgtggccccctaccagggccccagcagagaccccgaccagaagggcaagagaaacaccttccaggccgtgctggccagcagcgacagcagcagctacgccatcttcctgtaccccgaggacggcctgcagttccacaccaccttcagcaagaaggagaacaaccaggtgcccgccgtggtggccttcagccagggcagcgtgggcttcctgtggaagagcaacggcgcctacaacatcttcgccaacgacagagagagcgtggagaacctggccaagagcagcaacagcggccagcagggcgtgtgggtgttcgagatcggcagccccgccaccaccaacggcgtggtgcccgccgacgtgatcctgggcaccgaggacggcgccgagtacgacgacgaggacgaggactacgacctggccaccaccagactgggcctggaggacgtgggcaccacccccttcagctacaaggccctgagaagaggcggcgccgacacctacagcgtgcccagcgtgctgagccccagaagagccgccaccgagagacccctgggcccccccaccgagagaaccagaagcttccagctggccgtggagaccttccaccagcagcacccccaggtgatcgacgtggacgaggtggaggagaccggcgtggtgttcagctacaacaccgacagcagacagacctgcgccaacaacagacaccagtgcagcgtgcacgccgagtgcagagactacgccaccggcttctgctgcagctgcgtggccggctacaccggcaacggcagacagtgcgtggccgagggcagcccccagagagtgaacggcaaggtgaagggcagaatcttcgtgggcagcagccaggtgcccatcgtgttcgagaacaccgacctgcacagctacgtggtgatgaaccacggcagaagctacaccgccatcagcaccatccccgagaccgtgggctacagcctgctgcccctggcccccgtgggcggcatcatcggctggatgttcgccgtggagcaggacggcttcaagaacggcttcagcatcaccggcggcgagttcaccagacaggccgaggtgaccttcgtgggccaccccggcaacctggtgatcaagcagagattcagcggcatcgacgagcacggccacctgaccatcgacaccgagctggagggcagagtgccccagatccccttcggcagcagcgtgcacatcgagccctacaccgagctgtaccactacagcaccagcgtgatcaccagcagcagcaccagagagtacaccgtgaccgagcccgagagagacggcgccagccccagcagaatctacacctaccagtggagacagaccatcaccttccaggagtgcgtgcacgacgacagcagacccgccctgcccagcacccagcagctgagcgtggacagcgtgttcgtgctgtacaaccaggaggagaagatcctgagatacgccctgagcaacagcatcggccccgtgagagagggcagccccgacgccctgcagaacccctgctacatcggcacccacggctgcgacaccaacgccgcctgcagacccggccccagaacccagttcacctgcgagtgcagcatcggcttcagaggcgacggcagaacctgctacgaggtggagaagaccagatgccagcacgagagagagcacatcctgggcgccgccggcgccaccgacccccagagacccatcccccccggcctgttcgtgcccgagtgcgacgcccacggccactacgcccccacccagtgccacggcagcaccggctactgctggtgcgtggacagagacggcagagaggtggagggcaccagaaccagacccggcatgacccccccctgcctgagcaccgtggccccccccatccaccagggccccgccgtgcccaccgccgtgatccccctgccccccggcacccacctgctgttcgcccagaccggcaagatcgagagactgcccctggagggcaacaccatgagaaagaccgaggccaaggccttcctgcacgtgcccgccaaggtgatcatcggcctggccttcgactgcgtggacaagatggtgtactggaccgacatcaccgagcccagcatcggcagagccagcctgcacggcggcgagcccaccaccatcatcagacaggacctgggcagccccgagggcatcgccgtggaccacctgggcagaaacatcttctggaccgacagcaacctggacagaatcgaggtggccaagctggacggcacccagagaagagtgctgttcgagaccgacctggtgaaccccagaggcatcgtgaccgacagcgtgagaggcaacctgtactggaccgactggaacagagacaaccccaagatcgagaccagctacatggacggcaccaacagaagaatcctggtgcaggacgacctgggcctgcccaacggcctgaccttcgacgccttcagcagccagctgtgctgggtggacgccggcaccaacagagccgagtgcctgaaccccagccagcccagcagaagaaaggccctggagggcctgcagtaccccttcgccgtgaccagctacggcaagaacctgtacttcaccgactggaagatgaacagcgtggtggccctggacctggccatcagcaaggagaccgacgccttccagccccacaagcagaccagactgtacggcatcaccaccgccctgagccagtgcccccagggccacaactactgcagcgtgaacaacggcggctgcacccacctgtgcctggccacccccggcagcagaacctgcagatgccccgacaacaccctgggcgtggactgcatcgagcagaagtag

SEQ ID NO: 4024 - DNA, 2172 bp, Artificial Sequence
  Description of Artificial Sequence: Synthetic coding sequence
atgggcagcagatgcgccctggccctggccgtgctgagcgccctgctgtgccaggtgtggagcagcggcgtgttcgagctgaagctgcaggagttcgtgaacaagaagggcctgctgggcaacagaaactgctgcagaggcggcgccggcccccccccctgcgcctgcagaaccttcttcagagtgtgcctgaagcactaccaggccagcgtgagccccgagcccccctgcacctacggcagcgccgtgacccccgtgctgggcgtggacagcttcagcctgcccgacggcggcggcgccgacagcgccttcagcaaccccatcagattccccttcggcttcacctggcccggcaccttcagcctgatcatcgaggccctgcacaccgacagccccgacgacctggccaccgagaaccccgagagactgatcagcagactggccacccagagacacctgaccgtgggcgaggagtggagccaggacctgcacagcagcggcagaaccgacctgaagtacagctacagattcgtgtgcgacgagcactactacggcgagggctgcagcgtgttctgcagacccagagacgacgccttcggccacttcacctgcggcgagagaggcgagaaggtgtgcaaccccggctggaagggcccctactgcaccgagcccatctgcctgcccggctgcgacgagcagcacggcttctgcgacaagcccggcgagtgcaagtgcagagtgggctggcagggcagatactgcgacgagtgcatcagataccccggctgcctgcacggcacctgccagcagccctggcagtgcaactgccaggagggctggggcggcctgttctgcaaccaggacctgaactactgcacccaccacaagccctgcaagaacggcgccacctgcaccaacaccggccagggcagctacacctgcagctgcagacccggctacaccggcgccacctgcgagctgggcatcgacgagtgcgaccccagcccctgcaagaacggcggcagctgcaccgacctggagaacagctacagctgcacctgcccccccggcttctacggcaagatctgcgagctgagcgccatgacctgcgccgacggcccctgcttcaacggcggcagatgcagcgacagccccgacggcggctacagctgcagatgccccgtgggctacagcggcttcaactgcgagaagaagatcgactactgcagcagcagcccctgcagcaacggcgccaagtgcgtggacctgggcgacgcctacctgtgcagatgccaggccggcttcagcggcagacactgcgacgacaacgtggacgactgcgccagcagcccctgcgccaacggcggcacctgcagagacggcgtgaacgacttcagctgcacctgcccccccggctacaccggcagaaactgcagcgcccccgtgagcagatgcgagcacgccccctgccacaacggcgccacctgccacgagagaggccacagatacgtgtgcgagtgcgccagaggctacggcggccccaactgccagttcctgctgcccgagctgccccccggccccgccgtggtggacctgaccgagaagctggagggccagggcggccccttcccctgggtggccgtgtgcgccggcgtgatcctggtgctgatgctgctgctgggctgcgccgccgtggtggtgtgcgtgagactgagactgcagaagcacagaccccccgccgacccctgcagaggcgagaccgagaccatgaacaacctggccaactgccagagagagaaggacatcagcgtgagcatcatcggcgccacccagatcaagaacaccaacaagaaggccgacttccacggcgaccacagcgccgacaagaacggcttcaaggccagataccccgccgtggactacaacctggtgcaggacctgaagggcgacgacaccgccgtgagagacgcccacagcaagagagacaccaagtgccagccccagggcagcagcggcgaggagaagggcacccccaccaccctgagaggcggcgaggccagcgagagaaagagacccgacagcggctgcagcaccagcaaggacaccaagtaccagagcgtgtacgtgatcagcgaggagaaggacgagtgcgtgatcgccaccgaggtgtag

SEQ ID NO: 4025 - DNA, 981 bp, Artificial Sequence
  Description of Artificial Sequence: Synthetic coding sequence
atggccgcccccgccagcgtgatgggccccctgggccccagcgccctgggcctgctgctgctgctgctggtggtggccccccccagagtggccgccctggtgcacagacagcccgagaaccagggcatcagcctgaccggcagcgtggcctgcggcagacccagcatggagggcaagatcctgggcggcgtgcccgcccccgagagaaagtggccctggcaggtgagcgtgcactacgccggcctgcacgtgtgcggcggcagcatcctgaacgagtactgggtgctgagcgccgcccactgcttccacagagacaagaacatcaagatctacgacatgtacgtgggcctggtgaacctgagagtggccggcaaccacacccagtggtacgaggtgaacagagtgatcctgcaccccacctacgagatgtaccaccccatcggcggcgacgtggccctggtgcagctgaagaccagaatcgtgttcagcgagagcgtgctgcccgtgtgcctggccacccccgaggtgaacctgaccagcgccaactgctgggccaccggctggggcctggtgagcaagcagggcgagaccagcgacgagctgcaggagatgcagctgcccctgatcctggagccctggtgccacctgctgtacggccacatgagctacatcatgcccgacatgctgtgcgccggcgacatcctgaacgccaagaccgtgtgcgagggcgacagcggcggccccctggtgtgcgagttcaacagaagctggctgcagatcggcatcgtgagctggggcagaggctgcagcaaccccctgtaccccggcgtgtacgccagcgtgagctacttcagcaagtggatctgcgacaacatcgagatcacccccacccccgcccagcccgcccccgccctgagccccgccctgggccccaccctgagcgtgctgatggccatgctggccggctggagcgtgctgtag

SEQ ID NO: 4026 - DNA, 1596 bp, Artificial Sequence
  Description of Artificial Sequence: Synthetic coding sequence
atgagcctggccgcctactgcgtgatctgctgcagaagaatcggcaccagcaccagcccccccaagagcggcacccactggagagacatcagaaacatcatcaagttcaccggcagcctgatcctgggcggcagcctgttcctgacctacgaggtgctggccctgaagaaggccgtgaccctggacacccaggtggtggagagagagaagatgaagagctacatctacgtgcacaccgtgagcctggacaagggcgagaaccacggcatcgcctggcaggccagaaaggagctgcacaaggccgtgagaaaggtgctggccaccagcgccaagatcctgagaaaccccttcgccgaccccttcagcaccgtggacatcgaggaccacgagtgcgccgtgtggctgctgctgagaaagagcaagagcgacgacaagaccaccagactggaggccgtgagagagatgagcgagacccaccactggcacgactaccagtacagaatcatcgcccaggcctgcgaccccaagaccctgatcggcctggccagaagcgaggagagcgacctgagattcttcctgctgcccccccccctgcccagcctgaaggaggacagcagcaccgaggaggagctgagacagctgctggccagcctgccccagaccgagctggacgagtgcatccagtacttcaccagcctggccctgagcgagagcagccagagcctggccgcccagaagggcggcctgtggtgcttcggcggcaacggcctgccctacgccgagagcttcggcgaggtgcccagcgccaccgtggagatgttctgcctggaggccatcgtgaagcacagcgagatcagcacccactgcgacaagatcgaggccaacggcggcctgcagctgctgcagagactgtacagactgcacaaggactgccccaaggtgcagagaaacatcatgagagtgatcggcaacatggccctgaacgagcacctgcacagcagcatcgtgagaagcggctgggtgagcatcatggccgaggccatgaagagcccccacatcatggagagcagccacgccgccagaatcctggccaacctggacagagagaccgtgcaggagaagtaccaggacggcgtgtacgtgctgcacccccagtacagaaccagccagcccatcaaggccgacgtgctgttcatccacggcctgatgggcgccgccttcaagacctggagacagcaggacagcgagcaggccgtgatcgagaagcccatggaggacgaggacagatacaccacctgctggcccaagacctggctggccaaggactgccccgccctgagaatcatcagcgtggagtacgacaccagcctgagcgactggagagccagatgccccatggagagaagaagcctgctgagcatcagcagcggcatcgtggagggcctggagagccccctgcacagcgaggccaccaacttcctgggcagcagcgagctgctggtgctgggcatcggccagtggttcggctaccacatcgcctgggaggtgttcctgagcaagagatgctgctggaagcccctgagaagccagaagtag

SEQ ID NO: 4027 - DNA, 1596 bp, Artificial Sequence; identical to SEQ ID NO: 4026
  Description of Artificial Sequence: Synthetic coding sequence

SEQ ID NO: 4028 - DNA, 1965 bp, Artificial Sequence
  Description of Artificial Sequence: Synthetic coding sequence
atgagcctggccgcctactgcgtgatctgctgcagaagaatcggcaccagcaccagcccccccaagagcggcacccactggagagacatcagaaacatcatcaagttcaccggcagcctgatcctgggcggcagcctgttcctgacctacgaggtgctggccctgaagaaggccgtgaccctggacacccaggtggtggagagagagaagatgaagagctacatctacgtgcacaccgtgagcctggacaagggcgagaaccacggcatcgcctggcaggccagaaaggagctgcacaaggccgtgagaaaggtgctggccaccagcgccaagatcctgagaaaccccttcgccgaccccttcagcaccgtggacatcgaggaccacgagtgcgccgtgtggctgctgctgagaaagagcaagagcgacgacaagaccaccagactggaggccgtgagagagatgagcgagacccaccactggcacgactaccagtacagaatcatcgcccaggcctgcgaccccaagaccctgatcggcctggccagaagcgaggagagcgacctgagattcttcctgctgcccccccccctgcccagcctgaaggaggacagcagcaccgaggaggagctgagacagctgctggccagcctgccccagaccgagctggacgagtgcatccagtacttcaccagcctggccctgagcgagagcagccagagcctggccgcccagaagggcggcctgtggtgcttcggcggcaacggcctgccctacgccgagagcttcggcgaggtgcccagcgccaccgtggagatgttctgcctggaggccatcgtgaagcacagcgagatcagcacccactgcgacaagatcgaggccaacggcggcctgcagctgctgcagagactgtacagactgcacaaggactgccccaaggtgcagagaaacatcatgagagtgatcggcaacatggccctgaacgagcacctgcacagcagcatcgtgagaagcggctgggtgagcatcatggccgaggccatgaagagcccccacatcatggagagcagccacgccgccagaatcctggccaacctggacagagagaccgtgcaggagaagtaccaggacggcgtgtacgtgctgcacccccagtacagaaccagccagcccatcaaggccgacgtgctgttcatccacggcctgatgggcgccgccttcaagacctggagacagcaggacagcgagcaggccgtgatcgagaagcccatggaggacgaggacagatacaccacctgctggcccaagacctggctggccaaggactgccccgccctgagaatcatcagcgtggagtacgacaccagcctgagcgactggagagccagatgccccatggagagaaagagcatcgccttcagaagcaacgagctgctgagaaagctgagagccgccggcgtgggcgacagacccgtggtgtggatcagccacagcatgggcggcctgctggtgaagaagatgctgctggaggccagcaccaagcccgagatgagcaccgtgatcaacaacaccagaggcatcatcttctacagcgtgccccaccacggcagcagactggccgagtacagcgtgaacatcagatacctgctgttccccagcctggaggtgaaggagctgagcaaggacagccccgccctgaagaccctgcaggacgacttcctggagttcgccaaggacaagaacttccaggtgctgaacttcgtggagaccctgcccacctacatcggcagcatgatcaagctgcacgtggtgcccgtggagagcgccgacctgggcatcggcgacctgatccccgtggacgtgaaccacctgaacatctgcaagcccaagaagaaggacgccttcctgtaccagagaaccctgcagttcatcagagaggccctggccaaggacctggagaactag

SEQ ID NO: 4029 - DNA, 1509 bp, Artificial Sequence
  Description of Artificial Sequence: Synthetic coding sequence
atggcccagagatgcgtgtgcgtgctggccctggtggccatgctgctgctggtgttccccaccgtgagcagaagcatgggccccagaagcggcgagcaccagagagccagcagaatccccagccagttcagcaaggaggagagagtggccatgaaggaggccctgaagggcgccatccagatccccaccgtgaccttcagcagcgagaagagcaacaccaccgccctggccgagttcggcaagtacatccacaaggtgttccccaccgtggtgagcaccagcttcatccagcacgaggtggtggaggagtacagccacctgttcaccatccagggcagcgaccccagcctgcagccctacctgctgatggcccacttcgacgtggtgcccgcccccgaggagggctgggaggtgccccccttcagcggcctggagagagacggcatcatctacggcagaggcaccctggacgacaagaacagcgtgatggccctgctgcaggccctggagctgctgctgatcagaaagtacatccccagaagaagcttcttcatcagcctgggccacgacgaggagagcagcggcaccggcgcccagagaatcagcgccctgctgcagagcagaggcgtgcagctggccttcatcgtggacgagggcggcttcatcctggacgacttcatccccaacttcaagaagcccatcgccctgatcgccgtgagcgagaagggcagcatgaacctgatgctgcaggtgaacatgaccagcggccacagcagcgccccccccaaggagaccagcatcggcatcctggccgccgccgtgagcagactggagcagacccccatgcccatcatcttcggcagcggcaccgtggtgaccgtgctgcagcagctggccaacgagttccccttccccgtgaacatcatcctgagcaacccctggctgttcgagcccctgatcagcagattcatggagagaaaccccctgaccaacgccatcatcagaaccaccaccgccctgaccatcttcaaggccggcgtgaagttcaacgtgatcccccccgtggcccaggccaccgtgaacttcagaatccaccccggccagaccgtgcaggaggtgctggagctgaccaagaacatcgtggccgacaacagagtgcagttccacgtgctgagcgccttcgaccccctgcccgtgagccccagcgacgacaaggccctgggctaccagctgctgagacagaccgtgcagagcgtgttccccgaggtgaacatcaccgcccccgtgaccagcatcggcaacaccgacagcagattcttcaccaacctgaccaccggcatctacagattctaccccatctacatccagcccgaggacttcaagagaatccacggcgtgaacgagaagatcagcgtgcaggcctacgagacccaggtgaagttcatcttcgagctgatccagaacgccgacaccgaccaggagcccgtgagccacctgcacaagctgtag

SEQ ID NO: 4030 - DNA, 999 bp, Artificial Sequence
  Description of Artificial Sequence: Synthetic coding sequence
atgagactgctggccttcctgagcctgctggccctggtgctgcaggagaccggcaccgccagcctgcccagaaaggagagaaagagaagagaggagcagatgcccagagagggcgacagcttcgaggtgctgcccctgagaaacgacgtgctgaaccccgacaactacggcgaggtgatcgacctgagcaactacgaggagctgaccgactacggcgaccagctgcccgaggtgaaggtgaccagcctggcccccgccaccagcatcagccccgccaagagcaccaccgcccccggcacccccagcagcaaccccaccatgaccagacccaccaccgccggcctgctgctgagcagccagcccaaccacggcctgcccacctgcctggtgtgcgtgtgcctgggcagcagcgtgtactgcgacgacatcgacctggaggacatcccccccctgcccagaagaaccgcctacctgtacgccagattcaacagaatcagcagaatcagagccgaggacttcaagggcctgaccaagctgaagagaatcgacctgagcaacaacctgatcagcagcatcgacaacgacgccttcagactgctgcacgccctgcaggacctgatcctgcccgagaaccagctggaggccctgcccgtgctgcccagcggcatcgagttcctggacgtgagactgaacagactgcagagcagcggcatccagcccgccgccttcagagccatggagaagctgcagttcctgtacctgagcgacaacctgctggacagcatccccggccccctgcccctgagcctgagaagcgtgcacctgcagaacaacctgatcgagaccatgcagagagacgtgttctgcgaccccgaggagcacaagcacaccagaagacagctggaggacatcagactggacggcaaccccatcaacctgagcctgttccccagcgcctacttctgcctgcccagactgcccatcggcagattcacctag

SEQ ID NO: 4031 - DNA, 1401 bp, Artificial Sequence
  Description of Artificial Sequence: Synthetic coding sequence
atggtgagaagcgtggcctgggccggcttcatggtgctgctgatgatcccctggggcagcgccgccaagctggtgtgctacttcaccaactgggcccagtacagacagggcgaggccagattcctgcccaaggacctggaccccagcctgtgcacccacctgatctacgccttcgccggcatgaccaaccaccagctgagcaccaccgagtggaacgacgagaccctgtaccaggagttcaacggcctgaagaagatgaaccccaagctgaagaccctgctggccatcggcggctggaacttcggcacccagaagttcaccgacatggtggccaccgccaacaacagacagaccttcgtgaacagcgccatcagattcctgagaaagtacagcttcgacggcctggacctggactgggagtaccccggcagccagggcagccccgccgtggacaaggagagattcaccaccctggtgcaggacctggccaacgccttccagcaggaggcccagaccagcggcaaggagagactgctgctgagcgccgccgtgcccgccggccagacctacgtggacgccggctacgaggtggacaagatcgcccagaacctggacttcgtgaacctgatggcctacgacttccacggcagctgggagaaggtgaccggccacaacagccccctgtacaagagacaggaggagagcggcgccgccgccagcctgaacgtggacgccgccgtgcagcagtggctgcagaagggcacccccgccagcaagctgatcctgggcatgcccacctacggcagaagcttcaccctggccagcagcagcgacaccagagtgggcgcccccgccaccggcagcggcacccccggccccttcaccaaggagggcggcatgctggcctactacgaggtgtgcagctggaagggcgccaccaagcagagaatccaggaccagaaggtgccctacatcttcagagacaaccagtgggtgggcttcgacgacgtggagagcttcaagaccaaggtgagctacctgaagcagaagggcctgggcggcgccatggtgtgggccctggacctggacgacttcgccggcttcagctgcaaccagggcagataccccctgatccagaccctgagacaggagctgagcctgccctacctgcccagcggcacccccgagctggaggtgcccaagcccggccagcccagcgagcccgagcacggccccagccccggccaggacaccttctgccagggcaaggccgacggcctgtaccccaaccccagagagagaagcagcttctacagctgcgccgccggcagactgttccagcagagctgccccaccggcctggtgttcagcaacagctgcaagtgctgcacctggaactag

SEQ ID NO: 4032 - DNA, 1596 bp, Artificial Sequence
  Description of Artificial Sequence: Synthetic coding sequence
atgagactgtgcctgggcagaccccaccccagaggccacagcagagtgggcaagagcgagagaggcagaggcgccagaggcctggccagacagagaaccctggaggacgaggaggagcaggagagagagagaagaagaagacacagaaacctgagcagcaccaccgacgacgaggcccccagactgagccagaacggcgacagacaggccagcgccagcgagagactgcccagcgtggaggaggccgaggtgcccaagcccctgccccccgccagcaaggacgaggacgaggacatccagagcatcctgagaaccagacaggagagaagacagagaagacaggtggtggaggccgcccaggcccccatccaggagagactggaggccgaggagggcagaaacagcctgagccccgtgcaggccacccagaagcccctggtgagcaagaaggagctggagatcccccccagaagaagactgagcagagagcagagaggcccctgggccctggaggaggagagcctggtgggcagagagcccgaggagagaaagaagggcgtgcccgagaagagccccgtgctggagaagagcagcatgcccaagaagaccgcccccgagaagagcctggtgagcgacaagaccagcatcagcgagaaggtgctggccagcgagaagaccagcctgagcgagaagatcgccgtgagcgagaagagaaacagcagcgagaagaagagcgtgctggagaagaccagcgtgagcgagaagagcctggcccccggcatggccctgggcagcggcagaagactggtgagcgagaaggccagcatcttcgagaaggccctggccagcgagaagagccccaccgccgacgccaagcccgcccccaagagagccaccgccagcgagcagcccctggcccaggagccccccgccagcggcggcagccccgccaccaccaaggagcagagaggcagagccctgcccggcaagaacctgcccagcctggccaagcagggcgccagcgacccccccaccgtggccagcagactgccccccgtgaccctgcaggtgaagatccccagcaaggaggaggaggccgacatgagcagccccacccagagaacctacagcagcagcctgaagagaagcagccccagaaccatcagcttcagaatgaagcccaagaaggagaacagcgagaccaccctgaccagaagcgccagcatgaagctgcccgacaacaccgtgaagctgggcgagaagctggagagataccacaccgccatcagaagaagcgagagcgtgaagagcagaggcctgccctgcaccgagctgttcgtggcccccgtgggcgtggccagcaagagacacctgttcgagaaggagctggccggccagagcagagccgagcccgccagcagcagaaaggagaacctgagactgagcggcgtggtgaccagcagactgaacctgtggatcagcagaacccaggagagcggcgaccaggacccccaggaggcccagaaggccagcagcgccaccgagagaacccagtggggccagaagagcgacagcagcctggacgccgaggtgtag

SEQ ID NO: 4033 - DNA, 1782 bp, Artificial Sequence
  Description of Artificial Sequence: Synthetic coding sequence
atgaaggccgacctgaagcagcaccaccaccactggagcatcttcagctacatcagactgagactgcccagcatgctgctgctgttcagcgtgatcctgatcagctgggtgagcaccgtgggcggcgagggcaccctgtgcgacttccccaagatccaccacggcttcctgtacgacgaggaggactacaaccccttcagccaggtgcccaccggcgaggtgttctactacagctgcgagtacaacttcgtgagccccagcaagagcttctggaccagaatcacctgcaccgaggagggctggagccccacccccaagtgcctgagaatgtgcagcttccccttcgtgaagaacggccacagcgagagcagcggcctgatccacctggagggcgacaccgtgcagatcatctgcaacaccggctacagcctgcagaacaacgagaagaacatcagctgcgtggagagaggctggagcaccccccccatctgcagcttcaccaagggcgagtgccacgtgcccatcctggaggccaacgtggacgcccagcccaagaaggagagctacaaggtgggcgacgtgctgaagttcagctgcagaaagaacctgatcagagtgggcagcgacagcgtgcagtgctaccagttcggctggagccccaacttccccacctgcaagggccaggtgagaagctgcggcccccccccccagctgagcaacggcgaggtgaaggagatcagaaaggaggagtacggccacaacgaggtggtggagtacgactgcaaccccaacttcatcatcaacggccccaagaagatccagtgcgtggacggcgagtggaccaccctgcccacctgcgtggagcaggtgaagacctgcggctacatccccgagctggagtacggctacgtgcagcccagcgtgcccccctaccagcacggcgtgagcgtggaggtgaactgcagaaacgagtacgccatgatcggcaacaacatgatcacctgcatcaacggcatctggaccgagctgcccatgtgcgtggccacccaccagctgaagagatgcaagatcgccggcgtgaacatcaagaccctgctgaagctgagcggcaaggagttcaaccacaacagcagaatcagatacagatgcagcgacatcttcagatacagacacagcgtgtgcatcaacggcaagtggaaccccgaggtggactgcaccgagaagagagagcagttctgccccccccccccccagatccccaacgcccagaacatgaccaccaccgtgaactaccaggacggcgagaaggtggccgtgctgtgcaaggagaactacctgctgcccgaggccaaggagatcgtgtgcaaggacggcagatggcagagcctgcccagatgcgtggagagcaccgcctactgcggccccccccccagcatcaacaacggcgacaccaccagcttccccctgagcgtgtacccccccggcagcaccgtgacctacagatgccagagcttctacaagctgcagggcagcgtgaccgtgacctgcagaaacaagcagtggagcgagccccccagatgcctggacccctgcgtggtgagcgaggagaacatgaacaagaacaacatccagctgaagtggagaaacgacggcaagctgtacgccaagaccggcgacgccgtggagttccagtgcaagttcccccacaaggccatgatcagcagcccccccttcagagccatctgccaggagggcaagttcgagtaccccatctgcgagtag

SEQ ID NO: 4034 - DNA, 2301 bp, Artificial Sequence
  Description of Artificial Sequence: Synthetic coding sequence
atgatctggagaagcagagccggcgccgagctgttcagcctgatggccctgtgggagtggatcgccctgagcctgcactgctgggtgctggccgtggccgccgtgagcgaccagcacgccaccagccccttcgactggctgctgagcgacaagggccccttccacagaagccaggagtacaccgacttcgtggacagaagcagacagggcttcagcaccagatacaagatctacagagagttcggcagatggaaggtgaacaacctggccgtggagagaagaaacttcctgggcagccccctgcccctggcccccgagttcttcagaaacatcagactgctgggcagaagacccaccctgcagcagatcaccgagaacctgatcaagaagtacggcacccacttcctgctgagcgccaccctgggcggcgaggagagcctgaccatcttcgtggacaagagaaagctgagcaagagagccgagggcagcgacagcaccaccaacagcagcagcgtgaccctggagaccctgcaccagctggccgccagctacttcatcgacagagacagcaccctgagaagactgcaccacatccagatcgccagcaccgccatcaaggtgaccgagaccagaaccggccccctgggctgcagcaactacgacaacctggacagcgtgagcagcgtgctggtgcagagccccgagaacaagatccagctgcagggcctgcaggtgctgctgcccgactacctgcaggagagattcgtgcaggccgccctgagctacatcgcctgcaacagcgagggcgagttcatctgcaaggagaacgactgctggtgccactgcggccccaagttccccgagtgcaactgccccagcatggacatccaggccatggaggagaacctgctgagaatcaccgagacctggaaggcctacaacagcgacttcgaggagagcgacgagttcaagctgttcatgaagagactgcccatgaactacttcctgaacaccagcaccatcatgcacctgtggaccatggacagcaacttccagagaagatacgagcagctggagaacagcatgaagcagctgttcctgaaggcccagaagatcgtgcacaagctgttcagcctgagcaagagatgccacaagcagcccctgatcagcctgcccagacagagaaccagcacctactggctgaccagaatccagagcttcctgtactgcaacgagaacggcctgctgggcagcttcagcgaggagacccacagctgcacctgccccaacgaccaggtggtgtgcaccgccttcctgccctgcaccgtgggcgacgccagcgcctgcctgacctgcgcccccgacaacagaaccagatgcggcacctgcaacaccggctacatgctgagccagggcctgtgcaagcccgaggtggccgagagcaccgaccactacatcggcttcgagaccgacctgcaggacctggagatgaagtacctgctgcagaagaccgacagaagaatcgaggtgcacgccatcttcatcagcaacgacatgagactgaacagctggttcgaccccagctggagaaagagaatgctgctgaccctgaagagcaacaagtacaagagcagcctggtgcacatgatcctgggcctgagcctgcagatctgcctgaccaagaacagcaccctggagcccgtgctggccgtgtacgtgaaccccttcggcggcagccacagcgagagctggttcatgcccgtgaacgagaacagcttccccgactgggagagaaccaagctggacctgcccctgcagtgctacaactggaccctgaccctgggcaacaagtggaagaccttcttcgagaccgtgcacatctacctgagaagcagaatcaagagcaacggccccaacggcaacgagagcatctactacgagcccctggagttcatcgaccccagcagaaacctgggctacatgaagatcaacaacatccaggtgttcggctacagcatgcacttcgaccccgaggccatcagagacctgatcctgcagctggactacccctacacccagggcagccaggacagcgccctgctgcagctgctggagatcagagacagagtgaacaagctgagcccccccggccagagaagactggacctgttcagctgcctgctgagacacagactgaagctgagcaccagcgaggtggtgagaatccagagcgccctgcaggccttcaacgccaagctgcccaacaccatggactacgacaccaccaagctgtgcagctag

SEQ ID NO: 4035 - DNA, 1815 bp, Artificial Sequence
  Description of Artificial Sequence: Synthetic coding sequence
atgagaagatgcaacagcggcagcggccccccccccagcctgctgctgctgctgctgtggctgctggccgtgcccggcgccaacgccgcccccagaagcgccctgtacagccccagcgaccccctgaccctgctgcaggccgacaccgtgagaggcgccgtgctgggcagcagaagcgcctgggccgtggagttcttcgccagctggtgcggccactgcatcgccttcgcccccacctggaaggccctggccgaggacgtgaaggcctggagacccgccctgtacctggccgccctggactgcgccgaggagaccaacagcgccgtgtgcagagacttcaacatccccggcttccccaccgtgagattcttcaaggccttcaccaagaacggcagcggcgccgtgttccccgtggccggcgccgacgtgcagaccctgagagagagactgatcgacgccctggagagccaccacgacacctggccccccgcctgcccccccctggagcccgccaagctggaggagatcgacggcttcttcgccagaaacaacgaggagtacctggccctgatcttcgagaagggcggcagctacctgggcagagaggtggccctggacctgagccagcacaagggcgtggccgtgagaagagtgctgaacaccgaggccaacgtggtgagaaagttcggcgtgaccgacttccccagctgctacctgctgttcagaaacggcagcgtgagcagagtgcccgtgctgatggagagcagaagcttctacaccgcctacctgcagagactgagcggcctgaccagagaggccgcccagaccaccgtggcccccaccaccgccaacaagatcgcccccaccgtgtggaagctggccgacagaagcaagatctacatggccgacctggagagcgccctgcactacatcctgagaatcgaggtgggcagattccccgtgctggagggccagagactggtggccctgaagaagttcgtggccgtgctggccaagtacttccccggcagacccctggtgcagaacttcctgcacagcgtgaacgagtggctgaagagacagaagagaaacaagatcccctacagcttcttcaagaccgccctggacgacagaaaggagggcgccgtgctggccaagaaggtgaactggatcggctgccagggcagcgagccccacttcagaggcttcccctgcagcctgtgggtgctgttccacttcctgaccgtgcaggccgccagacagaacgtggaccacagccaggaggccgccaaggccaaggaggtgctgcccgccatcagaggctacgtgcactacttcttcggctgcagagactgcgccagccacttcgagcagatggccgccgccagcatgcacagagtgggcagccccaacgccgccgtgctgtggctgtggagcagccacaacagagtgaacgccagactggccggcgcccccagcgaggacccccagttccccaaggtgcagtggccccccagagagctgtgcagcgcctgccacaacgagagactggacgtgcccgtgtgggacgtggaggccaccctgaacttcctgaaggcccacttcagccccagcaacatcatcctggacttccccgccgccggcagcgccgccagaagagacgtgcagaacgtggccgccgcccccgagctggccatgggcgccctggagctggagagcagaaacagcaccctggaccccggcaagcccgagatgatgaagagccccaccaacaccaccccccacgtgcccgccgagggccccgagctgatctag

SEQ ID NO: 4036 - DNA, 2244 bp, Artificial Sequence
  Description of Artificial Sequence: Synthetic coding sequence
atgagaagatgcaacagcggcagcggccccccccccagcctgctgctgctgctgctgtggctgctggccgtgcccggcgccaacgccgcccccagaagcgccctgtacagccccagcgaccccctgaccctgctgcaggccgacaccgtgagaggcgccgtgctgggcagcagaagcgcctgggccgtggagttcttcgccagctggtgcggccactgcatcgccttcgcccccacctggaaggccctggccgaggacgtgaaggcctggagacccgccctgtacctggccgccctggactgcgccgaggagaccaacagcgccgtgtgcagagacttcaacatccccggcttccccaccgtgagattcttcaaggccttcaccaagaacggcagcggcgccgtgttccccgtggccggcgccgacgtgcagaccctgagagagagactgatcgacgccctggagagccaccacgacacctggccccccgcctgcccccccctggagcccgccaagctggaggagatcgacggcttcttcgccagaaacaacgaggagtacctggccctgatcttcgagaagggcggcagctacctgggcagagaggtggccctggacctgagccagcacaagggcgtggccgtgagaagagtgctgaacaccgaggccaacgtggtgagaaagttcggcgtgaccgacttccccagctgctacctgctgttcagaaacggcagcgtgagcagagtgcccgtgctgatggagagcagaagcttctacaccgcctacctgcagagactgagcggcctgaccagagaggccgcccagaccaccgtggcccccaccaccgccaacaagatcgcccccaccgtgtggaagctggccgacagaagcaagatctacatggccgacctggagagcgccctgcactacatcctgagaatcgaggtgggcagattccccgtgctggagggccagagactggtggccctgaagaagttcgtggccgtgctggccaagtacttccccggcagacccctggtgcagaacttcctgcacagcgtgaacgagtggctgaagagacagaagagaaacaagatcccctacagcttcttcaagaccgccctggacgacagaaaggagggcgccgtgctggccaagaaggtgaactggatcggctgccagggcagcgagccccacttcagaggcttcccctgcagcctgtgggtgctgttccacttcctgaccgtgcaggccgccagacagaacgtggaccacagccaggaggccgccaaggccaaggaggtgctgcccgccatcagaggctacgtgcactacttcttcggctgcagagactgcgccagccacttcgagcagatggccgccgccagcatgcacagagtgggcagccccaacgccgccgtgctgtggctgtggagcagccacaacagagtgaacgccagactggccggcgcccccagcgaggacccccagttccccaaggtgcagtggccccccagagagctgtgcagcgcctgccacaacgagagactggacgtgcccgtgtgggacgtggaggccaccctgaacttcctgaaggcccacttcagccccagcaacatcatcctggacttccccgccgccggcagcgccgccagaagagacgtgcagaacgtggccgccgcccccgagctggccatgggcgccctggagctggagagcagaaacagcaccctggaccccggcaagcccgagatgatgaagagccccaccaacaccaccccccacgtgcccgccgagggccccgaggccagcagaccccccaagctgcaccccggcctgagagccgcccccggccaggagccccccgagcacatggccgagctgcagagaaacgagcaggagcagcccctgggccagtggcacctgagcaagagagacaccggcgccgccctgctggccgagagcagagccgagaagaacagactgtggggccccctggaggtgagaagagtgggcagaagcagcaagcagctggtggacatccccgagggccagctggaggccagagccggcagaggcagaggccagtggctgcaggtgctgggcggcggcttcagctacctggacatcagcctgtgcgtgggcctgtacagcctgagcttcatgggcctgctggccatgtacacctacttccaggccaagatcagagccctgaagggccacgccggccaccccgccgcctag

SEQ ID NO: 4037 - DNA, 1476 bp, Artificial Sequence
  Description of Artificial Sequence: Synthetic coding sequence
atgaagaccttcacctggaccctgggcgtgctgttcttcctgctggtggacaccggccactgcagaggcggccagttcaagatcaagaagatcaaccagagaagataccccagagccaccgacggcaaggaggaggccaagaagtgcgcctacaccttcctggtgcccgagcagagaatcaccggccccatctgcgtgaacaccaagggccaggacgccagcaccatcaaggacatgatcaccagaatggacctggagaacctgaaggacgtgctgagcagacagaagagagagatcgacgtgctgcagctggtggtggacgtggacggcaacatcgtgaacgaggtgaagctgctgagaaaggagagcagaaacatgaacagcagagtgacccagctgtacatgcagctgctgcacgagatcatcagaaagagagacaacagcctggagctgagccagctggagaacaagatcctgaacgtgaccaccgagatgctgaagatggccaccagatacagagagctggaggtgaagtacgccagcctgaccgacctggtgaacaaccagagcgtgatgatcaccctgctggaggagcagtgcctgagaatcttcagcagacaggacacccacgtgagcccccccctggtgcaggtggtgccccagcacatccccaacagccagcagtacacccccggcctgctgggcggcaacgagatccagagagaccccggctaccccagagacctgatgcccccccccgacctggccaccagccccaccaagagccccttcaagatcccccccgtgaccttcatcaacgagggccccttcaaggactgccagcaggccaaggaggccggccacagcgtgagcggcatctacatgatcaagcccgagaacagcaacggccccatgcagctgtggtgcgagaacagcctggaccccggcggctggaccgtgatccagaagagaaccgacggcagcgtgaacttcttcagaaactgggagaactacaagaagggcttcggcaacatcgacggcgagtactggctgggcctggagaacatctacatgctgagcaaccaggacaactacaagctgctgatcgagctggaggactggagcgacaagaaggtgtacgccgagtacagcagcttcagactggagcccgagagcgagttctacagactgagactgggcacctaccagggcaacgccggcgacagcatgatgtggcacaacggcaagcagttcaccaccctggacagagacaaggacatgtacgccggcaactgcgcccacttccacaagggcggctggtggtacaacgcctgcgcccacagcaacctgaacggcgtgtggtacagaggcggccactacagaagcaagcaccaggacggcatcttctgggccgagtacagaggcggcagctacagcctgagagccgtgcagatgatgatcaagcccatcgactag

SEQ ID NO: 4038 - DNA, 2484 bp, Artificial Sequence
  Description of Artificial Sequence: Synthetic coding sequence
atgatgtgcctgaagatcctgagaatcagcctggccatcctggccggctgggccctgtgcagcgccaacagcgagctgggctggaccagaaagaagagcctggtggagagagagcacctgaaccaggtgctgctggagggcgagagatgctggctgggcgccaaggtgagaagacccagagccagcccccagcaccacctgttcggcgtgtaccccagcagagccggcaactacctgagaccctaccccgtgggcgagcaggagatccaccacaccggcagaagcaagcccgacaccgagggcaacgccgtgagcctggtgccccccgacctgaccgagaaccccgccggcctgagaggcgccgtggaggagcccgccgccccctgggtgggcgacagccccatcggccagagcgagctgctgggcgacgacgacgcctacctgggcaaccagagaagcaaggagagcctgggcgaggccggcatccagaagggcagcgccatggccgccaccaccaccaccgccatcttcaccaccctgaacgagcccaagcccgagacccagagaagaggctgggccaagagcagacagagaagacaggtgtggaagagaagagccgaggacggccagggcgacagcggcatcagcagccacttccagccctggcccaagcacagcctgaagcacagagtgaagaagagcccccccgaggagagcaaccagaacggcggcgagggcagctacagagaggccgagaccttcaacagccaggtgggcctgcccatcctgtacttcagcggcagaagagagagactgctgctgagacccgaggtgctggccgagatccccagagaggccttcaccgtggaggcctgggtgaagcccgagggcggccagaacaaccccgccatcatcgccggcgtgttcgacaactgcagccacaccgtgagcgacaagggctgggccctgggcatcagaagcggcaaggacaagggcaagagagacgccagattcttcttcagcctgtgcaccgacagagtgaagaaggccaccatcctgatcagccacagcagataccagcccggcacctggacccacgtggccgccacctacgacggcagacacatggccctgtacgtggacggcacccaggtggccagcagcctggaccagagcggccccctgaacagccccttcatggccagctgcagaagcctgctgctgggcggcgacagcagcgaggacggccactacttcagaggccacctgggcaccctggtgttctggagcaccgccctgccccagagccacttccagcacagcagccagcacagcagcggcgaggaggaggccaccgacctggtgctgaccgccagcttcgagcccgtgaacaccgagtgggtgcccttcagagacgagaagtaccccagactggaggtgctgcagggcttcgagcccgagcccgagatcctgagccccctgcagccccccctgtgcggccagaccgtgtgcgacaacgtggagctgatcagccagtacaacggctactggcccctgagaggcgagaaggtgatcagataccaggtggtgaacatctgcgacgacgagggcctgaaccccatcgtgagcgaggagcagatcagactgcagcacgaggccctgaacgaggccttcagcagatacaacatcagctggcagctgagcgtgcaccaggtgcacaacagcaccctgagacacagagtggtgctggtgaactgcgagcccagcaagatcggcaacgaccactgcgaccccgagtgcgagcaccccctgaccggctacgacggcggcgactgcagactgcagggcagatgctacagctggaacagaagagacggcctgtgccacgtggagtgcaacaacatgctgaacgacttcgacgacggcgactgctgcgacccccaggtggccgacgtgagaaagacctgcttcgaccccgacagccccaagagagcctacatgagcgtgaaggagctgaaggaggccctgcagctgaacagcacccacttcctgaacatctacttcgccagcagcgtgagagaggacctggccggcgccgccacctggccctgggacaaggacgccgtgacccacctgggcggcatcgtgctgagccccgcctactacggcatgcccggccacaccgacaccatgatccacgaggtgggccacgtgctgggcctgtaccacgtgttcaagggcgtgagcgagagagagagctgcaacgacccctgcaaggagaccgtgcccagcatggagaccggcgacctgtgcgccgacaccgcccccacccccaagagcgagctgtgcagagagcccgagcccaccagcgacacctgcggcttcaccagattccccggcgcccccttcaccaactacatgagctacaccggcatcaccaccgtgctgttctgcttcctgctgagaatccacggcggcctgtag

SEQ ID NO: 4039 - DNA, 5376 bp, Artificial Sequence
  Description of Artificial Sequence: Synthetic coding sequence
atgatgtgcctgaagatcctgagaatcagcctggccatcctggccggctgggccctgtgcagcgccaacagcgagctgggctggaccagaaagaagagcctggtggagagagagcacctgaaccaggtgctgctggagggcgagagatgctggctgggcgccaaggtgagaagacccagagccagcccccagcaccacctgttcggcgtgtaccccagcagagccggcaactacctgagaccctaccccgtgggcgagcaggagatccaccacaccggcagaagcaagcccgacaccgagggcaacgccgtgagcctggtgccccccgacctgaccgagaaccccgccggcctgagaggcgccgtggaggagcccgccgccccctgggtgggcgacagccccatcggccagagcgagctgctgggcgacgacgacgcctacctgggcaaccagagaagcaaggagagcctgggcgaggccggcatccagaagggcagcgccatggccgccaccaccaccaccgccatcttcaccaccctgaacgagcccaagcccgagacccagagaagaggctgggccaagagcagacagagaagacaggtgtggaagagaagagccgaggacggccagggcgacagcggcatcagcagccacttccagccctggcccaagcacagcctgaagcacagagtgaagaagagcccccccgaggagagcaaccagaacggcggcgagggcagctacagagaggccgagaccttcaacagccaggtgggcctgcccatcctgtacttcagcggcagaagagagagactgctgctgagacccgaggtgctggccgagatccccagagaggccttcaccgtggaggcctgggtgaagcccgagggcggccagaacaaccccgccatcatcgccggcgtgttcgacaactgcagccacaccgtgagcgacaagggctgggccctgggcatcagaagcggcaaggacaagggcaagagagacgccagattcttcttcagcctgtgcaccgacagagtgaagaaggccaccatcctgatcagccacagcagataccagcccggcacctggacccacgtggccgccacctacgacggcagacacatggccctgtacgtggacggcacccaggtggccagcagcctggaccagagcggccccctgaacagccccttcatggccagctgcagaagcctgctgctgggcggcgacagcagcgaggacggccactacttcagaggccacctgggcaccctggtgttctggagcaccgccctgccccagagccacttccagcacagcagccagcacagcagcggcgaggaggaggccaccgacctggtgctgaccgccagcttcgagcccgtgaacaccgagtgggtgcccttcagagacgagaagtaccccagactggaggtgctgcagggcttcgagcccgagcccgagatcctgagccccctgcagccccccctgtgcggccagaccgtgtgcgacaacgtggagctgatcagccagtacaacggctactggcccctgagaggcgagaaggtgatcagataccaggtggtgaacatctgcgacgacgagggcctgaaccccatcgtgagcgaggagcagatcagactgcagcacgaggccctgaacgaggccttcagcagatacaacatcagctggcagctgagcgtgcaccaggtgcacaacagcaccctgagacacagagtggtgctggtgaactgcgagcccagcaagatcggcaacgaccactgcgaccccgagtgcgagcaccccctgaccggctacgacggcggcgactgcagactgcagggcagatgctacagctggaacagaagagacggcctgtgccacgtggagtgcaacaacatgctgaacgacttcgacgacggcgactgctgcgacccccaggtggccgacgtgagaaagacctgcttcgaccccgacagccccaagagagcctacatgagcgtgaaggagctgaaggaggccctgcagctgaacagcacccacttcctgaacatctacttcgccagcagcgtgagagaggacctggccggcgccgccacctggccctgggacaaggacgccgtgacccacctgggcggcatcgtgctgagccccgcctactacggcatgcccggccacaccgacaccatgatccacgaggtgggccacgtgctgggcctgtaccacgtgttcaagggcgtgagcgagagagagagctgcaacgacccctgcaaggagaccgtgcccagcatggagaccggcgacctgtgcgccgacaccgcccccacccccaagagcgagctgtgcagagagcccgagcccaccagcgacacctgcggcttcaccagattccccggcgcccccttcaccaactacatgagctacaccgacgacaactgcaccgacaacttcacccccaaccaggtggccagaatgcactgctacctggacctggtgtaccagcagtggaccgagagcagaaagcccacccccatccccatcccccccatggtgatcggccagaccaacaagagcctgaccatccactggctgccccccatcagcggcgtggtgtacgacagagccagcggcagcctgtgcggcgcctgcaccgaggacggcaccttcagacagtacgtgcacaccgccagcagcagaagagtgtgcgacagcagcggctactggacccccgaggaggccgtgggcccccccgacgtggaccagccctgcgagcccagcctgcaggcctggagccccgaggtgcacctgtaccacatgaacatgaccgtgccctgccccaccgagggctgcagcctggagctgctgttccagcaccccgtgcaggccgacaccctgaccctgtgggtgaccagcttcttcatggagagcagccaggtgctgttcgacaccgagatcctgctggagaacaaggagagcgtgcacctgggccccctggacaccttctgcgacatccccctgaccatcaagctgcacgtggacggcaaggtgagcggcgtgaaggtgtacaccttcgacgagagaatcgagatcgacgccgccctgctgaccagccagccccacagccccctgtgcagcggctgcagacccgtgagataccaggtgctgagagacccccccttcgccagcggcctgcccgtggtggtgacccacagccacagaaagttcaccgacgtggaggtgacccccggccagatgtaccagtaccaggtgctggccgaggccggcggcgagctgggcgaggccagcccccccctgaaccacatccacggcgccccctactgcggcgacggcaaggtgagcgagagactgggcgaggagtgcgacgacggcgacctggtgagcggcgacggctgcagcaaggtgtgcgagctggaggagggcttcaactgcgtgggcgagcccagcctgtgctacatgtacgagggcgacggcatctgcgagcccttcgagagaaagaccagcatcgtggactgcggcatctacacccccaagggctacctggaccagtgggccaccagagcctacagcagccacgaggacaagaagaagtgccccgtgagcctggtgaccggcgagccccacagcctgatctgcaccagctaccaccccgacctgcccaaccacagacccctgaccggctggttcccctgcgtggccagcgagaacgagacccaggacgacagaagcgagcagcccgagggcagcctgaagaaggaggacgaggtgtggctgaaggtgtgcttcaacagacccggcgaggccagagccatcttcatcttcctgaccaccgacggcctggtgcccggcgagcaccagcagcccaccgtgaccctgtacctgaccgacgtgagaggcagcaaccacagcctgggcacctacggcctgagctgccagcacaaccccctgatcatcaacgtgacccaccaccagaacgtgctgttccaccacaccaccagcgtgctgctgaacttcagcagccccagagtgggcatcagcgccgtggccctgagaaccagcagcagaatcggcctgagcgcccccagcaactgcatcagcgaggacgagggccagaaccaccagggccagagctgcatccacagaccctgcggcaagcaggacagctgccccagcctgctgctggaccacgccgacgtggtgaactgcaccagcatcggccccggcctgatgaagtgcgccatcacctgccagagaggcttcgccctgcaggccagcagcggccagtacatcagacccatgcagaaggagatcctgctgacctgcagcagcggccactgggaccagaacgtgagctgcctgcccgtggactgcggcgtgcccgaccccagcctggtgaactacgccaacttcagctgcagcgagggcaccaagttcctgaagagatgcagcatcagctgcgtgccccccgccaagctgcagggcctgagcccctggctgacctgcctggaggacggcctgtggagcctgcccgaggtgtactgcaagctggagtgcgacgccccccccatcatcctgaacgccaacctgctgctgccccactgcctgcaggacaaccacgacgtgggcaccatctgcaagtacgagtgcaagcccggctactacgtggccgagagcgccgagggcaaggtgagaaacaagctgctgaagatccagtgcctggagggcggcatctgggagcagggcagctgcatccccgtggtgtgcgagccccccccccccgtgttcgagggcatgtacgagtgcaccaacggcttcagcctggacagccagtgcgtgctgaactgcaaccaggagagagagaagctgcccatcctgtgcaccaaggagggcctgtggacccaggagttcaagctgtgcgagaacctgcagggcgagtgcccccccccccccagcgagctgaacagcgtggagtacaagtgcgagcagggctacggcatcggcgccgtgtgcagccccctgtgcgtgatcccccccagcgaccccgtgatgctgcccgagaacatcaccgccgacaccctggagcactggatggagcccgtgaaggtgcagagcatcgtgtgcaccggcagaagacagtggcaccccgaccccgtgctggtgcactgcatccagagctgcgagcccttccaggccgacggctggtgcgacaccatcaacaacagagcctactgccactacgacggcggcgactgctgcagcagcaccctgagcagcaagaaggtgatccccttcgccgccgactgcgacctggacgagtgcacctgcagagaccccaaggccgaggagaaccagtag

SEQ ID NO: 4040 - DNA, 702 bp, Artificial Sequence
  Description of Artificial Sequence: Synthetic coding sequence
atgaaggaccccctggccaaggacgagagaatctacgtgaccaactactactacggcaacaccctggtggagttcagaaacctggagaacttcaagcagggcagatggagcaacagctacaagctgccctacagctggatcggcaccggccacgtggtgtacaacggcgccttctactacaacagagccttcaccagaaacatcatcaagtacgacctgaagcagagatacgtggccgcctgggccatgctgcacgacgtggcctacgaggaggccaccccctggagatggcagggccacagcgacgtggacttcgccgtggacgagaacggcctgtggctgatctaccccgccctggacgacgagggcttcagccaggaggtgatcgtgctgagcaagctgaacgccgccgacctgagcacccagaaggagaccacctggagaaccggcctgagaagaaacttctacggcaactgcttcgtgatctgcggcgtgctgtacgccgtggacagctacaaccagagaaacgccaacatcagctacgccttcgacacccacaccaacacccagatcgtgcccagactgctgttcgagaacgagtacagctacaccacccagatcgactacaaccccaaggacagactgctgtacgcctgggacaacggccaccaggtgacctaccacgtgatcttcgcctactag

SEQ ID NO: 4041 - DNA, 579 bp, Artificial Sequence
  Description of Artificial Sequence: Synthetic coding sequence
atgctgaagaagatcagcgtgggcgtggccggcgacctgaacaccgtgaccatgaagctgggctgcgtgctgatggcctgggccctgtacctgagcctgggcgtgctgtgggtggcccagatgctgctggccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 4042 - DNA, 459 bp, Artificial Sequence
  Description of Artificial Sequence: Synthetic coding sequence
atgctgctggccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 4043 - DNA, 1098 bp, Artificial Sequence
  Description of Artificial Sequence: Synthetic coding sequence
atgaagctgggctgcgtgctgatggcctgggccctgtacctgagcctgggcgtgctgtgggtggcccagatgctgctggccgccggctgccacgccgccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacgactggctgatcctgcagggccccgccaagcccgtgttcgagggcgacctgctggtgctgagatgccaggcctggcaggactggcccctgacccaggtgaccttctacagagacggcagcgccctgggcccccccggccccaacagagagttcagcatcaccgtggtgcagaaggccgacagcggccactaccactgcagcggcatcttccagagccccggccccggcatccccgagaccgccagcgtggtggccatcaccgtgcaggagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 4044 - DNA, 711 bp, Artificial Sequence
  Description of Artificial Sequence: Synthetic coding sequence
atgctgaagaagatcagcgtgggcgtggccggcgacctgaacaccgtgaccatgaagctgggctgcgtgctgatggcctgggccctgtacctgagcctgggcgtgctgtgggtggcccagatgctgctggagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 4045 - DNA, 1149 bp, Artificial Sequence
  Description of Artificial Sequence: Synthetic coding sequence
atgctgaagaagatcagcgtgggcgtggccggcgacctgaacaccgtgaccatgaagctgggctgcgtgctgatggcctgggccctgtacctgagcctgggcgtgctgtgggtggcccagatgctgctggccgccggctgccacgccgccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacgactggctgatcctgcagggccccgccaagcccgtgttcgagggcgacctgctggtgctgagatgccaggcctggcaggactggcccctgacccaggtgaccttctacagagacggcagcgccctgggcccccccggccccaacagagagttcagcatcaccgtggtgcagaaggccgacagcggccactaccactgcagcggcatcttccagagccccggccccggcatccccgagaccgccagcgtggtggccatcaccgtgcaggagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 4046 - DNA, 738 bp, Artificial Sequence
  Description of Artificial Sequence: Synthetic coding sequence
atgagcagactgagagccctgctgggcctgggcctgctggtggccggcagcagagtgcccagaatcaagagccagaccatcgcctgcagaagcggccccacctggtggggcccccagagactgaacagcggcggcagatgggacagcgaggtgatggccagcaccgtggtgaagtacctgagccaggaggaggcccaggccgtggaccaggagctgttcaacgagtaccagttcagcgtggaccagctgatggagctggccggcctgagctgcgccaccgccatcgccaaggcctacccccccaccagcatgagcagaagcccccccaccgtgctggtgatctgcggccccggcaacaacggcggcgacggcctggtgtgcgccagacacctgaagctgttcggctacgagcccaccatctactaccccaagagacccaacaagcccctgttcaccgccctggtgacccagtgccagaagatggacatccccttcctgggcgagatgcccgccgagcccatgaccatcgacgagctgtacgagctggtggtggacgccatcttcggcttcagcttcaagggcgacgtgagagagcccttccacagcatcctgagcgtgctgaagggcctgaccgtgcccatcgccagcatcgacatccccagcggcgccggcatccagaaggtgggctggggcagactgggcccctacccccccgacagctgcccccaccaggtgtag

SEQ ID NO: 4047 - DNA, 783 bp, Artificial Sequence
  Description of Artificial Sequence: Synthetic coding sequence
atgagcagactgagagccctgctgggcctgggcctgctggtggccggcagcagagtgcccagaatcaagagccagaccatcgcctgcagaagcggccccacctggtggggcccccagagactgaacagcggcggcagatgggacagcgaggtgatggccagcaccgtggtgaagtacctgagccaggaggaggcccaggccgtggaccaggagctgttcaacgagtaccagttcagcgtggaccagctgatggagctggccggcctgagctgcgccaccgccatcgccaaggcctacccccccaccagcatgagcagaagcccccccaccgtgctggtgatctgcggccccggcaacaacggcggcgacggcctggtgtgcgccagacacctgaagctgttcggctacgagcccaccatctactaccccaagagacccaacaagcccctgttcaccgccctggtgacccagtgccagaagatggacatccccttcctgggcgagatgcccgccgagctgcagggcagatgcagcggcaccgtgccccagcaccccgagtgccccgagggcacccactgcgcccactgccagcacagacacagcctgagaatgggcagaggcgagggcaagtgctggagagaccccgccagactggcccacatcccccacagcccccagaagatctgcaaccccgtgtacagaagcctgcccctgcccggcggcagcttctgcgccacctgcagcggcgaggaggtgcccgccgagcccgccaccctgccctag

SEQ ID NO: 4048 - DNA, 867 bp, Artificial Sequence
  Description of Artificial Sequence: Synthetic coding sequence
atgagcagactgagagccctgctgggcctgggcctgctggtggccggcagcagagtgcccagaatcaagagccagaccatcgcctgcagaagcggccccacctggtggggcccccagagactgaacagcggcggcagatgggacagcgaggtgatggccagcaccgtggtgaagtacctgagccaggaggaggcccaggccgtggaccaggagctgttcaacgagtaccagttcagcgtggaccagctgatggagctggccggcctgagctgcgccaccgccatcgccaaggcctacccccccaccagcatgagcagaagcccccccaccgtgctggtgatctgcggccccggcaacaacggcggcgacggcctggtgtgcgccagacacctgaagctgttcggctacgagcccaccatctactaccccaagagacccaacaagcccctgttcaccgccctggtgacccagtgccagaagatggacatccccttcctgggcgagatgcccgccgagcccatgaccatcgacgagctgtacgagctggtggtggacgccatcttcggcttcagcttcaagggcgacgtgagagagcccttccacagcatcctgagcgtgctgaagggcctgaccgtgcccatcgccagcatcgacatccccagcggctgggacgtggagaagggcaacgccggcggcatccagcccgacctgctgatcagcctgaccgcccccaagaagagcgccacccagttcaccggcagataccactacctgggcggcagattcgtgccccccgccctggagaagaagtaccagctgaacctgcccccctaccccgacaccgagtgcgtgtacagactgcagtag

SEQ ID NO: 4049 - DNA, 879 bp, Artificial Sequence
  Description of Artificial Sequence: Synthetic coding sequence
atgcacctgagactgatcagctggctgttcatcatcctgaacttcatggagtacatcggcagccagaacgccagcagaggcagaagacagagaagaatgcaccccaacgtgagccagggctgccagggcggctgcgccacctgcagcgactacaacggctgcctgagctgcaagcccagactgttcttcgccctggagagaatcggcatgaagcagatcggcgtgtgcctgagcagctgccccagcggctactacggcaccagataccccgacatcaacaagtgcaccaagtgcaaggccgactgcgacacctgcttcaacaagaacttctgcaccaagtgcaagagcggcttctacctgcacctgggcaagtgcctggacaactgccccgagggcctggaggccaacaaccacaccatggagtgcgtgagcatcgtgcactgcgaggtgagcgagtggaacccctggagcccctgcaccaagaagggcaagacctgcggcttcaagagaggcaccgagaccagagtgagagagatcatccagcaccccagcgccaagggcaacctgtgcccccccaccaacgagaccagaaagtgcaccgtgcagagaaagaagtgccagaagggcgagagaggcaagaagggcagagagagaaagagaaagaagcccaacaagggcgagagcaaggaggccatccccgacagcaagagcctggagagcagcaaggagatccccgagcagagagagaacaagcagcagcagaagaagagaaaggtgcaggacaagcagaagagcggcatcgaggtgaccctggccgagggcctgaccagcgtgagccagagaacccagcccaccccctgcagaagaagatacctgtag

SEQ ID NO: 4050 - DNA, 2871 bp, Artificial Sequence
  Description of Artificial Sequence: Synthetic coding sequence
atggagacccaggagctgagaggcgccctggccctgctgctgctgtgcttcttcaccagcgccagccaggacctgcaggtgatcgacctgctgaccgtgggcgagagcagacagatggtggccgtggccgagaagatcagaaccgccctgctgaccgccggcgacatctacctgctgagcaccttcagactgccccccaagcagggcggcgtgctgttcggcctgtacagcagacaggacaacaccagatggctggaggccagcgtggtgggcaagatcaacaaggtgctggtgagataccagagagaggacggcaaggtgcacgccgtgaacctgcagcaggccggcctggccgacggcagaacccacaccgtgctgctgagactgagaggccccagcagacccagccccgccctgcacctgtacgtggactgcaagctgggcgaccagcacgccggcctgcccgccctggcccccatcccccccgccgaggtggacggcctggagatcagaaccggccagaaggcctacctgagaatgcagggcttcgtggagagcatgaagatcatcctgggcggcagcatggccagagtgggcgccctgagcgagtgccccttccagggcgacgagagcatccacagcgccgtgaccaacgccctgcacagcatcctgggcgagcagaccaaggccctggtgacccagctgaccctgttcaaccagatcctggtggagctgagagacgacatcagagaccaggtgaaggagatgagcctgatcagaaacaccatcatggagtgccaggtgtgcggcttccacgagcagagaagccactgcagccccaacccctgcttcagaggcgtggactgcatggaggtgtacgagtaccccggctacagatgcggcccctgcccccccggcctgcagggcaacggcacccactgcagcgacatcaacgagtgcgcccacgccgacccctgcttccccggcagcagctgcatcaacaccatgcccggcttccactgcgaggcctgccccagaggctacaagggcacccaggtgagcggcgtgggcatcgactacgccagagccagcaagcaggtgtgcaacgacatcgacgagtgcaacgacggcaacaacggcggctgcgaccccaacagcatctgcaccaacaccgtgggcagcttcaagtgcggcccctgcagactgggcttcctgggcaaccagagccagggctgcctgcccgccagaacctgccacagccccgcccacagcccctgccacatccacgcccactgcctgttcgagagaaacggcgccgtgagctgccagtgcaacgtgggctgggccggcaacggcaacgtgtgcggcaccgacaccgacatcgacggctaccccgaccaggccctgccctgcatggacaacaacaagcactgcaagcaggacaactgcctgctgacccccaacagcggccaggaggacgccgacaacgacggcgtgggcgaccagtgcgacgacgacgccgacggcgacggcatcaagaacgtggaggacaactgcagactgttccccaacaaggaccagcagaacagcgacaccgacagcttcggcgacgcctgcgacaactgccccaacgtgcccaacaacgaccagaaggacaccgacggcaacggcgagggcgacgcctgcgacaacgacgtggacggcgacggcatccccaacggcctggacaactgccccaaggtgcccaaccccctgcagaccgacagagacgaggacggcgtgggcgacgcctgcgacagctgccccgagatgagcaaccccacccagaccgacgccgacagcgacctggtgggcgacgtgtgcgacaccaacgaggacagcgacggcgacggccaccaggacaccaaggacaactgcccccagctgcccaacagcagccagctggacagcgacaacgacggcctgggcgacgagtgcgacggcgacgacgacaacgacggcatccccgactacgtgccccccggccccgacaactgcagactggtgcccaaccccaaccagaaggacagcgacggcaacggcgtgggcgacgtgtgcgaggacgacttcgacaacgacgccgtggtggaccccctggacgtgtgccccgagagcgccgaggtgaccctgaccgacttcagagcctaccagaccgtggtgctggaccccgagggcgacgcccagatcgaccccaactgggtggtgctgaaccagggcatggagatcgtgcagaccatgaacagcgaccccggcctggccgtgggctacaccgccttcaacggcgtggacttcgagggcaccttccacgtgaacaccgtgaccgacgacgactacgccggcttcctgttcagctaccaggacagcggcagattctacgtggtgatgtggaagcagaccgagcagacctactggcaggccacccccttcagagccgtggcccagcccggcctgcagctgaaggccgtgaccagcgtgagcggccccggcgagcacctgagaaacgccctgtggcacaccggccacacccccgaccaggtgagactgctgtggaccgaccccagaaacgtgggctggagagacaagaccagctacagatggcagctgctgcacagaccccaggtgggctacatcagagtgaagctgtacgagggcccccagctggtggccgacagcggcgtgatcatcgacaccagcatgagaggcggcagactgggcgtgttctgcttcagccaggagaacatcatctggagcaacctgcagtacagatgcaacgacaccgtgcccgaggacttcgagcccttcagaagacagctgctgcagggcagagtgtag

SEQ ID NO: 4051 - DNA, 1110 bp, Artificial Sequence
  Description of Artificial Sequence: Synthetic coding sequence
atgctgccctggctgctggtgttcagcgccctgggcatccaggcctggggcgacagcagctggaacaagacccaggccaagcaggtgagcgagggcctgcagtacctgttcgagaacatcagccagctgaccgagaaggacgtgagcaccaccgtgagcagaaaggcctggggcgccgaggccgtgggctgcagcatccagctgaccacccccgtgaacgtgctggtgatccaccacgtgcccggcctggagtgccacgaccagaccgtgtgcagccagagactgagagagctgcaggcccaccacgtgcacaacaacagcggctgcgacgtggcctacaacttcctggtgggcgacgacggcagagtgtacgagggcgtgggctggaacatccagggcgtgcacacccagggctacaacaacatcagcctgggcttcgccttcttcggcaccaagaagggccacagccccagccccgccgccctgagcgccatggagaacctgatcacctacgccgtgcagaagggccacctgagcagcagctacgtgcagcccctgctgggcaagggcgagaactgcctggcccccagacagaagaccagcctgaagaaggcctgccccggcgtggtgcccagaagcgtgtggggcgccagagagacccactgccccagaatgaccctgcccgccaagtacggcatcatcatccacaccgccggcagaacctgcaacatcagcgacgagtgcagactgctggtgagagacatccagagcttctacatcgacagactgaagagctgcgacatcggctacaacttcctggtgggccaggacggcgccatctacgagggcgtgggctggaacgtgcagggcagcagcacccccggctacgacgacatcgccctgggcatcaccttcatgggcaccttcaccggcatcccccccaacgccgccgccctggaggccgcccaggacctgatccagtgcgccatggtgaagggctacctgacccccaactacctgctggtgggccacagcgacgtggccagaaccctgagccccggccaggccctgtacaacatcatcagcacctggccccacttcaagcactag

SEQ ID NO: 4052 - DNA, 675 bp, Artificial Sequence
  Description of Artificial Sequence: Synthetic coding sequence
atggagaagatccccttcgtgctgggcggcaacctgcagggcggcgagctggtggtggcctacccctacgacctggtgagaagcccctggaagacccaggagcacacccccacccccgacgaccacgtgttcagatggctggcctacagctacgccagcacccacagactgatgaccgacgccagaagaagagtgtgccacaccgaggacttccagaaggaggagggcaccgtgaacggcgccagctggcacaccgtggccggcagcctgaacgacttcagctacctgcacaccaactgcttcgagctgagcatctacgtgggctgcgacaagtacccccacgagagccagctgcccgaggagtgggagaacaacagagagagcctgatcgtgttcatggagcaggtgcacagaggcatcaagggcctggtgagagacagccacggcaagggcatccccaacgccatcatcagcgtggagggcatcaaccacgacatcagaaccggcagagtgagcctgcagaagctgagcctggcctgcagaagagtgagatgcgccttcgccctgagcagcagcagcaccatgatcgtgagacccccccagccctacggcaccgtgccccacagcagccccgaccccgtgaccaccaagatcagccccctgagaaacttctag

SEQ ID NO: 4053 - DNA, 285 bp, Artificial Sequence
  Description of Artificial Sequence: Synthetic coding sequence
atgcccgtgatcgccggcggcatcctggccgccctgctgctgctgatcgtggtggtgctgtgcctgtacttcaagatccacaacgccctgaaggccgccaaggagcccgaggccgtggccgtgaagaaccacaaccccgacaaggtgtggtgggccaagaacagccaggccaagaccatcgccaccgagagctgccccgccctgcagtgctgcgagggctacagaatgtgcgccagcttcgacagcctgcccccctgctgctgcgacatcaacgagggcctgtag

SEQ ID NO: 4054 - DNA, 285 bp, Artificial Sequence; identical to SEQ ID NO: 4053
  Description of Artificial Sequence: Synthetic coding sequence

SEQ ID NO: 4055 - DNA, 1026 bp, Artificial Sequence
  Description of Artificial Sequence: Synthetic coding sequence
atggtgcccgccgccggcgccctgctgtgggtgctgctgctgaacctgggccccagagccgccggcgcccagggcctgacccagacccccaccgagatgcagagagtgagcctgagattcggcggccccatgaccagaagctacagaagcaccgccagaaccggcctgcccagaaagaccagaatcatcctggaggacgagaacgacgccatggccgacgccgacagactggccggccccgccgccgccgagctgctggccgccaccgtgagcaccggcttcagcagaagcagcgccatcaacgaggaggacggcagcagcgaggagggcgtggtgatcaacgccggcaaggacagcaccagcagagagctgcccagcgccacccccaacaccgccggcagcagcagcaccagattcatcgccaacagccaggagcccgagatcagactgaccagcagcctgcccagaagccccggcagaagcaccgaggacctgcccggcagccaggccaccctgagccagtggagcacccccggcagcacccccagcagatggcccagccccagccccaccgccatgcccagccccgaggacctgagactggtgctgatgccctggggcccctggcactgccactgcaagagcggcaccatgagcagaagcagaagcggcaagctgcacggcctgagcggcagactgagagtgggcgccctgagccagctgagaaccgagcacaagccctgcacctaccagcagtgcccctgcaacagactgagagaggagtgccccctggacaccagcctgtgcaccgacaccaactgcgccagccagagcaccaccagcaccagaaccaccaccacccccttccccaccatccacctgagaagcagccccagcctgccccccgccagcccctgccccgccctggccttctggaagagagtgagaatcggcctggaggacatctggaacagcctgagcagcgtgttcaccgagatgcagcccatcgacagaaaccagagatag

SEQ ID NO: 4056 - DNA, 366 bp, Artificial Sequence
  Description of Artificial Sequence: Synthetic coding sequence
atggacgtgctgttcgtggccatcttcgccgtgcccctgatcctgggccaggagtacgaggacgaggagagactgggcgaggacgagtactaccaggtggtgtactactacaccgtgacccccagctacgacgacttcagcgccgacttcaccatcgactacagcatcttcgagagcgaggacagactgaacagactggacaaggacatcaccgaggccatcgagaccaccatcagcctggagaccgccagagccgaccaccccaagcccgtgaccgtgaagcccgtgaccaccgagcccgtggaggagggctgctacgacagcctggacggcagcctggccagaggcaactggaagatcaagtag

SEQ ID NO: 4057 - DNA, 396 bp, Artificial Sequence
  Description of Artificial Sequence: Synthetic coding sequence
atggacgtgctgttcgtggccatcttcgccgtgcccctgatcctgggccaggagtacgaggacgaggagagactgggcgaggacgagtactaccaggtggtgtactactacaccgtgacccccagctacgacgacttcagcgccgacttcaccatcgactacagcatcttcgagagcgaggacagactgaacagactggacaaggacatcaccgaggccatcgagaccaccatcagcctggagaccgccagagccgaccaccccaagcccgtgaccgtgaagcccgtgaccaccgagcccagccccgacctgaacgacgccgtgagcagcctgagaagccccatccccctgctgctgagctgcgccttcgtgcaggtgggcatgtacttcatgtag

SEQ ID NO: 4058 - DNA, 396 bp, Artificial Sequence; identical to SEQ ID NO: 4057
  Description of Artificial Sequence: Synthetic coding sequence

SEQ ID NO: 4059 - DNA, 312 bp, Artificial Sequence; identical to SEQ ID NO: 3978
  Description of Artificial Sequence: Synthetic coding sequence

SEQ ID NO: 4060 - DNA, 312 bp, Artificial Sequence; identical to SEQ ID NO: 3978
  Description of Artificial Sequence: Synthetic coding sequence

SEQ ID NO: 4061 - DNA, 1404 bp, Artificial Sequence
  Description of Artificial Sequence: Synthetic coding sequence
atgctgggcatctggatcgtggccttcctgttcttcggcaccagcagaggcaaggaggtgtgctacgagagactgggctgcttcaaggacggcctgccctggaccagaaccttcagcaccgagctggtgggcctgccctggagccccgagaagatcaacaccagattcctgctgtacaccatccacaaccccaacgcctaccaggagatcagcgccgtgaacagcagcaccatccaggccagctacttcggcaccgacaagatcaccagaatcaacatcgccggctggaagaccgacggcaagtggcagagagacatgtgcaacgtgctgctgcagctggaggacatcaactgcatcaacctggactggatcaacggcagcagagagtacatccacgccgtgaacaacctgagagtggtgggcgccgaggtggcctacttcatcgacgtgctgatgaagaagttcgagtacagccccagcaaggtgcacctgatcggccacagcctgggcgcccacctggccggcgaggccggcagcagaatccccggcctgggcagaatcaccggcctggaccccgccggccccttcttccacaacacccccaaggaggtgagactggaccccagcgacgccaacttcgtggacgtgatccacaccaacgccgccagaatcctgttcgagctgggcgtgggcaccatcgacgcctgcggccacctggacttctaccccaacggcggcaagcacatgcccggctgcgaggacctgatcacccccctgctgaagttcaacttcaacgcctacaagaaggagatggccagcttcttcgactgcaaccacgccagaagctaccagttctacgccgagagcatcctgaaccccgacgccttcatcgcctacccctgcagaagctacaccagcttcaaggccggcaactgcttcttctgcagcaaggagggctgccccaccatgggccacttcgccgacagattccacttcaagaacatgaagaccaacggcagccactacttcctgaacaccggcagcctgagccccttcgccagatggagacacaagctgagcgtgaagctgagcggcagcgaggtgacccagggcaccgtgttcctgagagtgggcggcgccgtgagaaagaccggcgagttcgccatcgtgagcggcaagctggagcccggcatgacctacaccaagctgatcgacgccgacgtgaacgtgggcaacatcaccagcgtgcagttcatctggaagaagcacctgttcgaggacagccagaacaagctgggcgccgagatggtgatcaacaccagcggcaagtacggctacaagagcaccttctgcagccaggacatcatgggccccaacatcctgcagaacctgaagccctgctag

SEQ ID NO: 4062 - DNA, 1287 bp, Artificial Sequence
  Description of Artificial Sequence: Synthetic coding sequence
atgatcaccggcgtgttcagcatgagactgtggacccccgtgggcgtgctgaccagcctggcctactgcctgcaccagagaagagtggccctggccgagctgcaggaggccgacggccagtgccccgtggacagaagcctgctgaagctgaagatggtgcaggtggtgttcagacacggcgccagaagccccctgaagcccctgcccctggaggagcaggtggagtggaacccccagctgctggaggtgcccccccagacccagttcgactacaccgtgaccaacctggccggcggccccaagccctacagcccctacgacagccagtaccacgagaccaccctgaagggcggcatgttcgccggccagctgaccaaggtgggcatgcagcagatgttcgccctgggcgagagactgagaaagaactacgtggaggacatccccttcctgagccccaccttcaacccccaggaggtgttcatcagaagcaccaacatcttcagaaacctggagagcaccagatgcctgctggccggcctgttccagtgccagaaggagggccccatcatcatccacaccgacgaggccgacagcgaggtgctgtaccccaactaccagagctgctggagcctgagacagagaaccagaggcagaagacagaccgccagcctgcagcccggcatcagcgaggacctgaagaaggtgaaggacagaatgggcatcgacagcagcgacaaggtggacttcttcatcctgctggacaacgtggccgccgagcaggcccacaacctgcccagctgccccatgctgaagagattcgccagaatgatcgagcagagagccgtggacaccagcctgtacatcctgcccaaggaggacagagagagcctgcagatggccgtgggccccttcctgcacatcctggagagcaacctgctgaaggccgtggacagcgccaccgcccccgacaagatcagaaagctgtacctgtacgccgcccacgacgtgaccttcatccccctgctgatgaccctgggcatcttcgaccacaagtggccccccttcgccgtggacctgaccatggagctgtaccagcacctggagagcaaggagtggttcgtgcagctgtactaccacggcaaggagcaggtgcccagaggctgccccgacggcctgtgccccctggacatgttcctgaacgccatgagcgtgtacaccctgagccccgagaagtaccacgccctgtgcagccagacccaggtgatggaggtgggcaacgaggagtag

SEQ ID NO: 4063 - DNA, 711 bp, Artificial Sequence; identical to SEQ ID NO: 4020
  Description of Artificial Sequence: Synthetic coding sequence

SEQ ID NO: 4064 - DNA, 990 bp, Artificial Sequence
  Description of Artificial Sequence: Synthetic coding sequence
atggtgaccaaggccttcgtgctgctggccatcttcgccgaggccagcgccaagagctgcgcccccaacaaggccgacgtgatcctggtgttctgctaccccaagaccatcatcaccaagatccccgagtgcccctacggctgggaggtgcaccagctggccctgggcggcctgtgctacaacggcgtgcacgagggcggctactaccagttcgtgatccccgacctgagccccaagaacaagagctactgcggcacccagagcgagtacaagccccccatctaccacttctacagccacatcgtgagcaacgacaccaccgtgatcgtgaagaaccagcccgtgaactacagcttcagctgcacctaccacagcacctacctggtgaaccaggccgccttcgaccagagagtggccaccgtgcacgtgaagaacggcagcatgggcaccttcgagagccagctgagcctgaacttctacaccaacgccaagttcagcatcaagaaggaggcccccttcgtgctggaggccagcgagatcggcagcgacctgttcgccggcgtggaggccaagggcctgagcatcagattcaaggtggtgctgaacagctgctgggccacccccagcgccgacttcatgtaccccctgcagtggcagctgatcaacaagggctgccccaccgacgagaccgtgctggtgcacgagaacggcagagaccacagagccaccttccagttcaacgccttcagattccagaacatccccaagctgagcaaggtgtggctgcactgcgagaccttcatctgcgacagcgagaagctgagctgccccgtgacctgcgacaagagaaagagactgctgagagaccagaccggcggcgtgctggtggtggagctgagcctgagaagcagaggcttcagcagcctgtacagcttcagcgacgtgctgcaccacctgatcatgatgctgggcatctgcgccgtgctgtag

SEQ ID NO: 4065 - DNA, 1161 bp, Artificial Sequence
  Description of Artificial Sequence: Synthetic coding sequence
atggcccagtggcactgcagccagagaacccaggccggcggccacggcgtgggcgagagactggcccagtgccaggaccagagcagcagacacgccgccgagctgagagacttcaagaacaagatgctgcccctgctggaggtggccgagaaggagagagaggccctgagaaccgaggccgacaccatcagcggcagagtggacagactggagagagaggtggactacctggagacccagaaccccgccctgccctgcgtggagttcgacgagaaggtgaccggcggccccggcaccaagggcaagggcagaagaaacgagaagtacgacatggtgaccgactgcggctacaccatcagccaggtgagaagcatgaagatcctgaagagattcggcggccccgccggcctgtggaccaaggaccccctgggccagaccgagaagatctacgtgctggacggcacccagaacgacaccgccttcgtgttccccagactgagagacttcaccctggccatggccgccagaaaggccagcagagtgagagtgcccttcccctgggtgggcaccggccagctggtgtacggcggcttcctgtacttcgccagaagaccccccggcagacccggcggcggcggcgagatggagaacaccctgcagctgatcaagttccacctggccaacagaaccgtggtggacagcagcgtgttccccgccgagggcctgatccccccctacggcctgaccgccgacacctacatcgacctggccgccgacgaggagggcctgtgggccgtgtacgccaccagagaggacgacagacacctgtgcctggccaagctggacccccagaccctggacaccgagcagcagtgggacaccccctgccccagagagaacgccgaggccgccttcgtgatctgcggcaccctgtacgtggtgtacaacaccagacccgccagcagagccagaatccagtgcagcttcgacgccagcggcaccctgacccccgagagagccgccctgccctacttccccagaagatacggcgcccacgccagcctgagatacaaccccagagagagacagctgtacgcctgggacgacggctaccagatcgtgtacaagctggagatgagaaagaaggaggaggaggtgtag

SEQ ID NO: 4066 - DNA, 510 bp, Artificial Sequence
  Description of Artificial Sequence: Synthetic coding sequence
atgagcgagagagtggagagaaactggagcaccggcggctggctgctggccctgtgcctggcctggctgtggacccacctgaccctggccgccctgcagccccccaccgccaccgtgctggtgcagcagggcacctgcgaggtgatcgccgcccacagatgctgcaacagaaacagaatcgaggagagaagccagaccgtgaagtgcagctgcttcagcggccaggtggccggcaccaccagagccaagcccagctgcgtggacgacctgctgctggccgcccactgcgccagaagagaccccagagccgccctgagactgctgctgccccagccccccagcagctgcagagacggcggcgtgagatggagccccgcctgcagaggcagaagcgtgagatgcagcagaacctgcagagacggcgccgccgccgtggacaccaagagcaagccccccagaagccacgacagcagctggggcagcagacccggccaggagagactggactag

SEQ ID NO: 4067 - DNA, 693 bp, Artificial Sequence; identical to SEQ ID NO: 3999
  Description of Artificial Sequence: Synthetic coding sequence

SEQ ID NO: 4068 - DNA, 1176 bp, Artificial Sequence
  Description of Artificial Sequence: Synthetic coding sequence
atgctgagacccggcggcgccgaggaggccgcccagctgcccctgagaagagccagcgcccccgtgcccgtgcccagccccgccgcccccgacggcagcagagccagcgccagactgggcctggcctgcctgctgctgctgctgctgctgaccctgcccgccagagtggacaccagctggtggtacatcggcgccctgggcgccagagtgatctgcgacaacatccccggcctggtgagcagacagagacagctgtgccagagataccccgacatcatgagaagcgtgggcgagggcgccagagagtggatcagagagtgccagcaccagttcagacaccacagatggaactgcaccaccctggacagagaccacaccgtgttcggcagagtgatgctgagaagcagcagagaggccgccttcgtgtacgccatcagcagcgccggcgtggtgcacgccatcaccagagcctgcagccagggcgagctgagcgtgtgcagctgcgacccctacaccagaggcagacaccacgaccagagaggcgacttcgactggggcggctgcagcgacaacatccactacggcgtgagattcgccaaggccttcgtggacgccaaggagaagagactgaaggacgccagagccctgatgaacctgcacaacaacagatgcggcagaaccgccgtgagaagattcctgaagctggagtgcaagtgccacggcgtgagcggcagctgcaccctgagaacctgctggagagccctgagcgacttcagaagaaccggcgactacctgagaagaagatacgacggcgccgtgcaggtgatggccacccaggacggcgccaacttcaccgccgccagacagggctacagaagagccaccagaaccgacctggtgtacttcgacaacagccccgactactgcgtgctggacaaggccgccggcagcctgggcaccgccggcagagtgtgcagcaagaccagcaagggcaccgacggctgcgagatcatgtgctgcggcagaggctacgacaccaccagagtgaccagagtgacccagtgcgagtgcaagttccactggtgctgcgccgtgagatgcaaggagtgcagaaacaccgtggacgtgcacacctgcaaggcccccaagaaggccgagtggctggaccagacctag

SEQ ID NO: 4069 - DNA, 1119 bp, Artificial Sequence
  Description of Artificial Sequence: Synthetic coding sequence
atgctggacggcctgggcgtggtggccatcagcatcttcggcatccagctgaagaccgagggcagcctgagaaccgccgtgcccggcatccccacccagagcgccttcaacaagtgcctgcagagatacatcggcgccctgggcgccagagtgatctgcgacaacatccccggcctggtgagcagacagagacagctgtgccagagataccccgacatcatgagaagcgtgggcgagggcgccagagagtggatcagagagtgccagcaccagttcagacaccacagatggaactgcaccaccctggacagagaccacaccgtgttcggcagagtgatgctgagaagcagcagagaggccgccttcgtgtacgccatcagcagcgccggcgtggtgcacgccatcaccagagcctgcagccagggcgagctgagcgtgtgcagctgcgacccctacaccagaggcagacaccacgaccagagaggcgacttcgactggggcggctgcagcgacaacatccactacggcgtgagattcgccaaggccttcgtggacgccaaggagaagagactgaaggacgccagagccctgatgaacctgcacaacaacagatgcggcagaaccgccgtgagaagattcctgaagctggagtgcaagtgccacggcgtgagcggcagctgcaccctgagaacctgctggagagccctgagcgacttcagaagaaccggcgactacctgagaagaagatacgacggcgccgtgcaggtgatggccacccaggacggcgccaacttcaccgccgccagacagggctacagaagagccaccagaaccgacctggtgtacttcgacaacagccccgactactgcgtgctggacaaggccgccggcagcctgggcaccgccggcagagtgtgcagcaagaccagcaagggcaccgacggctgcgagatcatgtgctgcggcagaggctacgacaccaccagagtgaccagagtgacccagtgcgagtgcaagttccactggtgctgcgccgtgagatgcaaggagtgcagaaacaccgtggacgtgcacacctgcaaggcccccaagaaggccgagtggctggaccagacctag

SEQ ID NO: 4070 - DNA, 1242 bp, Artificial Sequence
  Description of Artificial Sequence: Synthetic coding sequence
atggagaacatgctgctgtggctgatcttcttcacccccggctggaccctgatcgacggcagcgagatggagtgggacttcatgtggcacctgagaaaggtgcccagaatcgtgagcgagagaaccttccacctgaccagccccgccttcgaggccgacgccaagatgatggtgaacaccgtgtgcggcatcgagtgccagaaggagctgcccacccccagcctgagcgagctggaggactacctgagctacgagaccgtgttcgagaacggcaccagaaccctgaccagagtgaaggtgcaggacctggtgctggagcccacccagaacatcaccaccaagggcgtgagcgtgagaagaaagagacaggtgtacggcaccgacagcagattcagcatcctggacaagagattcctgaccaacttccccttcagcaccgccgtgaagctgagcaccggctgcagcggcatcctgatcagcccccagcacgtgctgaccgccgcccactgcgtgcacgacggcaaggactacgtgaagggcagcaagaagctgagagtgggcctgctgaagatgagaaacaagagcggcggcaagaagagaagaggcagcaagagaagcagaagagaggccagcggcggcgaccagagagagggcaccagagagcacctgagagagagagccaagggcggcagaagaagaaagaagagcggcagaggccagagaatcgccgagggcagacccagcttccagtggaccagagtgaagaacacccacatccccaagggctgggccagaggcggcatgggcgacgccaccctggactacgactacgccctgctggagctgaagagagcccacaagaagaagtacatggagctgggcatcagccccaccatcaagaagatgcccggcggcatgatccacttcagcggcttcgacaacgacagagccgaccagctggtgtacagattctgcagcgtgagcgacgagagcaacgacctgctgtaccagtactgcgacgccgagagcggcagcaccggcagcggcgtgtacctgagactgaaggaccccgacaagaagaactggaagagaaagatcatcgccgtgtacagcggccaccagtgggtggacgtgcacggcgtgcagaaggactacaacgtggccgtgagaatcacccccctgaagtacgcccagatctgcctgtggatccacggcaacgacgccaactgcgcctacggctag

SEQ ID NO: 4071 - DNA, 1143 bp, Artificial Sequence
  Description of Artificial Sequence: Synthetic coding sequence
atgggcgccaccaccatggaccagaagagcctgtgggccggcagcgcctacaagctggtgtgctacttcaccaactggagccaggacagacaggagcccggcaagttcacccccgagaacatcgaccccttcctgtgcagccacctgatctacagcttcgccagcatcgagaacaacaaggtgatcatcaaggacaagagcgaggtgatgctgtaccagaccatcaacagcctgaagaccaagaaccccaagctgaagatcctgctgagcatcggcggctacctgttcggcagcaagggcttccaccccatggtggacagcagcaccagcagactggagttcatcaacagcatcatcctgttcctgagaaaccacaacttcgacggcctggacgtgagctggatctaccccgaccagaaggagaacacccacttcaccgtgctgatccacgagctggccgaggccttccagaaggacttcaccaagagcaccaaggagagactgctgctgaccgccggcgtgagcgccggcagacagatgatcgacaacagctaccaggtggagaagctggccaaggacctggacttcatcaacctgctgagcttcgacttccacggcagctgggagaagcccctgatcaccggccacaacagccccctgagcaagggctggcaggacagaggccccagcagctactacaacgtggagtacgccgtgggctactggatccacaagggcatgcccagcgagaaggtggtgatgggcatccccacctacggccacagcttcaccctggccagcgccgagaccaccgtgggcgcccccgccagcggccccggcgccgccggccccatcaccgagagcagcggcttcctggcctactacgagatctgccagttcctgaagggcgccaagatcaccagactgcaggaccagcaggtgccctacgccgtgaagggcaaccagtgggtgggctacgacgacgtgaagagcatggagaccaaggtgcagttcctgaagaacctgaacctgggcggcgccatgatctggagcatcgacatggacgacttcaccggcaagagctgcaaccagggcccctaccccctggtgcaggccgtgaagagaagcctgggcagcctgtag

SEQ ID NO: 4072 - DNA, 1173 bp, Artificial Sequence
  Description of Artificial Sequence: Synthetic coding sequence
atgggcgccaccaccatggaccagaagagcctgtgggccggcgtggtggtgctgctgctgctgcagggcggcagcgcctacaagctggtgtgctacttcaccaactggagccaggacagacaggagcccggcaagttcacccccgagaacatcgaccccttcctgtgcagccacctgatctacagcttcgccagcatcgagaacaacaaggtgatcatcaaggacaagagcgaggtgatgctgtaccagaccatcaacagcctgaagaccaagaaccccaagctgaagatcctgctgagcatcggcggctacctgttcggcagcaagggcttccaccccatggtggacagcagcaccagcagactggagttcatcaacagcatcatcctgttcctgagaaaccacaacttcgacggcctggacgtgagctggatctaccccgaccagaaggagaacacccacttcaccgtgctgatccacgagctggccgaggccttccagaaggacttcaccaagagcaccaaggagagactgctgctgaccgccggcgtgagcgccggcagacagatgatcgacaacagctaccaggtggagaagctggccaaggacctggacttcatcaacctgctgagcttcgacttccacggcagctgggagaagcccctgatcaccggccacaacagccccctgagcaagggctggcaggacagaggccccagcagctactacaacgtggagtacgccgtgggctactggatccacaagggcatgcccagcgagaaggtggtgatgggcatccccacctacggccacagcttcaccctggccagcgccgagaccaccgtgggcgcccccgccagcggccccggcgccgccggccccatcaccgagagcagcggcttcctggcctactacgagatctgccagttcctgaagggcgccaagatcaccagactgcaggaccagcaggtgccctacgccgtgaagggcaaccagtgggtgggctacgacgacgtgaagagcatggagaccaaggtgcagttcctgaagaacctgaacctgggcggcgccatgatctggagcatcgacatggacgacttcaccggcaagagctgcaaccagggcccctaccccctggtgcaggccgtgaagagaagcctgggcagcctgtag

SEQ ID NO: 4073 - DNA, 2202 bp, Artificial Sequence
  Description of Artificial Sequence: Synthetic coding sequence
atggccggcggcagagagacctgcctgcccctgatcggcttcatcctgatctgcctgaagatggtggccagcgccaagagcgcccccgagatccccaccatcgaccaggcctacagcaagctgagcaacagcatcaccgtggagtgggccaccgtgcccggcgccaccagctacctgctgaccgccgaggacggcgacaccgtgatcgagaccaccgtggccaacagccccggcaccgtgaccggcctgaaggccgccacctggtacgagatcaccatcagaagcatcagcgccgccggcagaagccaggccagcccccccaagcaggccaagaccgtgctggccgcccccatcctggaggtgagcagccccagcagcgacagcatcctggtgcagtgggaggccgtgtacatggccatcgccttcagcgtgagcatcatgagagccaacggcctgggcagcatctggaaggagaacaccaccaacaccagcctgaccttcaccagcctggaggccggcaccctgtacaccatcaaggcctacgcctggaacgccaacagaatccccggcgacgacagcacctgcaaccagagaaccagccccagagcccccgccaacatccaggtgagcttcgacagcggcgccctgaaggccagcttcagctgggccagagccgagggcgccttcaactacaccgtgatggccctgagcgacagcagcgagctgacctgcagcaccaccttcagcagctgcaccatcagcagcctgcagtgcggcaccgagtacctgatcagcgtgctggccagcaacgacgccggcagcagcaagagcagcagcgccatgaccctgaagaccgtggcctgcgcccccggcagagtgaccatccaggaggacccccccggccacctgagcgtggcctggagcagcgtggacctgggcgactactacgtggtgttcgtgaagagcgacgacggcctggaggtgcactgcaacaccagcctgacccagtgcaacttcctgagcgagtgcggcttcacctacttcatcagcgtgttcgtgtacaacaaggccggccagagccccctgggcgacatcttcaactacaccaccgccccctgctgccccagcgacatcaaccccgtgctggtgagcagcgacagagtggagatcgtgtggagccccgtgagaggcgccgagctgtacgagaccaaggccgtggacggctacaacatggtggagtgcaacgacaccacccccgcctgcaccctgagcgccctggagtgcgacaccaagtacaacatcaccgtgtacagcttcaacgaggtgagaggcagcaacatgagctgcaccccccagttcatcaccaccgccccctgcagccccgagatcaagaacgtgagcagagacgccttcagcatgatcaacgtgcactggagaagcaccaacgacgacgccacctacaccgtgaccgcccagggcgagaagggcctgtaccagtgcagcagcaccggcgagagctgcaccatgagaggcctgccctgcggcagcgtgttcagcgtgaccgccgtggccgagacccaggccggcagaagcctgcccagctacagcgtgcccctggagaccgtgccctgctgccccaccggcctgaccgtgacccagatcacccagagcgtgatcaacgtgagctggaccatcggcagagtggcccagacccacgtggccgtgctggagagccacaccggccagagcaagtgccacacccaccagaaccactgcctgctgggctgcatcacctgcggcatcaactacaccgtgaccctgaaggccatcagcgccaccggcctgaccgccgactgcagctaccagagctacttcagcggcgcctgctgccccctgggcgtgaagctgtacagactgggccccaacggcatcagaatctactggcaggccagcagaggcagcgccaactacagcaccgacctgtacggcagcaagggcatcttcacctgcacccccagcgccggcctgagcttctgcgacgtgaccgagatcccctgcggcgacgtgtacaccgtgatggtgagccccgtggccaagaccggcctgaagctgaccttctgccccaagaagatctacagcgtgacctgcagcggcagcaccctgggcatggtgatctacagaggcaagagaaacgaggagtag

SEQ ID NO: 4074 - DNA, 555 bp, Artificial Sequence
  Description of Artificial Sequence: Synthetic coding sequence
atgagaggccagggcagaaaggagagcctgagcgacagcagagacctggacggcagctacgaccagctgaccgacagcgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 4075 - DNA, 759 bp, Artificial Sequence
  Description of Artificial Sequence: Synthetic coding sequence
atgagaggccagggcagaaaggagagcctgagcgacagcagagacctggacggcagctacgaccagctgaccggccacccccccggccccaccaagaaggccctgaagcagagattcctgaagctgctgccctgctgcggcccccaggccctgcccagcgtgagcgagagcaacgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 4076 - DNA, 1377 bp, Artificial Sequence
  Description of Artificial Sequence: Synthetic coding sequence
atgcaggccaccagcaacctgctgaacctgctgctgctgagcctgttcgccggcctggaccccagcaagacccagatcagccccaaggagggctggcaggtgtacagcagcgcccaggaccccgacggcagatgcatctgcaccgtggtggcccccgagcagaacctgtgcagcagagacgccaagagcagacagctgagacagctgctggagaaggtgcagaacatgagccagagcatcgaggtgctgaacctgagaacccagagagacttccagtacgtgctgaagatggagacccagatgaagggcctgaaggccaagttcagacagatcgaggacgacagaaagaccctgatgaccaagcacttccaggagctgaaggagaagatggacgagctgctgcccctgatccccgtgctggagcagtacaagaccgacgccaagctgatcacccagttcaaggaggagatcagaaacctgagcgccgtgctgaccggcatccaggaggagatcggcgcctacgactacgaggagctgcaccagagagtgctgagcctggagaccagactgagagactgcatgaagaagctgacctgcggcaagctgatgaagatcaccggccccgtgaccgtgaagaccagcggcaccagattcggcgcctggatgaccgaccccctggccagcgagaagaacaacagagtgtggtacatggacagctacaccaacaacaagatcgtgagagagtacaagagcatcgccgacttcgtgagcggcgccgagagcagaacctacaacctgcccttcaagtgggccggcaccaaccacgtggtgtacaacggcagcctgtacttcaacaagtaccagagcaacatcatcatcaagtacagcttcgacatgggcagagtgctggcccagagaagcctggagtacgccggcttccacaacgtgtacccctacacctggggcggcttcagcgacatcgacctgatggccgacgagatcggcctgtgggccgtgtacgccaccaaccagaacgccggcaacatcgtgatcagccagctgaaccaggacaccctggaggtgatgaagagctggagcaccggctaccccaagagaagcgccggcgagagcttcatgatctgcggcaccctgtacgtgaccaacagccacctgaccggcgccaaggtgtactacagctacagcaccaagaccagcacctacgagtacaccgacatccccttccacaaccagtacttccacatcagcatgctggactacaacgccagagacagagccctgtacgcctggaacaacggccaccaggtgctgttcaacgtgaccctgttccacatcatcaagaccgaggacgacacctag

SEQ ID NO: 4077 - DNA, 915 bp, Artificial Sequence
  Description of Artificial Sequence: Synthetic coding sequence
atgctgcccccccccagacccgccgccgccctggccctgcccgtgctgctgctgctgctggtggtgctgacccccccccccaccggcgccagacccagccccggccccgactacctgagaagaggctggatgagactgctggccgagggcgagggctgcgccccctgcagacccgaggagtgcgccgcccccagaggctgcctggccggcagagtgagagacgcctgcggctgctgctgggagtgcgccaacctggagggccagctgtgcgacctggaccccagcgcccacttctacggccactgcggcgagcagctggagtgcagactggacaccggcggcgacctgagcagaggcgaggtgcccgagcccctgtgcgcctgcagaagccagagccccctgtgcggcagcgacggccacacctacagccagatctgcagactgcaggaggccgccagagccagacccgacgccaacctgaccgtggcccaccccggcccctgcgagagcggcccccagatcgtgagccacccctacgacacctggaacgtgaccggccaggacgtgatcttcggctgcgaggtgttcgcctaccccatggccagcatcgagtggagaaaggacggcctggacatccagctgcccggcgacgacccccacatcagcgtgcagttcagaggcggcccccagagattcgaggtgaccggctggctgcagatccaggccgtgagacccagcgacgagggcacctacagatgcctgggcagaaacgccctgggccaggtggaggcccccgccagcctgaccgtgctgacccccgaccagctgaacagcaccggcatcccccagctgagaagcctgaacctggtgcccgaggaggaggccgagagcgaggagaacgacgactactactag

SEQ ID NO: 4078 - DNA, 327 bp, Artificial Sequence
  Description of Artificial Sequence: Synthetic coding sequence
atgacccccagcagactgccctggctgctgagctgggtgagcgccaccgcctggagagccgccagaagccccctgctgtgccacagcctgagaaagaccagcagcagccagggcggcaagagcgagctggtgaagcagagcctgaagaagcccaagctgcccgagggcagattcgacgcccccgaggacagccacctggagaaggagcccctggagaagttccccgacgacgtgaaccccgtgaccaaggagaagggcggccccagaggccccgagcccaccagatacggcgactgggagagaaagggcagatgcatcgacttctag

SEQ ID NO: 4079 - DNA, 663 bp, Artificial Sequence
  Description of Artificial Sequence: Synthetic coding sequence
atggccggcctgagcagaggcagcgccagagccctgctggccgccctgctggccagcaccctgctggccctgctggtgagccccgccagaggcagaggcggcagagaccacggcgactgggacgaggccagcagactgccccccctgccccccagagaggacgccgccagagtggccagattcgtgacccacgtgagcgactggggcgccctggccaccatcagcaccctggaggccgtgagaggcagacccttcgccgacgtgctgagcctgagcgacggcccccccggcgccggcagcggcgtgccctacttctacctgagccccctgcagctgagcgtgagcaacctgcaggagaacccctacgccaccctgaccatgaccctggcccagaccaacttctgcaagaagcacggcttcgacccccagagccccctgtgcgtgcacatcatgctgagcggcaccgtgaccaaggtgaacgagaccgagatggacatcgccaagcacagcctgttcatcagacaccccgagatgaagacctggcccagcagccacaactggttcttcgccaagctgaacatcaccaacatctgggtgctggactacttcggcggccccaagatcgtgacccccgaggagtactacaacgtgaccgtgcagtag

SEQ ID NO: 4080 - DNA, 2760 bp, Artificial Sequence
  Description of Artificial Sequence: Synthetic coding sequence
atgggcctgttcagaggcttcgtgttcctgctggtgctgtgcctgctgcaccagagcaacaccagcttcatcaagctgaacaacaacggcttcgaggacatcgtgatcgtgatcgaccccagcgtgcccgaggacgagaagatcatcgagcagatcgaggacatggtgaccaccgccagcacctacctgttcgaggccaccgagaagagattcttcttcaagaacgtgagcatcctgatccccgagaactggaaggagaacccccagtacaagagacccaagcacgagaaccacaagcacgccgacgtgatcgtggccccccccaccctgcccggcagagacgagccctacaccaagcagttcaccgagtgcggcgagaagggcgagtacatccacttcacccccgacctgctgctgggcaagaagcagaacgagtacggcccccccggcaagctgttcgtgcacgagtgggcccacctgagatggggcgtgttcgacgagtacaacgaggaccagcccttctacagagccaagagcaagaagatcgaggccaccagatgcagcgccggcatcagcggcagaaacagagtgtacaagtgccagggcggcagctgcctgagcagagcctgcagaatcgacagcaccaccaagctgtacggcaaggactgccagttcttccccgacaaggtgcagaccgagaaggccagcatcatgttcatgcagagcatcgacagcgtggtggagttctgcaacgagaagacccacaaccaggaggcccccagcctgcagaacatcaagtgcaacttcagaagcacctgggaggtgatcagcaacagcgaggacttcaagaacaccatccccatggtgacccccccccccccccccgtgttcagcctgctgaagatcagccagagaatcgtgtgcctggtgctggacaagagcggcagcatgggcggcaaggacagactgaacagaatgaaccaggccgccaagcacttcctgctgcagaccgtggagaacggcagctgggtgggcatggtgcacttcgacagcaccgccaccatcgtgaacaagctgatccagatcaagagcagcgacgagagaaacaccctgatggccggcctgcccacctaccccctgggcggcaccagcatctgcagcggcatcaagtacgccttccaggtgatcggcgagctgcacagccagctggacggcagcgaggtgctgctgctgaccgacggcgaggacaacaccgccagcagctgcatcgacgaggtgaagcagagcggcgccatcgtgcacttcatcgccctgggcagagccgccgacgaggccgtgatcgagatgagcaagatcaccggcggcagccacttctacgtgagcgacgaggcccagaacaacggcctgatcgacgccttcggcgccctgaccagcggcaacaccgacctgagccagaagagcctgcagctggagagcaagggcctgaccctgaacagcaacgcctggatgaacgacaccgtgatcatcgacagcaccgtgggcaaggacaccttcttcctgatcacctggaacagcctgccccccagcatcagcctgtgggaccccagcggcaccatcatggagaacttcaccgtggacgccaccagcaagatggcctacctgagcatccccggcaccgccaaggtgggcacctgggcctacaacctgcaggccaaggccaaccccgagaccctgaccatcaccgtgaccagcagagccgccaacagcagcgtgccccccatcaccgtgaacgccaagatgaacaaggacgtgaacagcttccccagccccatgatcgtgtacgccgagatcctgcagggctacgtgcccgtgctgggcgccaacgtgaccgccttcatcgagagccagaacggccacaccgaggtgctggagctgctggacaacggcgccggcgccgacagcttcaagaacgacggcgtgtacagcagatacttcaccgcctacaccgagaacggcagatacagcctgaaggtgagagcccacggcggcgccaacaccgccagactgaagctgagaccccccctgaacagagccgcctacatccccggctgggtggtgaacggcgagatcgaggccaacccccccagacccgagatcgacgaggacacccagaccaccctggaggacttcagcagaaccgccagcggcggcgccttcgtggtgagccaggtgcccagcctgcccctgcccgaccagtacccccccagccagatcaccgacctggacgccaccgtgcacgaggacaagatcatcctgacctggaccgcccccggcgacaacttcgacgtgggcaaggtgcagagatacatcatcagaatcagcgccagcatcctggacctgagagacagcttcgacgacgccctgcaggtgaacaccaccgacctgagccccaaggaggccaacagcaaggagagcttcgccttcaagcccgagaacatcagcgaggagaacgccacccacatcttcatcgccatcaagagcatcgacaagagcaacctgaccagcaaggtgagcaacatcgcccaggtgaccctgttcatcccccaggccaaccccgacgacatcgaccccacccccacccccacccccacccccacccccgacaagagccacaacagcggcgtgaacatcagcaccctggtgctgagcgtgatcggcagcgtggtgatcgtgaacttcatcctgagcaccaccatctag

SEQ ID NO: 4081 - DNA, 1938 bp, Artificial Sequence
  Description of Artificial Sequence: Synthetic coding sequence
atggcccccagcgccgaccccggcatgagcagaatgctgcccttcctgctgctgctgtggttcctgcccatcaccgagggcagccagagagccgagcccatgttcaccgccgtgaccaacagcgtgctgccccccgactacgacagcaaccccacccagctgaactacggcgtggccgtgaccgacgtggaccacgacggcgacttcgagatcgtggtggccggctacaacggccccaacctggtgctgaagtacgacagagcccagaagagactggtgaacatcgccgtggacgagagaagcagcccctactacgccctgagagacagacagggcaacgccatcggcgtgaccgcctgcgacatcgacggcgacggcagagaggagatctacttcctgaacaccaacaacgccttcagcggcgtggccacctacaccgacaagctgttcaagttcagaaacaacagatgggaggacatcctgagcgacgaggtgaacgtggccagaggcgtggccagcctgttcgccggcagaagcgtggcctgcgtggacagaaagggcagcggcagatacagcatctacatcgccaactacgcctacggcaacgtgggccccgacgccctgatcgagatggaccccgaggccagcgacctgagcagaggcatcctggccctgagagacgtggccgccgaggccggcgtgagcaagtacaccggcggcagaggcgtgagcgtgggccccatcctgagcagcagcgccagcgacatcttctgcgacaacgagaacggccccaacttcctgttccacaacagaggcgacggcaccttcgtggacgccgccgccagcgccggcgtggacgacccccaccagcacggcagaggcgtggccctggccgacttcaacagagacggcaaggtggacatcgtgtacggcaactggaacggcccccacagactgtacctgcagatgagcacccacggcaaggtgagattcagagacatcgccagccccaagttcagcatgcccagccccgtgagaaccgtgatcaccgccgacttcgacaacgaccaggagctggagatcttcttcaacaacatcgcctacagaagcagcagcgccaacagactgttcagagtgatcagaagagagcacggcgaccccctgatcgaggagctgaaccccggcgacgccctggagcccgagggcagaggcaccggcggcgtggtgaccgacttcgacggcgacggcatgctggacctgatcctgagccacggcgagagcatggcccagcccctgagcgtgttcagaggcaaccagggcttcaacaacaactggctgagagtggtgcccagaaccagattcggcgccttcgccagaggcgccaaggtggtgctgtacaccaagaagagcggcgcccacctgagaatcatcgacggcggcagcggctacctgtgcgagatggagcccgtggcccacttcggcctgggcaaggacgaggccagcagcgtggaggtgacctggcccgacggcaagatggtgagcagaaacgtggccagcggcgagatgaacagcgtgctggagatcctgtaccccagagacgaggacaccctgcaggaccccgcccccctggagtgcggccagggcttcagccagcaggagaacggccactgcatggacaccaacgagtgcatccagttccccttcgtgtgccccagagacaagcccgtgtgcgtgaacacctacggcagctacagatgcagaaccaacaagaagtgcagcagaggctacgagcccaacgaggacggcaccgcctgcgtggcccaggtggccttcctgggcggctacagcagcgccgccagcagaatcagcgagcccctgagcagagccagctacctgagcctgggcctgggcctgtgcctgcagctgtacgccctgtag

SEQ ID NO: 4082 - DNA, 1986 bp, Artificial Sequence
  Description of Artificial Sequence: Synthetic coding sequence
atggcccccagcgccgaccccggcatgagcagaatgctgcccttcctgctgctgctgtggttcctgcccatcaccgagggcagccagagagccgagcccatgttcaccgccgtgaccaacagcgtgctgccccccgactacgacagcaaccccacccagctgaactacggcgtggccgtgaccgacgtggaccacgacggcgacttcgagatcgtggtggccggctacaacggccccaacctggtgctgaagtacgacagagcccagaagagactggtgaacatcgccgtggacgagagaagcagcccctactacgccctgagagacagacagggcaacgccatcggcgtgaccgcctgcgacatcgacggcgacggcagagaggagatctacttcctgaacaccaacaacgccttcagcggcgtggccacctacaccgacaagctgttcaagttcagaaacaacagatgggaggacatcctgagcgacgaggtgaacgtggccagaggcgtggccagcctgttcgccggcagaagcgtggcctgcgtggacagaaagggcagcggcagatacagcatctacatcgccaactacgcctacggcaacgtgggccccgacgccctgatcgagatggaccccgaggccagcgacctgagcagaggcatcctggccctgagagacgtggccgccgaggccggcgtgagcaagtacaccggcggcagaggcgtgagcgtgggccccatcctgagcagcagcgccagcgacatcttctgcgacaacgagaacggccccaacttcctgttccacaacagaggcgacggcaccttcgtggacgccgccgccagcgccggcgtggacgacccccaccagcacggcagaggcgtggccctggccgacttcaacagagacggcaaggtggacatcgtgtacggcaactggaacggcccccacagactgtacctgcagatgagcacccacggcaaggtgagattcagagacatcgccagccccaagttcagcatgcccagccccgtgagaaccgtgatcaccgccgacttcgacaacgaccaggagctggagatcttcttcaacaacatcgcctacagaagcagcagcgccaacagactgttcagagtgatcagaagagagcacggcgaccccctgatcgaggagctgaaccccggcgacgccctggagcccgagggcagaggcaccggcggcgtggtgaccgacttcgacggcgacggcatgctggacctgatcctgagccacggcgagagcatggcccagcccctgagcgtgttcagaggcaaccagggcttcaacaacaactggctgagagtggtgcccagaaccagattcggcgccttcgccagaggcgccaaggtggtgctgtacaccaagaagagcggcgcccacctgagaatcatcgacggcggcagcggctacctgtgcgagatggagcccgtggcccacttcggcctgggcaaggacgaggccagcagcgtggaggtgacctggcccgacggcaagatggtgagcagaaacgtggccagcggcgagatgaacagcgtgctggagatcctgtaccccagagacgaggacaccctgcaggaccccgcccccctggagtgcggccagggcttcagccagcaggagaacggccactgcatggacaccaacgagtgcatccagttccccttcgtgtgccccagagacaagcccgtgtgcgtgaacacctacggcagctacagatgcagaaccaacaagaagtgcagcagaggctacgagcccaacgaggacggcaccgcctgcgtgggcaccctgggccagagccccggccccagacccaccacccccaccgccgccgccgccaccgccgccgccgccgccgccgccggcgccgccaccgccgcccccgtgctggtggacggcgacctgaacctgggcagcgtggtgaaggagagctgcgagcccagctgctag

SEQ ID NO: 4083 - DNA, 1230 bp, Artificial Sequence
  Description of Artificial Sequence: Synthetic coding sequence
atggccctgacccccggctggggcagcagcgccggccccgtgagacccgagctgtggctgctgctgtgggccgccgcctggagactgggcgccagcgcctgccccgccctgtgcacctgcaccggcaccaccgtggactgccacggcaccggcctgcaggccatccccaagaacatccccagaaacaccgagagactggagctgaacggcaacaacatcaccagaatccacaagaacgacttcgccggcctgaagcagctgagagtgctgcagctgatggagaaccagatcggcgccgtggagagaggcgccttcgacgacatgaaggagctggagagactgagactgaacagaaaccagctgcacatgctgcccgagctgctgttccagaacaaccaggccctgagcagactggacctgagcgagaacgccatccaggccatccccagaaaggccttcagaggcgccaccgacctgaagaacctgcagctggacaagaaccagatcagctgcatcgaggagggcgccttcagagccctgagaggcctggaggtgctgaccctgaacaacaacaacatcaccaccatccccgtgagcagcttcaaccacatgcccaagctgagaaccttcagactgcacagcaaccacctgttctgcgactgccacctggcctggctgagccagtggctgagacagagacccaccatcggcctgttcacccagtgcagcggccccgccagcctgagaggcctgaacgtggccgaggtgcagaagagcgagttcagctgcagcggccagggcgaggccggcagagtgcccacctgcaccctgagcagcggcagctgccccgccatgtgcacctgcagcaacggcatcgtggactgcagaggcaagggcctgaccgccatccccgccaacctgcccgagaccatgaccgagatcagactggagctgaacggcatcaagagcatcccccccggcgccttcagcccctacagaaagctgagaagaatcgacctgagcaacaaccagatcgccgagatcgcccccgacgccttccagggcctgagaagcctgaacagcctgcacaccggccccgtgacctgcccccacaccaccggcacccacagcagccactgcagagccttcgccgtggccgtgccccacagcagaaacgacctggaggccatgttcgaggaggaggtgcccagaatcttctacagcgcctag

SEQ ID NO: 4084 - DNA, 1143 bp, Artificial Sequence
  Description of Artificial Sequence: Synthetic coding sequence
atggccctgacccccggctggggcagcagcgccggccccgtgagacccgagctgtggctgctgctgtgggccgccgcctggagactgggcgccagcgcctgccccgccctgtgcacctgcaccggcaccaccgtggactgccacggcaccggcctgcaggccatccccaagaacatccccagaaacaccgagagactggagctgaacggcaacaacatcaccagaatccacaagaacgacttcgccggcctgaagcagctgagagtgctgcagctgatggagaaccagatcggcgccgtggagagaggcgccttcgacgacatgaaggagctggagagactggacctgagcgagaacgccatccaggccatccccagaaaggccttcagaggcgccaccgacctgaagaacctgcagctggacaagaaccagatcagctgcatcgaggagggcgccttcagagccctgagaggcctggaggtgctgaccctgaacaacaacaacatcaccaccatccccgtgagcagcttcaaccacatgcccaagctgagaaccttcagactgcacagcaaccacctgttctgcgactgccacctggcctggctgagccagtggctgagacagagacccaccatcggcctgttcacccagtgcagcggccccgccagcctgagaggcctgaacgtggccgaggtgcagaagagcgagttcagctgcagcggccagggcgaggccggcagagtgcccacctgcaccctgagcagcggcagctgccccgccatgtgcacctgcagcaacggcatcgtggactgcagaggcaagggcctgaccgccatccccgccaacctgcccgagaccatgaccgagatcagactggagctgaacggcatcaagagcatcccccccggcgccttcagcccctacagaaagctgagaagaatcgacctgagcaacaaccagatcgccgagatcgcccccgacgccttccagggcctgagaagcctgaacagcctggtgctgtacggcaacaagatcaccgacctgcccagaggcgtgttcggcggcctgtacaccctgcagctgctgctgctgaacgccaacaagatcaactgcatcagacccgacgccttccaggacctgtag

SEQ ID NO: 4085 - DNA, 2448 bp, Artificial Sequence
  Description of Artificial Sequence: Synthetic coding sequence
atggccctgacccccggctggggcagcagcgccggccccgtgagacccgagctgtggctgctgctgtgggccgccgcctggagactgggcgccagcgcctgccccgccctgtgcacctgcaccggcaccaccgtggactgccacggcaccggcctgcaggccatccccaagaacatccccagaaacaccgagagactggagctgaacggcaacaacatcaccagaatccacaagaacgacttcgccggcctgaagcagctgagagtgctgcagctgatggagaaccagatcggcgccgtggagagaggcgccttcgacgacatgaaggagctggagagactgagactgaacagaaaccagctgcacatgctgcccgagctgctgttccagaacaaccaggccctgagcagactggacctgagcgagaacgccatccaggccatccccagaaaggccttcagaggcgccaccgacctgaagaacctgcagctggacaagaaccagatcagctgcatcgaggagggcgccttcagagccctgagaggcctggaggtgctgaccctgaacaacaacaacatcaccaccatccccgtgagcagcttcaaccacatgcccaagctgagaaccttcagactgcacagcaaccacctgttctgcgactgccacctggcctggctgagccagtggctgagacagagacccaccatcggcctgttcacccagtgcagcggccccgccagcctgagaggcctgaacgtggccgaggtgcagaagagcgagttcagctgcagcggccagggcgaggccggcagagtgcccacctgcaccctgagcagcggcagctgccccgccatgtgcacctgcagcaacggcatcgtggactgcagaggcaagggcctgaccgccatccccgccaacctgcccgagaccatgaccgagatcagactggagctgaacggcatcaagagcatcccccccggcgccttcagcccctacagaaagctgagaagaatctgccccctgagcttctgcagcccctgcagagacctgagcaacaaccagatcgccgagatcgcccccgacgccttccagggcctgagaagcctgaacagcctggtgctgtacggcaacaagatcaccgacctgcccagaggcgtgttcggcggcctgtacaccctgcagctgctgctgctgaacgccaacaagatcaactgcatcagacccgacgccttccaggacctgcagaacctgagcctgctgagcctgtacgacaacaagatccagagcctggccaagggcaccttcaccagcctgagagccatccagaccctgcacctggcccagaaccccttcatctgcgactgcaacctgaagtggctggccgacttcctgagaaccaaccccatcgagaccagcggcgccagatgcgccagccccagaagactggccaacaagagaatcggccagatcaagagcaagaagttcagatgcagcgccaaggagcagtacttcatccccggcaccgaggactaccagctgaacagcgagtgcaacagcgacgtggtgtgcccccacaagtgcagatgcgaggccaacgtggtggagtgcagcagcctgaagctgaccaagatccccgagagaatcccccagagcaccgccgagctgagactgaacaacaacgagatcagcatcctggaggccaccggcatgttcaagaagctgacccacctgaagaagatcaacctgagcaacaacaaggtgagcgagatcgaggacggcgccttcgagggcgccgccagcgtgagcgagctgcacctgaccgccaaccagctggagagcatcagaagcggcatgttcagaggcctggacggcctgagaaccctgatgctgagaaacaacagaatcagctgcatccacaacgacagcttcaccggcctgagaaacgtgagactgctgagcctgtacgacaaccagatcaccaccgtgagccccggcgccttcgacaccctgcagagcctgagcaccctgaacctgctggccaaccccttcaactgcaactgccagctggcctggctgggcggctggctgagaaagagaaagatcgtgaccggcaaccccagatgccagaaccccgacttcctgagacagatccccctgcaggacgtggccttccccgacttcagatgcgaggagggccaggaggagggcggctgcctgcccagaccccagtgcccccaggagtgcgcctgcctggacaccgtggtgagatgcagcaacaagcacctgagagccctgcccaagggcatccccaagaacgtgaccgagctgtacctggacggcaaccagttcaccctggtgcccggccagctgagcaccttcaagtacctgcagctggtgatcctgagctacaacgccctgcagtgcatcccccccctggccttccagtag

SEQ ID NO: 4086 - DNA, 4386 bp, Artificial Sequence
  Description of Artificial Sequence: Synthetic coding sequence
atggccctgacccccggctggggcagcagcgccggccccgtgagacccgagctgtggctgctgctgtgggccgccgcctggagactgggcgccagcgcctgccccgccctgtgcacctgcaccggcaccaccgtggactgccacggcaccggcctgcaggccatccccaagaacatccccagaaacaccgagagactggagctgaacggcaacaacatcaccagaatccacaagaacgacttcgccggcctgaagcagctgagagtgctgcagctgatggagaaccagatcggcgccgtggagagaggcgccttcgacgacatgaaggagctggagagactgagactgaacagaaaccagctgcacatgctgcccgagctgctgttccagaacaaccaggccctgagcagactggacctgagcgagaacgccatccaggccatccccagaaaggccttcagaggcgccaccgacctgaagaacctgcagctggacaagaaccagatcagctgcatcgaggagggcgccttcagagccctgagaggcctggaggtgctgaccctgaacaacaacaacatcaccaccatccccgtgagcagcttcaaccacatgcccaagctgagaaccttcagactgcacagcaaccacctgttctgcgactgccacctggcctggctgagccagtggctgagacagagacccaccatcggcctgttcacccagtgcagcggccccgccagcctgagaggcctgaacgtggccgaggtgcagaagagcgagttcagctgcagcggccagggcgaggccggcagagtgcccacctgcaccctgagcagcggcagctgccccgccatgtgcacctgcagcaacggcatcgtggactgcagaggcaagggcctgaccgccatccccgccaacctgcccgagaccatgaccgagatcagactggagctgaacggcatcaagagcatcccccccggcgccttcagcccctacagaaagctgagaagaatcgacctgagcaacaaccagatcgccgagatcgcccccgacgccttccagggcctgagaagcctgaacagcctggtgctgtacggcaacaagatcaccgacctgcccagaggcgtgttcggcggcctgtacaccctgcagctgctgctgctgaacgccaacaagatcaactgcatcagacccgacgccttccaggacctgcagaacctgagcctgctgagcctgtacgacaacaagatccagagcctggccaagggcaccttcaccagcctgagagccatccagaccctgcacctggcccagaaccccttcatctgcgactgcaacctgaagtggctggccgacttcctgagaaccaaccccatcgagaccagcggcgccagatgcgccagccccagaagactggccaacaagagaatcggccagatcaagagcaagaagttcagatgcagcgccaaggagcagtacttcatccccggcaccgaggactaccagctgaacagcgagtgcaacagcgacgtggtgtgcccccacaagtgcagatgcgaggccaacgtggtggagtgcagcagcctgaagctgaccaagatccccgagagaatcccccagagcaccgccgagctgagactgaacaacaacgagatcagcatcctggaggccaccggcatgttcaagaagctgacccacctgaagaagatcaacctgagcaacaacaaggtgagcgagatcgaggacggcgccttcgagggcgccgccagcgtgagcgagctgcacctgaccgccaaccagctggagagcatcagaagcggcatgttcagaggcctggacggcctgagaaccctgatgctgagaaacaacagaatcagctgcatccacaacgacagcttcaccggcctgagaaacgtgagactgctgagcctgtacgacaaccagatcaccaccgtgagccccggcgccttcgacaccctgcagagcctgagcaccctgaacctgctggccaaccccttcaactgcaactgccagctggcctggctgggcggctggctgagaaagagaaagatcgtgaccggcaaccccagatgccagaaccccgacttcctgagacagatccccctgcaggacgtggccttccccgacttcagatgcgaggagggccaggaggagggcggctgcctgcccagaccccagtgcccccaggagtgcgcctgcctggacaccgtggtgagatgcagcaacaagcacctgagagccctgcccaagggcatccccaagaacgtgaccgagctgtacctggacggcaaccagttcaccctggtgcccggccagctgagcaccttcaagtacctgcagctggtggacctgagcaacaacaagatcagcagcctgagcaacagcagcttcaccaacatgagccagctgaccaccctgatcctgagctacaacgccctgcagtgcatcccccccctggccttccagggcctgagaagcctgagactgctgagcctgcacggcaacgacatcagcaccctgcaggagggcatcttcgccgacgtgaccagcctgagccacctggccatcggcgccaaccccctgtactgcgactgccacctgagatggctgagcagctgggtgaagaccggctacaaggagcccggcatcgccagatgcgccggcccccaggacatggagggcaagctgctgctgaccacccccgccaagaagttcgagtgccagggcccccccaccctggccgtgcaggccaagtgcgacctgtgcctgagcagcccctgccagaaccagggcacctgccacaacgaccccctggaggtgtacagatgcgcctgccccagcggctacaagggcagagactgcgaggtgagcctggacagctgcagcagcggcccctgcgagaacggcggcacctgccacgcccaggagggcgaggacgcccccttcacctgcagctgccccaccggcttcgagggccccacctgcggcgtgaacaccgacgactgcgtggaccacgcctgcgccaacggcggcgtgtgcgtggacggcgtgggcaactacacctgccagtgccccctgcagtacgagggcaaggcctgcgagcagctggtggacctgtgcagccccgacctgaacccctgccagcacgaggcccagtgcgtgggcacccccgacggccccagatgcgagtgcatgcccggctacgccggcgacaactgcagcgagaaccaggacgactgcagagaccacagatgccagaacggcgcccagtgcatggacgaggtgaacagctacagctgcctgtgcgccgagggctacagcggccagctgtgcgagatccccccccacctgcccgcccccaagagcccctgcgagggcaccgagtgccagaacggcgccaactgcgtggaccagggcaacagacccgtgtgccagtgcctgcccggcttcggcggccccgagtgcgagaagctgctgagcgtgaacttcgtggacagagacacctacctgcagttcaccgacctgcagaactggcccagagccaacatcaccctgcaggtgagcaccgccgaggacaacggcatcctgctgtacaacggcgacaacgaccacatcgccgtggagctgtaccagggccacgtgagagtgagctacgaccccggcagctaccccagcagcgccatctacagcgccgagaccatcaacgacggccagttccacaccgtggagctggtggccttcgaccagatggtgaacctgagcatcgacggcggcagccccatgaccatggacaacttcggcaagcactacaccctgaacagcgaggcccccctgtacgtgggcggcatgcccgtggacgtgaacagcgccgccttcagactgtggcagatcctgaacggcaccggcttccacggctgcatcagaaacctgtacatcaacaacgagctgcaggacttcaccaagacccagatgaagcccggcgtggtgcccggctgcgagccctgcagaaagctgtactgcctgcacggcatctgccagcccaacgccacccccggccccatgtgccactgcgaggccggctgggtgggcctgcactgcgaccagcccgccgacggcccctgccacggccacaagtgcgtgcacggccagtgcgtgcccctggacgccctgagctacagctgccagtgccaggacggctacagcggcgccctgtgcaaccagagccccagcgccggcggcaccctgagcggcaccttcaccagaagcagaggcgccatgcccagcgccagacccagagccccctgccacggctggagcgccggcgccagagcccaggccagagccgccgccagagccttcggctag

SEQ ID NO: 4087 - DNA, 570 bp, Artificial Sequence
  Description of Artificial Sequence: Synthetic coding sequence
atggaggccaccggcaccgacgaggtggacaagctgaagaccaagttcatcagcgcctggaacaacatgaagtacagctgggtgctgaagaccaagacctacttcagcagaaacagccccgtgctgctgctgggcaagtgctaccacttcaagtacgaggacgaggacaagaccctgcccgccgagagcggctgcaccatcgaggaccacgtgatcgccggcaacgtggaggagttcagaaaggacttcatcagcagaatctggctgacctacagagaggagttcccccagatcgagggcagcgccctgaccaccgactgcggctggggctgcaccctgagaaccggccagatgctgctggcccagggcctgatcctgcacttcctgggcagagcctggacctggcccgacgccctgaacatcgagaacagcgacagcgagagctggaccagccacaccgtgaagaagttcaccgccagcttcgaggccagcctgagcggcgagagagagttcaagacccccaccatcagcctgaaggagaccatcggcaagtacagcgacgaccactag

SEQ ID NO: 4088 - DNA, 1377 bp, Artificial Sequence; identical to SEQ ID NO: 3771
  Description of Artificial Sequence: Synthetic coding sequence

SEQ ID NO: 4089 - DNA, 8178 bp, Artificial Sequence
  Description of Artificial Sequence: Synthetic coding sequence
atggagcagaccgactgcaagccctaccagcccctgcccaaggtgaagcacgagatggacctggcctacaccagcagcagcgacgagagcgaggacggcagaaagcccagacagagctacaacagcagagagaccctgcacgagtacaaccaggagctgagaatgaactacaacagccagagcagaaagagaaaggaggtggagaagagcacccaggagatggagttctgcgagaccagccacaccctgtgcagcggctaccagaccgacatgcacagcgtgagcagacacggctaccagctggagatgggcagcgacgtggacaccgagaccgagggcgccgccagccccgaccacgccctgagaatgtggatcagaggcatgaagagcgagcacagcagctgcctgagcagcagagccaacagcgccctgagcctgaccgacaccgaccacgagagaaagagcgacggcgagaacggcttcaagttcagccccgtgtgctgcgacatggaggcccaggccggcagcacccaggacgtgcagagcagcccccacaaccagttcaccttcagacccctgccccccccccccccccccccccacgcctgcacctgcgccagaaagcccccccccgccgccgacagcctgcagagaagaagcatgaccaccagaagccagcccagccccgccgcccccgccccccccaccagcacccaggacagcgtgcacctgcacaacagctgggtgctgaacagcaacatccccctggagaccagacacttcctgttcaagcacggcagcggcagcagcgccatcttcagcgccgccagccagaactaccccctgaccagcaacaccgtgtacagccccccccccagacccctgcccagaagcaccttcagcagacccgccttcaccttcaacaagccctacagatgctgcaactggaagtgcaccgccctgagcgccaccgccatcaccgtgaccctggccctgctgctggcctacgtgatcgccgtgcacctgttcggcctgacctggcagctgcagcccgtggagggcgagctgtacgccaacggcgtgagcaagggcaacagaggcaccgagagcatggacaccacctacagccccatcggcggcaaggtgagcgacaagagcgagaagaaggtgttccagaagggcagagccatcgacaccggcgaggtggacatcggcgcccaggtgatgcagaccatcccccccggcctgttctggagattccagatcaccatccaccaccccatctacctgaagttcaacatcagcctggccaaggacagcctgctgggcatctacggcagaagaaacatcccccccacccacacccagttcgacttcgtgaagctgatggacggcaagcagctggtgaagcaggacagcaagggcagcgacgacacccagcacagccccagaaacctgatcctgaccagcctgcaggagaccggcttcatcgagtacatggaccagggcccctggtacctggccttctacaacgacggcaagaagatggagcaggtgttcgtgctgaccaccgccatcgagatcatggacgactgcagcaccaactgcaacggcaacggcgagtgcatcagcggccactgccactgcttccccggcttcctgggccccgactgcgccagagacagctgccccgtgctgtgcggcggcaacggcgagtacgagaagggccactgcgtgtgcagacacggctggaagggccccgagtgcgacgtgcccgaggagcagtgcatcgaccccacctgcttcggccacggcacctgcatcatgggcgtgtgcatctgcgtgcccggctacaagggcgagatctgcgaggaggaggactgcctggaccccatgtgcagcaaccacggcatctgcgtgaagggcgagtgccactgcagcaccggctggggcggcgtgaactgcgagacccccctgcccgtgtgccaggagcagtgcagcggccacggcaccttcctgctggacgccggcgtgtgcagctgcgaccccaagtggaccggcagcgactgcagcaccgagctgtgcaccatggagtgcggcagccacggcgtgtgcagcagaggcatctgccagtgcgaggagggctgggtgggccccacctgcgaggagagaagctgccacagccactgcaccgagcacggccagtgcaaggacggcaagtgcgagtgcagccccggctgggagggcgaccactgcaccatcgcccactacctggacgccgtgagagacggctgccccggcctgtgcttcggcaacggcagatgcaccctggaccagaacggctggcactgcgtgtgccaggtgggctggagcggcaccggctgcaacgtggtgatggagatgctgtgcggcgacaacctggacaacgacggcgacggcctgaccgactgcgtggaccccgactgctgccagcagagcaactgctacatcagccccctgtgccagggcagccccgaccccctggacctgatccagcagagccagaccctgttcagccagcacaccagcagactgttctacgacagaatcaagttcctgatcggcaaggacagcacccacgtgatcccccccgaggtgagcttcgacagcagaagagcctgcgtgatcagaggccaggtggtggccatcgacggcacccccctggtgggcgtgaacgtgagcttcctgcaccacagcgactacggcttcaccatcagcagacaggacggcagcttcgacctggtggccatcggcggcatcagcgtgatcctgatcttcgacagaagccccttcctgcccgagaagagaaccctgtggctgccctggaaccagttcatcgtggtggagaaggtgaccatgcagagagtggtgagcgacccccccagctgcgacatcagcaacttcatcagccccaaccccatcgtgctgcccagccccctgaccagcttcggcggcagctgccccgagagaggcaccatcgtgcccgagctgcaggtggtgcaggaggagatccccatccccagcagcttcgtgagactgagctacctgagcagcagaacccccggctacaagaccctgctgagaatcctgctgacccacagcaccatccccgtgggcatgatcaaggtgcacctgaccgtggccgtggagggcagactgacccagaagtggttccccgccgccatcaacctggtgtacaccttcgcctggaacaagaccgacatctacggccagaaggtgtggggcctggccgaggccctggtgagcgtgggctacgagtacgagacctgccccgacttcatcctgtgggagcagagaaccgtggtgctgcagggcttcgagatggacgccagcaacctgggcggctggagcctgaacaagcaccacatcctgaacccccagagcggcatcatccacaagggcaacggcgagaacatgttcatcagccagcagccccccgtgatcagcaccatcatgggcaacggccaccagagaagcgtggcctgcaccaactgcaacggccccgcccacaacaacaagctgttcgcccccgtggccctggccagcggccccgacggcagcgtgtacgtgggcgacttcaacttcgtgagaagaatcttccccagcggcaacagcgtgagcatcctggagctgagcaccagccccgcccacaagtactacctggccatggaccccgtgagcgagagcctgtacctgagcgacaccaacaccagaaaggtgtacaagctgaagagcctggtggagaccaaggacctgagcaagaacttcgaggtggtggccggcaccggcgaccagtgcctgcccttcgaccagagccactgcggcgacggcggcagagccagcgaggccagcctgaacagccccagaggcatcaccgtggacagacacggcttcatctacttcgtggacggcaccatgatcagaaagatcgacgagaacgccgtgatcaccaccgtgatcggcagcaacggcctgaccagcacccagcccctgagctgcgacagcggcatggacatcacccaggtgagactggagtggcccaccgacctggccgtgaaccccatggacaacagcctgtacgtgctggacaacaacatcgtgctgcagatcagcgagaacagaagagtgagaatcatcgccggcagacccatccactgccaggtgcccggcatcgaccacttcctggtgagcaaggtggccatccacagcaccctggagagcgccagagccatcagcgtgagccacagcggcctgctgttcatcgccgagaccgacgagagaaaggtgaacagaatccagcaggtgaccaccaacggcgagatctacatcatcgccggcgcccccaccgactgcgactgcaagatcgaccccaactgcgactgcttcagcggcgacggcggctacgccaaggacgccaagatgaaggcccccagcagcctggccgtgagccccgacggcaccctgtacgtggccgacctgggcaacgtgagaatcagaaccatcagcagaaaccaggcccacctgaacgacatgaacatctacgagatcgccagccccgccgaccaggagctgtaccagttcaccgtgaacggcacccacctgcacaccctgaacctgatcaccagagactacgtgtacaacttcacctacaacagcgagggcgacctgggcgccatcaccagcagcaacggcaacagcgtgcacatcagaagagacgccggcggcatgcccctgtggctggtggtgcccggcggccaggtgtactggctgaccatcagcagcaacggcgtgctgaagagagtgagcgcccagggctacaacctggccctgatgacctaccccggcaacaccggcctgctggccaccaagagcaacgagaacggctggaccaccgtgtacgagtacgaccccgagggccacctgaccaacgccaccttccccaccggcgaggtgagcagcttccacagcgacctggagaagctgaccaaggtggagctggacaccagcaacagagagaacgtgctgatgagcaccaacctgaccgccaccagcaccatctacatcctgaagcaggagaacacccagagcacctacagagtgaaccccgacggcagcctgagagtgaccttcgccagcggcatggagatcggcctgagcagcgagccccacatcctggccggcgccgtgaaccccaccctgggcaagtgcaacatcagcctgcccggcgagcacaacgccaacctgatcgagtggagacagagaaaggagcagaacaagggcaacgtgagcgccttcgagagaagactgagagcccacaacagaaacctgctgagcatcgacttcgaccacatcaccagaaccggcaagatctacgacgaccacagaaagttcaccctgagaatcctgtacgaccagaccggcagacccatcctgtggagccccgtgagcagatacaacgaggtgaacatcacctacagccccagcggcctggtgaccttcatccagagaggcacctggaacgagaagatggagtacgaccagagcggcaagatcatcagcagaacctgggccgacggcaagatctggagctacacctacctggagaagagcgtgatgctgctgctgcacagccagagaagatacatcttcgagtacgaccagcccgactgcctgctgagcgtgaccatgcccagcatggtgagacacagcctgcagaccatgctgagcgtgggctactacagaaacatctacaccccccccgacagcagcaccagcttcatccaggactacagcagagacggcagactgctgcagaccctgcacctgggcaccggcagaagagtgctgtacaagtacaccaagcaggccagactgagcgaggtgctgtacgacaccacccaggtgaccctgacctacgaggagagcagcggcgtgatcaagaccatccacctgatgcacgacggcttcatctgcaccatcagatacagacagaccggccccctgatcggcagacagatcttcagattcagcgaggagggcctggtgaacgccagattcgactacagctacaacaacttcagagtgaccagcatgcaggccgtgatcaacgagacccccctgcccatcgacctgtacagatacgtggacgtgagcggcagaaccgagcagttcggcaagttcagcgtgatcaactacgacctgaaccaggtgatcaccaccaccgtgatgaagcacaccaagatcttcagcgccaacggccaggtgatcgaggtgcagtacgagatcctgaaggccatcgcctactggatgaccatccagtacgacaacgtgggcagaatggtgatctgcgacatcagagtgggcgtggacgccaacatcaccagatacttctacgagtacgacgccgacggccagctgcagaccgtgagcgtgaacgacaagacccagtggagatacagctacgacctgaacggcaacatcaacctgctgagccacggcaagagcgccagactgacccccctgagatacgacctgagagacagaatcaccagactgggcgagatccagtacaagatggacgaggacggcttcctgagacagagaggcaacgacatcttcgagtacaacagcaacggcctgctgcagaaggcctacaacaaggccagcggctggaccgtgcagtactactacgacggcctgggcagaagagtggccagcaagagcagcctgggccagcacctgcagttcttctacgccgacctgaccaaccccatcagagtgacccacctgtacaaccacaccagcagcgagatcaccagcctgtactacgacctgcagggccacctgatcgccatggagctgagcagcggcgaggagtactacgtggcctgcgacaacaccggcacccccctggccgtgttcagcagcagaggccaggtgatcaaggagatcctgtacaccccctacggcgacatctaccacgacacctaccccgacttccaggtgatcatcggcttccacggcggcctgtacgacttcctgaccaagctggtgcacctgggccagagagactacgacgtggtggccggcagatggaccacccccaaccaccacatctggaagcagctgaacctgctgcccaagcccttcaacctgtacagcttcgagaacaactaccccgtgggcaagatccaggacgtggccaagtacaccaccgacatcagaagctggctggagctgttcggcttccagctgcacaacgtgctgcccggcttccccaagcccgagctggagaacctggagctgacctacgagctgctgagactgcagaccaagacccaggagtgggaccccggcaagaccatcctgggcatccagtgcgagctgcagaagcagctgagaaacttcatcagcctggaccagctgcccatgacccccagatacaacgacggcagatgcctggagggcggcaagcagcccagattcgccgccgtgcccagcgtgttcggcaagggcatcaagttcgccatcaaggacggcatcgtgaccgccgacatcatcggcgtggccaacgaggacagcagaagactggccgccatcctgaacaacgcccactacctggagaacctgcacttcaccatcgagggcagagacacccactacttcatcaagctgggcagcctggaggaggacctggtgctgatcggcaacaccggcggcagaagaatcctggagaacggcgtgaacgtgaccgtgagccagatgaccagcgtgctgaacggcagaaccagaagattcgccgacatccagctgcagcacggcgccctgtgcttcaacatcagatacggcaccaccgtggaggaggagaagaaccacgtgctggagatcgccagacagagagccgtggcccaggcctggaccaaggagcagagaagactgcaggagggcgaggagggcatcagagcctggaccgagggcgagaagcagcagctgctgagcaccggcagagtgcagggctacgacggctacttcgtgctgagcgtggagcagtacctggagctgagcgacagcgccaacaacatccacttcatgagacagagcgagatcggcagaagatag

SEQ ID NO: 4090 - DNA, 204 bp, Artificial Sequence
  Description of Artificial Sequence: Synthetic coding sequence
atgaagatccagctgttcttcttcatcctgcacttctgggtgaccatcctgcccgccaagaagaagtaccccgagtacggcagcctggacctgagaagagagtgcagaatcggcaacggccagtgcaagaaccagtgccacgagaacgagatcagaatcgcctactgcatcagacccggcacccactgctgcctgcagcagtag

SEQ ID NO: 4091 - DNA, 831 bp, Artificial Sequence
  Description of Artificial Sequence: Synthetic coding sequence
atgaagcagatcctgcaccccgccctggagaccaccgcctgcaccaaccacttcaacgccgacccctgcagcaccggcttcgtgttccccgccatgaccctgttccccgtgctgctgttcctggtggccggcctgctgcccagcttccccgccaacgaggacaaggaccccgccttcaccgccctgctgaccacccagacccaggtgcagagagagatcgtgaacaagcacaacgagctgagaagagccgtgagcccccccgccagaaacatgctgaagatggagtggaacaaggaggccgccgccaacgcccagaagtgggccaaccagtgcaactacagacacagcaaccccaaggacagaatgaccagcctgaagtgcggcgagaacctgtacatgagcagcgccagcagcagctggagccaggccatccagagctggttcgacgagtacaacgacttcgacttcggcgtgggccccaagacccccaacgccgtggtgggccactacacccaggtggtgtggtacagcagctacctggtgggctgcggcaacgcctactgccccaaccagaaggtgctgaagtactactacgtgtgccagtactgccccgccggcaactgggccaacagactgtacgtgccctacgagcagggcgccccctgcgccagctgccccgacaactgcgacgacggcctgtgcaccaacggctgcaagtacgaggacctgtacagcaactgcaagagcctgaagctgaccctgacctgcaagcaccagctggtgagagacagctgcaaggccagctgcaactgcagcaacagcatctactag

SEQ ID NO: 4092 - DNA, 1350 bp, Artificial Sequence
  Description of Artificial Sequence: Synthetic coding sequence
atgctggccgagtggggcgcctgcctgctgctggccgtggccctgctgggccccggcctgcaggcccaggccatggagggcgtgaagtgcggcggcgtgctgagcgcccccagcggcaacttcagcagccccaacttccccagactgtacccctacaacaccgagtgcagctggctgatcgtggtggccgagggcagcagcgtgctgctgaccttccacgccttcgacctggagtaccacgacacctgcagcttcgacttcctggagatctacaacggcgccagccccgacaagggcaacctgctgggcagattctgcggcaaggtgccccccccccccttcaccagcagctggcacgtgatgagcgtgatcttccacagcgacaagcacgtggccagccacggcttcagcgccggctaccagaaggacgtgtgcggcggcgtgctgaccggcctgagcggcgtgctgaccagccccgagtaccccaacaactaccccaacagcatggagtgccactgggtgatcagagccgccggccccgcccacgtgaagctggtgttcgtggacttccaggtggagggcaacgaggagtgcacctacgactacgtggccgtgctgggcggccccggccccaccagaggccaccactactgcggcagcaccagaccccccaccctggtgagcctgggccacgagctgcaggtggtgttcaagagcgacttcaacatcggcggcagaggcttcaaggcctactacttcagcggcgagtgccaggaggtgtacatggccatgagaggcaacttcagcagcccccagtaccccagcagctaccccaacaacatcagatgccactggaccatcagactgccccccggctaccaggtgaaggtgttcttcctggacctggacctggaggagcccaacagcctgaccaagacctgcgacttcgaccacctggccgccttcgacggcgccagcgaggaggcccccctgctgggcaactggtgcggccaccacctgcccccccccgtgaccagcagccacaaccagctgctgctgctgctgcacaccgacagaagcaccaccagaagaggcttcagcgtggcctacatcggcggccagctgggctgcggcagcggcagcaccgagggcgagggcgaggccctgcagccccagagcctgcagagccccagcagcatcccccccgtgtgccccgccccccccatgaacggcctgctgcagctgctgctgcactggctgcacccctgccccctgagcggccccctgagactggacggcaccgcccccgcctgcttccactactgcagagccagcttccccagcttctag

SEQ ID NO: 4093 - DNA, 1434 bp, Artificial Sequence; identical to SEQ ID NO: 3532
  Description of Artificial Sequence: Synthetic coding sequence

SEQ ID NO: 4094 - DNA, 1479 bp, Artificial Sequence
  Description of Artificial Sequence: Synthetic coding sequence
atgggcagcgccccctgggcccccgtgctgctgctggccctgggcctgagaggcctgcaggccggcgccagaagagcccccgaccccggcttccaggagagattcttccagcagagactggaccacttcaacttcgagagattcggcaacaagaccttcccccagagattcctggtgagcgacagattctgggtgagaggcgagggccccatcttcttctacaccggcaacgagggcgacgtgtgggccttcgccaacaacagcgccttcgtggccgagctggccgccgagagaggcgccctgctggtgttcgccgagcacagatactacggcaagagcctgcccttcggcgcccagagcacccagagaggccacaccgagctgctgaccgtggagcaggccctggccgacttcgccgagctgctgagagccctgagaagagacctgggcgcccaggacgcccccgccatcgccttcggcggcagctacggcggcatgctgagcgcctacctgagaatgaagtacccccacctggtggccggcgccctggccgccagcgcccccgtgctggccgtggccggcctgggcgacagcaaccagttcttcagagacgtgaccgccgacttcgagggccagagccccaagtgcacccagggcgtgagagaggccttcagacagatcaaggacctgttcctgcagggcgcctacgacaccgtgagatgggagttcggcacctgccagcccctgagcgacgagaaggacctgacccagctgttcatgttcgccagaaacgccttcaccgtgctggccatgatggactacccctaccccaccgacttcctgggccccctgcccgccaaccccgtgaaggtgggctgcgacagactgctgagcgaggcccagagaatcaccggcctgagagccctggccggcctggtgtacaacgccagcggcagcgagcactgctacgacatctacagactgtaccacagctgcgccgaccccaccggctgcggcaccggccccgacgccagagcctgggactaccaggcctgcaccgagatcaacctgaccttcgccagcaacaacgtgaccgacatgttccccgacctgcccttcaccgacgagctgagacagagatactgcctggacacctggggcgtgtggcccagacccgactggctgctgaccagcttctggggcggcgacctgagagccgccagcaacatcatcttcagcaacggcaacctggacccctgggccggcggcggcatcagaagaaacctgagcgccagcgtgatcgccgtgaccatccagggcggcgcccaccacctggacctgagagccagccaccccgaggaccccgccagcgtggtggaggccagaaagctggaggccaccatcatcggcgagtgggtgaaggccgccagaagagagcagcagcccgccctgagaggcggccccagactgagcctgtag

SEQ ID NO: 4095 - DNA, 2850 bp, Artificial Sequence
  Description of Artificial Sequence: Synthetic coding sequence
atgatcctgagcctgctgttcagcctgggcggccccctgggctggggcctgctgggcgcctgggcccaggccagcagcaccagcctgagcgacctgcagagcagcagaacccccggcgtgtggaaggccgaggccgaggacaccggcaaggaccccgtgggcagaaactggtgcccctaccccatgagcaagctggtgaccctgctggccctgtgcaagaccgagaagttcctgatccacagccagcagccctgcccccagggcgcccccgactgccagaaggtgaaggtgatgtacagaatggcccacaagcccgtgtaccaggtgaagcagaaggtgctgaccagcctggcctggagatgctgccccggctacaccggccccaactgcgagcaccacgacagcatggccatccccgagcccgccgaccccggcgacagccaccaggagccccaggacggccccgtgagcttcaagcccggccacctggccgccgtgatcaacgaggtggaggtgcagcaggagcagcaggagcacctgctgggcgacctgcagaacgacgtgcacagagtggccgacagcctgcccggcctgtggaaggccctgcccggcaacctgaccgccgccgtgatggaggccaaccagaccggccacgagttccccgacagaagcctggagcaggtgctgctgccccacgtggacaccttcctgcaggtgcacttcagccccatctggagaagcttcaaccagagcctgcacagcctgacccaggccatcagaaacctgagcctggacgtggaggccaacagacaggccatcagcagagtgcaggacagcgccgtggccagagccgacttccaggagctgggcgccaagttcgaggccaaggtgcaggagaacacccagagagtgggccagctgagacaggacgtggaggacagactgcacgcccagcacttcaccctgcacagaagcatcagcgagctgcaggccgacgtggacaccaagctgaagagactgcacaaggcccaggaggcccccggcaccaacggcagcctggtgctggccacccccggcgccggcgccagacccgagcccgacagcctgcaggccagactgggccagctgcagagaaacctgagcgagctgcacatgaccaccgccagaagagaggaggagctgcagtacaccctggaggacatgagagccaccctgaccagacacgtggacgagatcaaggagctgtacagcgagagcgacgagaccttcgaccagatcagcaaggtggagagacaggtggaggagctgcaggtgaaccacaccgccctgagagagctgagagtgatcctgatggagaagagcctgatcatggaggagaacaaggaggaggtggagagacagctgctggagctgaacctgaccctgcagcacctgcagggcggccacgccgacctgatcaagtacgtgaaggactgcaactgccagaagctgtacctggacctggacgtgatcagagagggccagagagacgccaccagagccctggaggagacccaggtgagcctggacgagagaagacagctggacggcagcagcctgcaggccctgcagaacgccgtggacgccgtgagcctggccgtggacgcccacaaggccgagggcgagagagccagagccgccaccagcagactgagaagccaggtgcaggccctggacgacgaggtgggcgccctgaaggccgccgccgccgaggccagacacgaggtgagacagctgcacagcgccttcgccgccctgctggaggacgccctgagacacgaggccgtgctggccgccctgttcggcgaggaggtgctggaggagatgagcgagcagacccccggccccctgcccctgagctacgagcagatcagagtggccctgcaggacgccgccagcggcctgcaggagcaggccctgggctgggacgagctggccgccagagtgaccgccctggagcaggccagcgagccccccagacccgccgagcacctggagcccagccacgacgccggcagagaggaggccgccaccaccgccctggccggcctggccagagagctgcagagcctgagcaacgacgtgaagaacgtgggcagatgctgcgaggccgaggccggcgccggcgccgccagcctgaacgccagcctgcacggcctgcacaacgccctgttcgccacccagagaagcctggagcagcaccagagactgttccacagcctgttcggcaacttccagggcctgatggaggccaacgtgagcctggacctgggcaagctgcagaccatgctgagcagaaagggcaagaagcagcagaaggacctggaggcccccagaaagagagacaagaaggaggccgagcccctggtggacatcagagtgaccggccccgtgcccggcgccctgggcgccgccctgtgggaggccggcagccccgtggccttctacgccagcttcagcgagggcaccgccgccctgcagaccgtgaagttcaacaccacctacatcaacatcggcagcagctacttccccgagcacggctacttcagagcccccgagagaggcgtgtacctgttcgccgtgagcgtggagttcggccccggccccggcaccggccagctggtgttcggcggccaccacagaacccccgtgtgcaccaccggccagggcagcggcagcaccgccaccgtgttcgccatggccgagctgcagaagggcgagagagtgtggttcgagctgacccagggcagcatcaccaagagaagcctgagcggcaccgccttcggcggcttcctgatgttcaagacctag

SEQ ID NO: 4096 - DNA, 246 bp, Artificial Sequence
  Description of Artificial Sequence: Synthetic coding sequence
atgagactgctggtgctgagcagcctgctgtgcatcctgctgctgtgcttcagcatcttcagcaccgagggcaagagaagacccgccaaggcctggagcggcagaagaaccagactgtgctgccacagagtgcccagccccaacagcaccaacctgaagggccaccacgtgagactgtgcaagccctgcaagctggagcccgagcccagactgtgggtggtgcccggcgccctgccccaggtgtag

SEQ ID NO: 4097 - DNA, 690 bp, Artificial Sequence
  Description of Artificial Sequence: Synthetic coding sequence
atgagcttcctgcaggaccccagcttcttcaccatgggcatgtggagcatcggcgccggcgccctgggcgccgccgccctggccctgctgctggccaacaccgacgtgttcctgagcaagccccagaaggccgccctggagtacctggaggacatcgacctgaagaccctggagaaggagcccagaaccttcaaggccaaggagctgtgggagaagaacggcgccgtgatcatggccgtgagaagacccggctgcttcctgtgcagagaggaggccgccgacctgagcagcctgaagagcatgctggaccagctgggcgtgcccctgtacgccgtggtgaaggagcacatcagaaccgaggtgaaggacttccagccctacttcaagggcgagatcttcctggacgagaagaagaagttctacggcccccagagaagaaagatgatgttcatgggcttcatcagactgggcgtgtggtacaacttcttcagagcctggaacggcggcttcagcggcaacctggagggcgagggcttcatcctgggcggcgtgttcgtggtgggcagcggcaagcagggcatcctgctggagcacagagagaaggagttcggcgacaaggtgaacctgctgagcgtgctggaggccgccaagatgatcaagccccagaccctggccagcgagaagaagtag

SEQ ID NO: 4098 - DNA, 657 bp, Artificial Sequence
  Description of Artificial Sequence: Synthetic coding sequence
atgggcatgtggagcatcggcgccggcgccctgggcgccgccgccctggccctgctgctggccaacaccgacgtgttcctgagcaagccccagaaggccgccctggagtacctggaggacatcgacctgaagaccctggagaaggagcccagaaccttcaaggccaaggagctgtgggagaagaacggcgccgtgatcatggccgtgagaagacccggctgcttcctgtgcagagaggaggccgccgacctgagcagcctgaagagcatgctggaccagctgggcgtgcccctgtacgccgtggtgaaggagcacatcagaaccgaggtgaaggacttccagccctacttcaagggcgagatcttcctggacgagaagaagaagttctacggcccccagagaagaaagatgatgttcatgggcttcatcagactgggcgtgtggtacaacttcttcagagcctggaacggcggcttcagcggcaacctggagggcgagggcttcatcctgggcggcgtgttcgtggtgggcagcggcaagcagggcatcctgctggagcacagagagaaggagttcggcgacaaggtgaacctgctgagcgtgctggaggccgccaagatgatcaagccccagaccctggccagcgagaagaagtag

SEQ ID NO: 4099 - DNA, 690 bp, Artificial Sequence; identical to SEQ ID NO: 4097
  Description of Artificial Sequence: Synthetic coding sequence

SEQ ID NO: 4100 - DNA, 690 bp, Artificial Sequence; identical to SEQ ID NO: 4097
  Description of Artificial Sequence: Synthetic coding sequence

SEQ ID NO: 4101 - DNA, 1248 bp, Artificial Sequence; identical to SEQ ID NO: 3809
  Description of Artificial Sequence: Synthetic coding sequence

SEQ ID NO: 4102 - DNA, 240 bp, Artificial Sequence
  Description of Artificial Sequence: Synthetic coding sequence
atggccccccagaccctgctgcccgtgctggtgctgtgcgtgctgctgctgcaggcccagggcggctacagagacaagaagagaatgcagaagacccagctgagccccgagatcaaggtgtgccagcagcagcccaagctgtacctgtgcaagcacctgtgcgagagccacagagactgccaggccaacaacatctgctgcagcacctactgcggcaacgtgtgcatgagcatcctgtag

SEQ ID NO: 4103 - DNA, 486 bp, Artificial Sequence
  Description of Artificial Sequence: Synthetic coding sequence
atgggcctgagcggcctgctgcccatcctggtgcccttcatcctgctgggcgacatccaggagcccggccacgccgagggcatcctgggcaagccctgccccaagatcaaggtggagtgcgaggtggaggagatcgaccagtgcaccaagcccagagactgccccgagaacatgaagtgctgccccttcagcagaggcaagaagtgcctggacttcagaaagatctacgccgtgtgccacagaagactggcccccgcctggcccccctaccacaccggcggcaccatcaagaagaccaagatctgcagcgagttcatctacggcggcagccagggcaacaacaacaacttccagaccgaggccatctgcctggtgacctgcaagaagtaccacaagagcgccctgctgtacaccatcagaagaagcctgaacaacctgcaggacctggcccacaaccccggcctgagccccagagtgcccgactag

SEQ ID NO: 4104 - DNA, 261 bp, Artificial Sequence
  Description of Artificial Sequence: Synthetic coding sequence
atgggcctgagcggcctgctgcccatcctggtgcccttcatcctgctgggcgacatccaggagcccggccacgccgagggcatcctgggcaagccctgccccaagatcaaggtggagtgcgaggtggaggagatcgaccagtgcaccaagcccagagactgccccgagaacatgaagtgctgccccttcagcagaggcaagaagtgcctggacttcagaaaggtgagcctgaccctgtaccacaaggaggagctggagtag

SEQ ID NO: 4105 - DNA, 375 bp, Artificial Sequence
  Description of Artificial Sequence: Synthetic coding sequence
atgcccgcctgcagactgggccccctggccgccgccctgctgctgagcctgctgctgttcggcttcaccctggtgagcggcaccggcgccgagaagaccggcgtgtgccccgagctgcaggccgaccagaactgcacccaggagtgcgtgagcgacagcgagtgcgccgacaacctgaagtgctgcagcgccggctgcgccaccttctgcagcctgcccaacgacaaggagggcagctgcccccaggtgaacatcaacttcccccagctgggcctgtgcagagaccagtgccaggtggacagccagtgccccggccagatgaagtgctgcagaaacggctgcggcaaggtgagctgcgtgacccccaacttctag

SEQ ID NO: 4106 - DNA, 1428 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacaccaccggcctggcctggagcaagaccggccccgtggccaaggagctgagcggcctgcccagcggccccagcgccggcagctgccccccccccccccccccctgccccccccccccccccgtgagcaccatcagctgcagctacgagagcgccagcagaagcagcctgttcgcccagatcaaccagggcgagagcatcacccacgccctgaagcacgtgagcgacgacatgaagacccacaagaaccccgccctgaaggcccagagcggccccgtgagaagcggccccaagcccttcagcgcccccaagccccagaccagccccagccccaagagagccaccaagaaggagcccgccgtgctggagctggagggcaagaagtggagagtggagaaccaggagaacgtgagcaacctggtgatcgaggacaccgagctgaagcaggtggcctacatctacaagtgcgtgaacaccaccctgcagatcaagggcaagatcaacagcatcaccgtggacaactgcaagaagctgggcctggtgttcgacgacgtggtgggcatcgtggagatcatcaacagcaaggacgtgaaggtgcaggtgatgggcaaggtgcccaccatcagcatcaacaagaccgacggctgccacgcctacctgagcaagaacagcctggactgcgagatcgtgagcgccaagagcagcgagatgaacgtgctgatccccaccgagggcggcgacttcaacgagttccccgtgcccgagcagttcaagaccctgtggaacggccagaagctggtgaccaccgtgaccgagatcgccggctag

SEQ ID NO: 4107 - DNA, 438 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggcctacatcaaggagttccacaccaccggcctggcctggagcaagaccggccccgtggccaaggagctgagcggcctgcccagcggccccagcgccggcagctgccccccccccccccccccctgccccccccccccccccgtgagcaccatcagctgcagctacgagagcgccagcagaagcagcctgttcgcccagatcaaccagggcgagagcatcacccacgccctgaagcacgtgagcgacgacatgaagacccacaagaaccccgccctgaaggcccagagcggccccgtgagatag

SEQ ID NO: 4108 - DNA, 1428 bp, Artificial Sequence; identical to SEQ ID NO: 4106
  Description of Artificial Sequence: Synthetic coding sequence

SEQ ID NO: 4109 - DNA, 1425 bp, Artificial Sequence; identical to SEQ ID NO: 3898
  Description of Artificial Sequence: Synthetic coding sequence

SEQ ID NO: 4110 - DNA, 1425 bp, Artificial Sequence; identical to SEQ ID NO: 3898
  Description of Artificial Sequence: Synthetic coding sequence

SEQ ID NO: 4111 - DNA, 1428 bp, Artificial Sequence; identical to SEQ ID NO: 4106
  Description of Artificial Sequence: Synthetic coding sequence

SEQ ID NO: 4112 - DNA, 1209 bp, Artificial Sequence
  Description of Artificial Sequence: Synthetic coding sequence
atgaccgccctgcccggccccctgtggctgctgggcctggccctgtgcgccctgggcggcggcggccccggcctgagacccccccccggctgcccccagagaagactgggcgccagagagagaagagacgtgcagagagagatcctggccgtgctgggcctgcccggcagacccagacccagagccccccccgccgccagcagactgcccgccagcgcccccctgttcatgctggacctgtaccacgccatggccggcgacgacgacgaggacggcgcccccgccgagagaagactgggcagagccgacctggtgatgagcttcgtgaacatggtggagagagacagagccctgggccaccaggagccccactggaaggagttcagattcgacctgacccagatccccgccggcgaggccgtgaccgccgccgagttcagaatctacaaggtgcccagcatccacctgctgaacagaaccctgcacgtgagcatgttccaggtggtgcaggagcagagcaacagagagagcgacctgttcttcctggacctgcagaccctgagagccggcgacgagggctggctggtgctggacgtgaccgccgccagcgactgctggctgctgaagagacacaaggacctgggcctgagactgtacgtggagaccgaggacggccacagcgtggaccccggcctggccggcctgctgggccagagagcccccagaagccagcagcccttcgtggtgaccttcttcagagccagccccagccccatcagaacccccagagccgtgagacccctgagaagaagacagcccaagaagagcaacgagctgccccaggccaacagactgcccggcatcttcgacgacgtgcacggcagccacggcagacaggtgtgcagaagacacgagctgtacgtgagcttccaggacctgggctggctggactgggtgatcgccccccagggctacagcgcctactactgcgagggcgagtgcagcttccccctggacagctgcatgaacgccaccaaccacgccatcctgcagagcctggtgcacctgatgatgcccgacgccgtgcccaaggcctgctgcgcccccaccaagctgagcgccaccagcgtgctgtactacgacagcagcaacaacgtgatcctgagaaagcacagaaacatggtggtgaaggcctgcggctgccactag

SEQ ID NO: 4113 - DNA, 804 bp, Artificial Sequence
  Description of Artificial Sequence: Synthetic coding sequence
atggccgccatcagaatgggcaagctgaccaccatgcccgccggcctgatctacgccagcgtgagcgtgcacgccgccaagcaggaggagagcaagaagcagctggtgaagcccgagcagctgcccatctacaccgccccccccctgcagagcaagtacgtggaggagcagcccggccacctgcagatgggcttcgccagcatcagaaccgccaccggctgctacatcggctggtgcaagggcgtgtacgtgttcgtgaagaacggcatcatggacaccgtgcagttcggcaaggacgcctacgtgtacctgaagaacccccccagagacttcctgcccaagatgggcgtgatcaccgtgagcggcctggccggcctggtgagcgccagaaagggcagcaagttcaagaagatcacctaccccctgggcctggccaccctgggcgccaccgtgtgctaccccgtgcagagcgtgatcatcgccaaggtgaccgccaagagatacatgctgcaggccagcaagttcctggagcagctgaaccactgcggccagaaggccgccaagaagagccacagcctgaacctgaagaagaccaagctgggcagcagcagcgagatcgaggtgcccgccaagaccacccacgtgctgaagcacagcgtgcccctgcccaccgagctgagcagcgaggccaagaccaagagcgagagcaccagcggcgccacccagttcatgcccgaccccaagctgatggaccacggccagagccaccccgaggacatcgacatgtacagcaccagaagctag

SEQ ID NO: 4114 - DNA, 807 bp, Artificial Sequence
  Description of Artificial Sequence: Synthetic coding sequence
atggccgccatcagaatgggcaagctgaccaccatgcccgccggcctgatctacgccagcgtgagcgtgcacgccgccaagcaggaggagagcaagaagcagctggtgaagcccgagcagctgcccatctacaccgccccccccctgcagagcaagtacgtggaggagcagcccggccacctgcagatgggcttcgccagcatcagaaccgccaccggctgctacatcggctggtgcaagggcgtgtacgtgttcgtgaagaacggcatcatggacaccgtgcagttcggcaaggacgcctacgtgtacctgaagaacccccccagagacttcctgcccaagatgggcgtgatcaccgtgagcggcctggccggcctggtgagcgccagaaagggcagcaagttcaagaagatcacctaccccctgggcctggccaccctgggcgccaccgtgtgctaccccgtgcagagcgtgatcatcgccaaggtgaccgccaagaaggtgtacgccaccagccagcagatcttcggcgccgtgaagagcctgtggaccaagagcagcaaggaggagagcctgcccaagcccaaggagaagaccaagctgggcagcagcagcgagatcgaggtgcccgccaagaccacccacgtgctgaagcacagcgtgcccctgcccaccgagctgagcagcgaggccaagaccaagagcgagagcaccagcggcgccacccagttcatgcccgaccccaagctgatggaccacggccagagccaccccgaggacatcgacatgtacagcaccagaagctag

SEQ ID NO: 4115 - DNA, 3672 bp, Artificial Sequence
  Description of Artificial Sequence: Synthetic coding sequence
atggcccccctgagagccctgctgagctacctgctgcccctgcactgcgccctgtgcgccgccgccggcagcagaacccccgagctgcacctgagcggcaagctgagcgactacggcgtgaccgtgccctgcagcaccgacttcagaggcagattcctgagccacgtggtgagcggccccgccgccgccagcgccggcagcatggtggtggacaccccccccaccctgcccagacacagcagccacctgagagtggccagaagccccctgcaccccggcggcaccctgtggcccggcagagtgggcagacacagcctgtacttcaacgtgaccgtgttcggcaaggagctgcacctgagactgagacccaacagaagactggtggtgcccggcagcagcgtggagtggcaggaggacttcagagagctgttcagacagcccctgagacaggagtgcgtgtacaccggcggcgtgaccggcatgcccggcgccgccgtggccatcagcaactgcgacggcctggccggcctgatcagaaccgacagcaccgacttcttcatcgagcccctggagagaggccagcaggagaaggaggccagcggcagaacccacgtggtgtacagaagagaggccgtgcagcaggagtgggccgagcccgacggcgacctgcacaacgaggccttcggcctgggcgacctgcccaacctgctgggcctggtgggcgaccagctgggcgacaccgagagaaagagaagacacgccaagcccggcagctacagcatcgaggtgctgctggtggtggacgacagcgtggtgagattccacggcaaggagcacgtgcagaactacgtgctgaccctgatgaacatcgtggacgagatctaccacgacgagagcctgggcgtgcacatcaacatcgccctggtgagactgatcatggtgggctacagacagagcctgagcctgatcgagagaggcaaccccagcagaagcctggagcaggtgtgcagatgggcccacagccagcagagacaggaccccagccacgccgagcaccacgaccacgtggtgttcctgaccagacaggacttcggccccagcggctacgcccccgtgaccggcatgtgccaccccctgagaagctgcgccctgaaccacgaggacggcttcagcagcgccttcgtgatcgcccacgagaccggccacgtgctgggcatggagcacgacggccagggcaacggctgcgccgacgagaccagcctgggcagcgtgatggcccccctggtgcaggccgccttccacagattccactggagcagatgcagcaagctggagctgagcagatacctgcccagctacgactgcctgctggacgaccccttcgaccccgcctggccccagccccccgagctgcccggcatcaactacagcatggacgagcagtgcagattcgacttcggcagcggctaccagacctgcctggccttcagaaccttcgagccctgcaagcagctgtggtgcagccaccccgacaacccctacttctgcaagaccaagaagggcccccccctggacggcaccgagtgcgcccccggcaagtggtgcttcaagggccactgcatctggaagagccccgagcagacctacggccaggacggcggctggagcagctggaccaagttcggcagctgcagcagaagctgcggcggcggcgtgagaagcagaagcagaagctgcaacaaccccagccccgcctacggcggcagactgtgcctgggccccatgttcgagtaccaggtgtgcaacagcgaggagtgccccggcacctacgaggacttcagagcccagcagtgcgccaagagaaacagctactacgtgcaccagaacgccaagcacagctgggtgccctacgagcccgacgacgacgcccagaagtgcgagctgatctgccagagcgccgacaccggcgacgtggtgttcatgaaccaggtggtgcacgacggcaccagatgcagctacagagacccctacagcgtgtgcgccagaggcgagtgcgtgcccgtgggctgcgacaaggaggtgggcagcatgaaggccgacgacaagtgcggcgtgtgcggcggcgacaacagccactgcagaaccgtgaagggcaccctgggcaaggccagcaagcaggccggcgccctgaagctggtgcagatccccgccggcgccagacacatccagatcgaggccctggagaagagcccccacagaatcgtggtgaagaaccaggtgaccggcagcttcatcctgaaccccaagggcaaggaggccaccagcagaaccttcaccgccatgggcctggagtgggaggacgccgtggaggacgccaaggagagcctgaagaccagcggccccctgcccgaggccatcgccatcctggccctgccccccaccgagggcggccccagaagcagcctggcctacaagtacgtgatccacgaggacctgctgcccctgatcggcagcaacaacgtgctgctggaggagatggacacctacgagtgggccctgaagagctgggccccctgcagcaaggcctgcggcggcggcatccagttcaccaagtacggctgcagaagaagaagagaccaccacatggtgcagagacacctgtgcgaccacaagaagagacccaagcccatcagaagaagatgcaaccagcacccctgcagccagcccgtgtgggtgaccgaggagtggggcgcctgcagcagaagctgcggcaagctgggcgtgcagaccagaggcatccagtgcctgctgcccctgagcaacggcacccacaaggtgatgcccgccaaggcctgcgccggcgacagacccgaggccagaagaccctgcctgagagtgccctgccccgcccagtggagactgggcgcctggagccagtgcagcgccacctgcggcgagggcatccagcagagacaggtggtgtgcagaaccaacgccaacagcctgggccactgcgagggcgacagacccgacaccgtgcaggtgtgcagcctgcccgcctgcggcggcaaccaccagaacagcaccgtgagagccgacgtgtgggagctgggcacccccgagggccagtgggtgccccagagcgagcccctgcaccccatcaacaagatcagcagcaccgagccctgcaccggcgacagaagcgtgttctgccagatggaggtgctggacagatactgcagcatccccggctaccacagactgtgctgcgtgagctgcatcaagaaggccagcggccccaaccccggccccgaccccggccccaccagcctgccccccttcagcacccccggcagccccctgcccggcccccaggaccccgccgacgccgccgagccccccggcaagcccaccggcagcgaggaccaccagcacggcagagccacccagctgcccggcgccctggacaccagcagccccggcacccagcaccccttcgcccccgagacccccatccccggcgccagctggagcatcagccccaccacccccggcggcctgccctggggctggacccagacccccacccccgtgcccgaggacaagggccagcccggcgaggacctgagacaccccggcaccagcctgcccgccgccagccccgtgacctag

SEQ ID NO: 4116 - DNA, 3681 bp, Artificial Sequence
  Description of Artificial Sequence: Synthetic coding sequence
atggcccccctgagagccctgctgagctacctgctgcccctgcactgcgccctgtgcgccgccgccggcagcagaacccccgagctgcacctgagcggcaagctgagcgactacggcgtgaccgtgccctgcagcaccgacttcagaggcagattcctgagccacgtggtgagcggccccgccgccgccagcgccggcagcatggtggtggacaccccccccaccctgcccagacacagcagccacctgagagtggccagaagccccctgcaccccggcggcaccctgtggcccggcagagtgggcagacacagcctgtacttcaacgtgaccgtgttcggcaaggagctgcacctgagactgagacccaacagaagactggtggtgcccggcagcagcgtggagtggcaggaggacttcagagagctgttcagacagcccctgagacaggagtgcgtgtacaccggcggcgtgaccggcatgcccggcgccgccgtggccatcagcaactgcgacggcctggccggcctgatcagaaccgacagcaccgacttcttcatcgagcccctggagagaggccagcaggagaaggaggccagcggcagaacccacgtggtgtacagaagagaggccgtgcagcaggagtgggccgagcccgacggcgacctgcacaacgaggccttcggcctgggcgacctgcccaacctgctgggcctggtgggcgaccagctgggcgacaccgagagaaagagaagacacgccaagcccggcagctacagcatcgaggtgctgctggtggtggacgacagcgtggtgagattccacggcaaggagcacgtgcagaactacgtgctgaccctgatgaacatcgtggacgagatctaccacgacgagagcctgggcgtgcacatcaacatcgccctggtgagactgatcatggtgggctacagacagagcctgagcctgatcgagagaggcaaccccagcagaagcctggagcaggtgtgcagatgggcccacagccagcagagacaggaccccagccacgccgagcaccacgaccacgtggtgttcctgaccagacaggacttcggccccagcggcatgcagggctacgcccccgtgaccggcatgtgccaccccctgagaagctgcgccctgaaccacgaggacggcttcagcagcgccttcgtgatcgcccacgagaccggccacgtgctgggcatggagcacgacggccagggcaacggctgcgccgacgagaccagcctgggcagcgtgatggcccccctggtgcaggccgccttccacagattccactggagcagatgcagcaagctggagctgagcagatacctgcccagctacgactgcctgctggacgaccccttcgaccccgcctggccccagccccccgagctgcccggcatcaactacagcatggacgagcagtgcagattcgacttcggcagcggctaccagacctgcctggccttcagaaccttcgagccctgcaagcagctgtggtgcagccaccccgacaacccctacttctgcaagaccaagaagggcccccccctggacggcaccgagtgcgcccccggcaagtggtgcttcaagggccactgcatctggaagagccccgagcagacctacggccaggacggcggctggagcagctggaccaagttcggcagctgcagcagaagctgcggcggcggcgtgagaagcagaagcagaagctgcaacaaccccagccccgcctacggcggcagactgtgcctgggccccatgttcgagtaccaggtgtgcaacagcgaggagtgccccggcacctacgaggacttcagagcccagcagtgcgccaagagaaacagctactacgtgcaccagaacgccaagcacagctgggtgccctacgagcccgacgacgacgcccagaagtgcgagctgatctgccagagcgccgacaccggcgacgtggtgttcatgaaccaggtggtgcacgacggcaccagatgcagctacagagacccctacagcgtgtgcgccagaggcgagtgcgtgcccgtgggctgcgacaaggaggtgggcagcatgaaggccgacgacaagtgcggcgtgtgcggcggcgacaacagccactgcagaaccgtgaagggcaccctgggcaaggccagcaagcaggccggcgccctgaagctggtgcagatccccgccggcgccagacacatccagatcgaggccctggagaagagcccccacagaatcgtggtgaagaaccaggtgaccggcagcttcatcctgaaccccaagggcaaggaggccaccagcagaaccttcaccgccatgggcctggagtgggaggacgccgtggaggacgccaaggagagcctgaagaccagcggccccctgcccgaggccatcgccatcctggccctgccccccaccgagggcggccccagaagcagcctggcctacaagtacgtgatccacgaggacctgctgcccctgatcggcagcaacaacgtgctgctggaggagatggacacctacgagtgggccctgaagagctgggccccctgcagcaaggcctgcggcggcggcatccagttcaccaagtacggctgcagaagaagaagagaccaccacatggtgcagagacacctgtgcgaccacaagaagagacccaagcccatcagaagaagatgcaaccagcacccctgcagccagcccgtgtgggtgaccgaggagtggggcgcctgcagcagaagctgcggcaagctgggcgtgcagaccagaggcatccagtgcctgctgcccctgagcaacggcacccacaaggtgatgcccgccaaggcctgcgccggcgacagacccgaggccagaagaccctgcctgagagtgccctgccccgcccagtggagactgggcgcctggagccagtgcagcgccacctgcggcgagggcatccagcagagacaggtggtgtgcagaaccaacgccaacagcctgggccactgcgagggcgacagacccgacaccgtgcaggtgtgcagcctgcccgcctgcggcggcaaccaccagaacagcaccgtgagagccgacgtgtgggagctgggcacccccgagggccagtgggtgccccagagcgagcccctgcaccccatcaacaagatcagcagcaccgagccctgcaccggcgacagaagcgtgttctgccagatggaggtgctggacagatactgcagcatccccggctaccacagactgtgctgcgtgagctgcatcaagaaggccagcggccccaaccccggccccgaccccggccccaccagcctgccccccttcagcacccccggcagccccctgcccggcccccaggaccccgccgacgccgccgagccccccggcaagcccaccggcagcgaggaccaccagcacggcagagccacccagctgcccggcgccctggacaccagcagccccggcacccagcaccccttcgcccccgagacccccatccccggcgccagctggagcatcagccccaccacccccggcggcctgccctggggctggacccagacccccacccccgtgcccgaggacaagggccagcccggcgaggacctgagacaccccggcaccagcctgcccgccgccagccccgtgacctag

SEQ ID NO: 4117 - DNA, 762 bp, Artificial Sequence
  Description of Artificial Sequence: Synthetic coding sequence
atggccgccgccaccagaggctgcagaccctggggcagcctgctgggcctgctgggcctggtgagcgccgccgccgccgcctgggacctggccagcctgagatgcaccctgggcgccttctgcgagtgcgacttcagacccgacctgcccggcctggagtgcgacctggcccagcacctggccggccagcacctggccaaggccctggtggtgaaggccctgaaggccttcgtgagagaccccgcccccaccaagcccctggtgctgagcctgcacggctggaccggcaccggcaagagctacgtgagcagcctgctggcccactacctgttccagggcggcctgagaagccccagagtgcaccacttcagccccgtgctgcacttcccccaccccagccacatcgagagatacaagaaggacctgaagagctgggtgcagggcaacctgaccgcctgcggcagaagcctgttcctgttcgacgagatggacaagatgccccccggcctgatggaggtgctgagacccttcctgggcagcagctgggtggtgtacggcaccaactacagaaaggccatcttcatcttcatcagatggggccccgccctgcagtgggcccagtggggcggccacttcagcgaggtgcagctgtacagcctgagcctgtgcagccagcagaaccccgtgccccacggcctgagctgggccttccccgtgcccagcgccaccctgagagacgacatcgtgatcccccccggctag

SEQ ID NO: 4118 - DNA, 966 bp, Artificial Sequence
  Description of Artificial Sequence: Synthetic coding sequence
atggccgccgccaccagaggctgcagaccctggggcagcctgctgggcctgctgggcctggtgagcgccgccgccgccgcctgggacctggccagcctgagatgcaccctgggcgccttctgcgagtgcgacttcagacccgacctgcccggcctggagtgcgacctggcccagcacctggccggccagcacctggccaaggccctggtggtgaaggccctgaaggccttcgtgagagaccccgcccccaccaagcccctggtgctgagcctgcacggctggaccggcaccggcaagagctacgtgagcagcctgctggcccactacctgttccagggcggcctgagaagccccagagtgcaccacttcagccccgtgctgcacttcccccaccccagccacatcgagagatacaagaaggacctgaagagctgggtgcagggcaacctgaccgcctgcggcagaagcctgttcctgttcgacgagatggacaagatgccccccggcctgatggaggtgctgagacccttcctgggcagcagctgggtggtgtacggcaccaactacagaaaggccatcttcatcttcatcagcaacaccggcggcaagcagatcaaccaggtggccctggaggcctggagaagcagaagagacagagaggagatcctgctgcaggagctggagcccgtgatcagcagagccgtgctggacaacccccaccacggcttcagcaacagcggcatcatggaggagagactgctggacgccgtggtgcccttcctgcccctgcagagacaccacgtgagacactgcgtgctgaacgagctggcccagctgggcctggagcccagagacgaggtggtgcaggccgtgctggacagcaccaccttcttccccgaggacgagcagctgttcagcagcaacggctgcaagaccgtggccagcagaatcgccttcttcctgtag

SEQ ID NO: 4119 - DNA, 576 bp, Artificial Sequence
  Description of Artificial Sequence: Synthetic coding sequence
atgcaggtgtggtgcgaccagagacacgaccccggcggctggaccgtgatccagagaagactggacggcagcgtgaacttcttcagaaactgggagacctacaagcagggcttcggcaacatcgacggcgagtactggctgggcctggagaacatctactggctgaccaaccagggcaactacaagctgctggtgaccatggaggactggagcggcagaaaggtgttcgccgagtacgccagcttcagactggagcccgagagcgagtactacaagctgagactgggcagataccacggcaacgccggcgacagcttcacctggcacaacggcaagcagttcaccaccctggacagagaccacgacgtgtacaccggcaactgcgcccactaccagaagggcggctggtggtacaacgcctgcgcccacagcaacctgaacggcgtgtggtacagaggcggccactacagaagcagataccaggacggcgtgtactgggccgagttcagaggcggcagctacagcctgaagaaggtggtgatgatgatcagacccaaccccaacaccttccactag

SEQ ID NO: 4120 - DNA, 1482 bp, Artificial Sequence
  Description of Artificial Sequence: Synthetic coding sequence
atgagacccctgtgcgtgacctgctggtggctgggcctgctggccgccatgggcgccgtggccggccaggaggacggcttcgagggcaccgaggagggcagccccagagagttcatctacctgaacagatacaagagagccggcgagagccaggacaagtgcacctacaccttcatcgtgccccagcagagagtgaccggcgccatctgcgtgaacagcaaggagcccgaggtgctgctggagaacagagtgcacaagcaggagctggagctgctgaacaacgagctgctgaagcagaagagacagatcgagaccctgcagcagctggtggaggtggacggcggcatcgtgagcgaggtgaagctgctgagaaaggagagcagaaacatgaacagcagagtgacccagctgtacatgcagctgctgcacgagatcatcagaaagagagacaacgccctggagctgagccagctggagaacagaatcctgaaccagaccgccgacatgctgcagctggccagcaagtacaaggacctggagcacaagtaccagcacctggccaccctggcccacaaccagagcgagatcatcgcccagctggaggagcactgccagagagtgcccagcgccagacccgtgccccagcccccccccgccgccccccccagagtgtaccagccccccacctacaacagaatcatcaaccagatcagcaccaacgagatccagagcgaccagaacctgaaggtgctgcccccccccctgcccaccatgcccaccctgaccagcctgcccagcagcaccgacaagcccagcggcccctggagagactgcctgcaggccctggaggacggccacgacaccagcagcatctacctggtgaagcccgagaacaccaacagactgatgcaggtgtggtgcgaccagagacacgaccccggcggctggaccgtgatccagagaagactggacggcagcgtgaacttcttcagaaactgggagacctacaagcagggcttcggcaacatcgacggcgagtactggctgggcctggagaacatctactggctgaccaaccagggcaactacaagctgctggtgaccatggaggactggagcggcagaaaggtgttcgccgagtacgccagcttcagactggagcccgagagcgagtactacaagctgagactgggcagataccacggcaacgccggcgacagcttcacctggcacaacggcaagcagttcaccaccctggacagagaccacgacgtgtacaccggcaactgcgcccactaccagaagggcggctggtggtacaacgcctgcgcccacagcaacctgaacggcgtgtggtacagaggcggccactacagaagcagataccaggacggcgtgtactgggccgagttcagaggcggcagctacagcctgaagaaggtggtgatgatgatcagacccaaccccaacaccttccactag

SEQ ID NO: 4121 - DNA, 1959 bp, Artificial Sequence
  Description of Artificial Sequence: Synthetic coding sequence
atggccgccgccgccctgccccccagacccctgctgctgctgcccctggtgctgctgctgagcggcagacccaccagagccgacagcaaggtgttcggcgacctggaccaggtgagaatgaccagcgagggcagcgactgcagatgcaagtgcatcatgagacccctgagcaaggacgcctgcagcagagtgagaagcggcagagccagagtggaggacttctacaccgtggagaccgtgagcagcggcaccgactgcagatgcagctgcaccgccccccccagcagcctgaacccctgcgagaacgagtggaagatggagaagctgaagaagcaggcccccgagctgctgaagctgcagagcatggtggacctgctggagggcaccctgtacagcatggacctgatgaaggtgcacgcctacgtgcacaaggtggccagccagatgaacaccctggaggagagcatcaaggccaacctgagcagagagaacgaggtggtgaaggacagcgtgagacacctgagcgagcagctgagacactacgagaaccacagcgccatcatgctgggcatcaagaaggagctgagcagactgggcctgcagctgctgcagaaggacgccgccgccgcccccgccacccccgccaccggcaccggcagcaaggcccaggacaccgccagaggcaagggcaaggacatcagcaagtacggcagcgtgcagaagagcttcgccgacagaggcctgcccaagccccccaaggagaagctgctgcaggtggagaagctgagaaaggagagcggcaagggcagcttcctgcagcccaccgccaagcccagagccctggcccagcagcaggccgtgatcagaggcttcacctactacaaggccggcaagcaggaggtgaccgaggccgtggccgacaacaccctgcagggcaccagctggctggagcagctgccccccaaggtggagggcagaagcaacagcgccgagcccaacagcgccgagcaggacgaggccgagcccagaagcagcgagagagtggacctggccagcggcacccccaccagcatccccgccaccaccaccaccgccaccaccacccccacccccaccaccagcctgctgcccaccgagccccccagcggccccgaggtgagcagccagggcagagaggccagctgcgagggcaccctgagagccgtggacccccccgtgagacaccacagctacggcagacacgagggcgcctggatgaaggaccccgccgccagagacgacagaatctacgtgaccaactactactacggcaacagcctggtggagttcagaaacctggagaacttcaagcagggcagatggagcaacatgtacaagctgccctacaactggatcggcaccggccacgtggtgtaccagggcgccttctactacaacagagccttcaccaagaacatcatcaagtacgacctgagacagagattcgtggccagctgggccctgctgcccgacgtggtgtacgaggacaccaccccctggaagtggagaggccacagcgacatcgacttcgccgtggacgagagcggcctgtgggtgatctaccccgccgtggacgacagagacgaggcccagcccgaggtgatcgtgctgagcagactggaccccggcgacctgagcgtgcacagagagaccacctggaagaccagactgagaagaaacagctacggcaactgcttcctggtgtgcggcatcctgtacgccgtggacacctacaaccagcaggagggccaggtggcctacgccttcgacacccacaccggcaccgacgccagaccccagctgcccttcctgaacgagcacgcctacaccacccagatcgactacaaccccaaggagagagtgctgtacgcctgggacaacggccaccagctgacctacaccctgcacttcgtggtgtag

SEQ ID NO: 4122 - DNA, 1641 bp, Artificial Sequence
  Description of Artificial Sequence: Synthetic coding sequence
atgaagaaccaggacaagaagaacggcgccgccaagcagagcaaccccaagagcagccccggccagcccgaggccggccccgagggcgcccaggagagacccagccaggccgcccccgccgtggaggccgagggccccggcagcagccaggcccccagaaagcccgagggcgcccaggccagaaccgcccagagcggcgccctgagagacgtgagcgaggagctgagcagacagctggaggacatcctgagcacctactgcgtggacaacaaccagggcggccccggcgaggacggcgcccagggcgagcccgccgagcccgaggacgccgagaagagcagaacctacgtggccagaaacggcgagcccgagcccacccccgtggtgaacggcgagaaggagcccagcaagggcgaccccaacaccgaggagatcagacagagcgacgaggtgggcgacagagaccacagaagaccccaggagaagaagaaggccaagggcctgggcaaggagatcaccctgctgatgcagaccctgaacaccctgagcacccccgaggagaagctggccgccctgtgcaagaagtacgccgagctgctggaggagcacagaaacagccagaagcagatgaagctgctgcagaagaagcagagccagctggtgcaggagaaggaccacctgagaggcgagcacagcaaggccgtgctggccagaagcaagctggagagcctgtgcagagagctgcagagacacaacagaagcctgaaggaggagggcgtgcagagagccagagaggaggaggagaagagaaaggaggtgaccagccacttccaggtgaccctgaacgacatccagctgcagatggagcagcacaacgagagaaacagcaagctgagacaggagaacatggagctggccgagagactgaagaagctgatcgagcagtacgagctgagagaggagcacatcgacaaggtgttcaagcacaaggacctgcagcagcagctggtggacgccaagctgcagcaggcccaggagatgctgaaggaggccgaggagagacaccagagagagaaggacttcctgctgaaggaggccgtggagagccagagaatgtgcgagctgatgaagcagcaggagacccacctgaagcagcagctggccctgtacaccgagaagttcgaggagttccagaacaccctgagcaagagcagcgaggtgttcaccaccttcaagcaggagatggagaagatgaccaagaagatcaagaagctggagaaggagaccaccatgtacagaagcagatgggagagcagcaacaaggccctgctggagatggccgaggagaagaccgtgagagacaaggagctggagggcctgcaggtgaagatccagagactggagaagctgtgcagagccctgcagaccgagagaaacgacctgaacaagagagtgcaggacctgagcgccggcggccagggcagcctgaccgacagcggccccgagagaagacccgagggccccggcgcccaggcccccagcagccccagagtgaccgaggccccctgctaccccggcgcccccagcaccgaggccagcggccagaccggcccccaggagcccaccagcgccagagcctag

SEQ ID NO: 4123 - DNA, 1641 bp, Artificial Sequence; identical to SEQ ID NO: 4122
  Description of Artificial Sequence: Synthetic coding sequence

SEQ ID NO: 4124 - DNA, 1392 bp, Artificial Sequence
  Description of Artificial Sequence: Synthetic coding sequence
atgcacggcagctgcagcttcctgatgctgctgctgcccctgctgctgctgctggtggccaccaccggccccgtgggcgccctgaccgacgaggagaagagactgatggtggagctgcacaacctgtacagagcccaggtgagccccaccgccagcgacatgctgcacatgagatgggacgaggagctggccgccttcgccaaggcctacgccagacagtgcgtgtggggccacaacaaggagagaggcagaagaggcgagaacctgttcgccatcaccgacgagggcatggacgtgcccctggccatggaggagtggcaccacgagagagagcactacaacctgagcgccgccacctgcagccccggccagatgtgcggccactacacccaggtggtgtgggccaagaccgagagaatcggctgcggcagccacttctgcgagaagctgcagggcgtggaggagaccaacatcgagctgctggtgtgcaactacgagccccccggcaacgtgaagggcaagagaccctaccaggagggcaccccctgcagccagtgccccagcggctaccactgcaagaacagcctgtgcgagcccatcggcagccccgaggacgcccaggacctgccctacctggtgaccgaggcccccagcttcagagccaccgaggccagcgacagcagaaagatgggcacccccagcagcctggccaccggcatccccgccttcctggtgaccgaggtgagcggcagcctggccaccaaggccctgcccgccgtggagacccaggcccccaccagcctggccaccaaggacccccccagcatggccaccgaggcccccccctgcgtgaccaccgaggtgcccagcatcctggccgcccacagcctgcccagcctggacgaggagcccgtgaccttccccaagagcacccacgtgcccatccccaagagcgccgacaaggtgaccgacaagaccaaggtgcccagcagaagccccgagaacagcctggaccccaagatgagcctgaccggcgccagagagctgctgccccacgcccaggaggaggccgaggccgaggccgagctgccccccagcagcgaggtgctggccagcgtgttccccgcccaggacaagcccggcgagctgcaggccaccctggaccacaccggccacaccagcagcaagagcctgcccaacttccccaacaccagcgccaccgccaacgccaccggcggcagagccctggccctgcagagcagcctgcccggcgccgagggccccgacaagcccagcgtggtgagcggcctgaacagcggccccggccacgtgtggggccccctgctgggcctgctgctgctgccccccctggtgctggccggcatcttctag

SEQ ID NO: 4125 - DNA, 459 bp, Artificial Sequence
  Description of Artificial Sequence: Synthetic coding sequence
atgatgctgccccagtggctgctgctgctgttcctgctgttcttcttcctgttcctgctgaccagaggcagcctgagccccaccaagtacaacctgctggagctgaaggagagctgcatcagaaaccaggactgcgagaccggctgctgccagagagcccccgacaactgcgagagccactgcgccgagaagggcagcgagggcagcctgtgccagacccaggtgttcttcggccagtacagagcctgcccctgcctgagaaacctgacctgcatctacagcaagaacgagaagtggctgagcatcgcctacggcagatgccagaagatcggcagacagaagctggccaagaagatgttcctggtgctgccccccagctgctgcctgctgctgctgcacctgctgagcagcctgcccagagccctgtgcagcccctgcagccccgagccccccccctag

SEQ ID NO: 4126 - DNA, 366 bp, Artificial Sequence
  Description of Artificial Sequence: Synthetic coding sequence
atgatgctgccccagtggctgctgctgctgttcctgctgttcttcttcctgttcctgctgaccagaggcagcctgagccccaccaagtacaacctgctggagctgaaggagagctgcatcagaaaccaggactgcgagaccggctgctgccagagagcccccgacaactgcgagagccactgcgccgagaagggcagcgagggcagcctgtgccagacccaggtgttcttcggccagtacagagcctgcccctgcctgagaaacctgacctgcatctacagcaagaacgagaagtggctgagcatcgcctacggcagatgccagaagatcggcagacagaagctggccaagaagatgttcttctag

SEQ ID NO: 4127 - DNA, 1122 bp, Artificial Sequence
  Description of Artificial Sequence: Synthetic coding sequence
atgagactgctggcctggctgatcttcctggccaactggggcggcgccagagccgagcccggcaagttctggcacatcgccgacctgcacctggaccccgactacaaggtgagcaaggaccccttccaggtgtgccccagcgccggcagccagcccgtgcccgacgccggcccctggggcgactacctgtgcgacagcccctgggccctgatcaacagcagcatctacgccatgaaggagatcgagcccgagcccgacttcatcctgtggaccggcgacgacaccccccacgtgcccgacgagaagctgggcgaggccgccgtgctggagatcgtggagagactgaccaagctgatcagagaggtgttccccgacaccaaggtgtacgccgccctgggcaaccacgacttccaccccaagaaccagttccccgccggcagcaacaacatctacaaccagatcgccgagctgtggaagccctggctgagcaacgagagcatcgccctgttcaagaagggcgccttctactgcgagaagctgcccggccccagcggcgccggcagaatcgtggtgctgaacaccaacctgtactacaccagcaacgccctgaccgccgacatggccgaccccggccagcagttccagtggctggaggacgtgctgaccgacgccagcaaggccggcgacatggtgtacatcgtgggccacgtgccccccggcttcttcgagaagacccagaacaaggcctggttcagagagggcttcaacgagaagtacctgaaggtggtgagaaagcaccacagagtgatcgccggccagttcttcggccaccaccacaccgacagcttcagaatgctgtacgacgacgccggcgtgcccatcagcgccatgttcatcacccccggcgtgaccccctggaagaccaccctgcccggcgtggtgaacggcgccaacaaccccgccatcagagtgttcgagtacgacagagccaccctgagcctgaaggtgagaagccccgccgaggccagaggcggcggctgggagggcctgaagtgcatcaccaccttcccccacagccagctgatccacctgcccctgaccaccgagccccaggagggctag

SEQ ID NO: 4128 - DNA, 810 bp, Artificial Sequence
  Description of Artificial Sequence: Synthetic coding sequence
atgagactgctggcctggctgatcttcctggccaactggggcggcgccagagccgagcccgaggaggcccagggcccctgcgcccaggagaagggcaagggccccccccccaccagcatcctggccagcctggcccccggcctggaggccggcaagttctggcacatcgccgacctgcacctggaccccgactacaaggtgagcaaggaccccttccaggtgtgccccagcgccggcagccagcccgtgcccgacgccggcccctggggcgactacctgtgcgacagcccctgggccctgatcaacagcagcatctacgccatgaaggagatcgagcccgagcccgacttcatcctgtggaccggcgacgacaccccccacgtgcccgacgagaagctgggcgaggccgccgtgctggagatcgtggagagactgaccaagctgatcagagaggtgttccccgacaccaaggtgtacgccgccctgggcaaccacgacttccaccccaagaaccagttccccgccggcagcaacaacatctacaaccagatcgccgagctgtggaagccctggctgagcaacgagagcatcgccctgttcaagaagggcgccttctactgcgagaagctgcccggccccagcggcgccggcagaatcgtggtgctgaacaccaacctgtactacaccagcaacgccctgaccgccgacatggccgaccccggccagcagttccagtggctggaggacgtgctgaccgacgccagcaaggccggcgacatggtgtacatcgtgggccacgtgcccccctag

SEQ ID NO: 4129 - DNA, 1368 bp, Artificial Sequence
  Description of Artificial Sequence: Synthetic coding sequence
atgagactgctggcctggctgatcttcctggccaactggggcggcgccagagccgagcccggcaagttctggcacatcgccgacctgcacctggaccccgactacaaggtgagcaaggaccccttccaggtgtgccccagcgccggcagccagcccgtgcccgacgccggcccctggggcgactacctgtgcgacagcccctgggccctgatcaacagcagcatctacgccatgaaggagatcgagcccgagcccgacttcatcctgtggaccggcgacgacaccccccacgtgcccgacgagaagctgggcgaggccgccgtgctggagatcgtggagagactgaccaagctgatcagagaggtgttccccgacaccaaggtgtacgccgccctgggcaaccacgacttccaccccaagaaccagttccccgccggcagcaacaacatctacaaccagatcgccgagctgtggaagccctggctgagcaacgagagcatcgccctgttcaagaagggcgccttctactgcgagaagctgcccggccccagcggcgccggcagaatcgtggtgctgaacaccaacctgtactacaccagcaacgccctgaccgccgacatggccgaccccggccagcagttccagtggctggaggacgtgctgaccgacgccagcaaggccggcgacatggtgtacatcgtgggccacgtgccccccggcttcttcgagaagacccagaacaaggcctggttcagagagggcttcaacgagaagtacctgaaggtggtgagaaagcaccacagagtgatcgccggccagttcttcggccaccaccacaccgacagcttcagaatgctgtacgacgacgccggcgtgcccatcagcgccatgttcatcacccccggcgtgaccccctggaagaccaccctgcccggcgtggtgaacggcgccaacaaccccgccatcagagtgttcgagtacgacagagccaccctgagcctgaaggacatggtgacctacttcatgaacctgagccaggccaacgcccagggcacccccagatgggagctggagtaccagctgaccgaggcctacggcgtgcccgacgccagcgcccacagcatgcacaccgtgctggacagaatcgccggcgaccagagcaccctgcagagatactacgtgtacaacagcgtgagctacagcgccggcgtgtgcgacgaggcctgcagcatgcagcacgtgtgcgccatgagacaggtggacatcgacgcctacaccacctgcctgtacgccagcggcaccacccccgtgccccagctgcccctgctgctgatggccctgctgggcctgtgcaccctggtgctgtag

SEQ ID NO: 4130 - DNA, 867 bp, Artificial Sequence
  Description of Artificial Sequence: Synthetic coding sequence
atggccctggcccccccccccagaggcctgtggcaggccaaggacatcagccccatcgtgaaggccgccagaagagacggcgagctgctgctgagcgcccagctggacagcgaggagagagaccccggcgtgcccagacccagcccctacgccccctacatcctggtgtacgccaacgacctggccatcagcgagcccaacagcgtggccgtgaccctgcagagatacgaccccttccccgccggcgaccccgagcccagagccgcccccaacaacagcgccgaccccagagtgagaagagccgcccaggccaccggccccctgcaggacaacgagctgcccggcctggacgagagaccccccagagcccacgcccagcacttccacaagcaccagctgtggcccagccccttcagagccctgaagcccagacccggcagaaaggacagaagaaagaagggccaggaggtgttcatggccgccagccaggtgctggacttcgacgagaagaccatgcagaaggccagaagaaagcagtgggacgagcccagagtgtgcagcagaagatacctgaaggtggacttcgccgacatcggctggaacgagtggatcatcagccccaagagcttcgacgcctactactgcgccggcgcctgcgagttccccatgcccaagatcgtgagacccagcaaccacgccaccatccagagcatcgtgagagccgtgggcatcatccccggcatccccgagccctgctgcgtgcccgacaagatgaacagcctgggcgtgctgttcctggacgagaacagaaacgtggtgctgaaggtgtaccccaacatgagcgtggacacctgcgcctgcagatag

SEQ ID NO: 4131 - DNA, 1626 bp, Artificial Sequence
  Description of Artificial Sequence: Synthetic coding sequence
atgcccttcagactgctgatccccctgggcctgctgtgcgccctgctgccccagcaccacggcgcccccggccccgacggcagcgcccccgaccccgcccactacagcttcagcctgaccctgatcgacgccctggacaccctgctgatcctgggcaacgtgagcgagttccagagagtggtggaggtgctgcaggacagcgtggacttcgacatcgacgtgaacgccagcgtgttcgagaccaacatcagagtggtgggcggcctgctgagcgcccacctgctgagcaagaaggccggcgtggaggtggaggccggctggccctgcagcggccccctgctgagaatggccgaggaggccgccagaaagctgctgcccgccttccagacccccaccggcatgccctacggcaccgtgaacctgctgcacggcgtgaaccccggcgagacccccgtgacctgcaccgccggcatcggcaccttcatcgtggagttcgccaccctgagcagcctgaccggcgaccccgtgttcgaggacgtggccagagtggccctgatgagactgtgggagagcagaagcgacatcggcctggtgggcaaccacatcgacgtgctgaccggcaagtgggtggcccaggacgccggcatcggcgccggcgtggacagctacttcgagtacctggtgaagggcgccatcctgctgcaggacaagaagctgatggccatgttcctggagtacaacaaggccatcagaaactacaccagattcgacgactggtacctgtgggtgcagatgtacaagggcaccgtgagcatgcccgtgttccagagcctggaggcctactggcccggcctgcagagcctgatcggcgacatcgacaacgccatgagaaccttcctgaactactacaccgtgtggaagcagttcggcggcctgcccgagttctacaacatcccccagggctacaccgtggagaagagagagggctaccccctgagacccgagctgatcgagagcgccatgtacctgtacagagccaccggcgaccccaccctgctggagctgggcagagacgccgtggagagcatcgagaagatcagcaaggtggagtgcggcttcgccaccatcaaggacctgagagaccacaagctggacaacagaatggagagcttcttcctggccgagaccgtgaagtacctgtacctgctgttcgaccccaccaacttcatccacaacaacggcagcaccttcgacgccgtgatcaccccctacggcgagtgcatcctgggcgccggcggctacatcttcaacaccgaggcccaccccatcgaccccgccgccctgcactgctgccagagactgaaggaggagcagtgggaggtggaggacctgatgagagagttctacagcctgaagagaagcagaagcaagttccagaagaacaccgtgagcagcggcccctgggagccccccgccagacccggcaccctgttcagccccgagaaccacgaccaggccagagagagaaagcccgccaagcagaaggtgcccctgctgagctgccccagccagcccttcaccagcaagctggccctgctgggccaggtgttcctggacagcagctag

SEQ ID NO: 4132 - DNA, 1737 bp, Artificial Sequence
  Description of Artificial Sequence: Synthetic coding sequence
atgcccttcagactgctgatccccctgggcctgctgtgcgccctgctgccccagcaccacggcgcccccggccccgacggcagcgcccccgaccccgcccactacagagagagagtgaaggccatgttctaccacgcctacgacagctacctggagaacgccttccccttcgacgagctgagacccctgacctgcgacggccacgacacctggggcagcttcagcctgaccctgatcgacgccctggacaccctgctgatcctgggcaacgtgagcgagttccagagagtggtggaggtgctgcaggacagcgtggacttcgacatcgacgtgaacgccagcgtgttcgagaccaacatcagagtggtgggcggcctgctgagcgcccacctgctgagcaagaaggccggcgtggaggtggaggccggctggccctgcagcggccccctgctgagaatggccgaggaggccgccagaaagctgctgcccgccttccagacccccaccggcatgccctacggcaccgtgaacctgctgcacggcgtgaaccccggcgagacccccgtgacctgcaccgccggcatcggcaccttcatcgtggagttcgccaccctgagcagcctgaccggcgaccccgtgttcgaggacgtggccagagtggccctgatgagactgtgggagagcagaagcgacatcggcctggtgggcaaccacatcgacgtgctgaccggcaagtgggtggcccaggacgccggcatcggcgccggcgtggacagctacttcgagtacctggtgaagggcgccatcctgctgcaggacaagaagctgatggccatgttcctggagtacaacaaggccatcagaaactacaccagattcgacgactggtacctgtgggtgcagatgtacaagggcaccgtgagcatgcccgtgttccagagcctggaggcctactggcccggcctgcagagcctgatcggcgacatcgacaacgccatgagaaccttcctgaactactacaccgtgtggaagcagttcggcggcctgcccgagttctacaacatcccccagggctacaccgtggagaagagagagggctaccccctgagacccgagctgatcgagagcgccatgtacctgtacagagccaccggcgaccccaccctgctggagctgggcagagacgccgtggagagcatcgagaagatcagcaaggtggagtgcggcttcgccaccatcaaggacctgagagaccacaagctggacaacagaatggagagcttcttcctggccgagaccgtgaagtacctgtacctgctgttcgaccccaccaacttcatccacaacaacggcagcaccttcgacgccgtgatcaccccctacggcgagtgcatcctgggcgccggcggctacatcttcaacaccgaggcccaccccatcgaccccgccgccctgcactgctgccagagactgaaggaggagcagtgggaggtggaggacctgatgagagagttctacagcctgaagagaagcagaagcaagttccagaagaacaccgtgagcagcggcccctgggagccccccgccagacccggcaccctgttcagccccgagaaccacgaccaggccagagagagaaagcccgccaagcagaaggtgcccctgctgagctgccccagccagcccttcaccagcaagctggccctgctgggccaggtgttcctggacagcagctag

SEQ ID NO: 4133 - DNA, 495 bp, Artificial Sequence
  Description of Artificial Sequence: Synthetic coding sequence
atgagaagctgctacgtggcccaggccggcctgaagctgcccggcagcagcgacccccccgccagcgccagccagagcaccagaatcaccgccagcggctacggcccccccagcagcagacccagcagcagagtggtgaacggcgaggacgccgtgccctacagctggccctggcaggtgagcctgcagtacgagaagagcggcagcttctaccacacctgcggcggcagcctgatcgcccccgactgggtggtgaccgccggccactgcatcagcagcagcagaacctaccaggtggtgctgggcgagtacgacagagccgtgaaggagggccccgagcaggtgatccccatcaacagcggcgacctgttcgtgcaccccctgtggaacagaagctgcgtggcctgcggcaacgacatcgccctgatcaagctgagcagaagcgcccagctgggcgacgccgtgcagctggccagcctgccccccgccggctag

SEQ ID NO: 4134 - DNA, 3663 bp, Artificial Sequence
  Description of Artificial Sequence: Synthetic coding sequence
atgcccggcctgctgaactggatcaccggcgccgccctgcccctgaccgccagcgacgtgaccagctgcgtgagcggctacgccctgggcctgaccgccagcctgacctacggcaacctggaggcccagcccttccagggcctgttcgtgtaccccctggacgagtgcaccaccgtgatcggcttcgaggccgtgatcgccgacagagtggtgaccgtgcagatcaaggacaaggccaagctggagagcggccacttcgacgccagccacgtgagaagccccaccgtgaccggcaacatcctgcaggacggcgtgagcatcgccccccacagctgcacccccggcaaggtgaccctggacgaggacctggagagaatcctgttcgtggccaacctgggcaccatcgcccccatggagaacgtgaccatcttcatcagcaccagcagcgagctgcccaccctgcccagcggcgccgtgagagtgctgctgcccgccgtgtgcgcccccaccgtgccccagttctgcaccaagagcaccggcaccagcaaccagcaggcccagggcaaggacagacactgcttcggcgcctgggcccccggcagctggaacaagctgtgcctggccaccctgctgaacaccgaggtgagcaaccccatggagtacgagttcaacttccagctggagatcagaggcccctgcctgctggccggcgtggagagccccacccacgagatcagagccgacgccgcccccagcgccagaagcgccaagagcatcatcatcaccctggccaacaagcacaccttcgacagacccgtggagatcctgatccaccccagcgagccccacatgccccacgtgctgatcgagaagggcgacatgaccctgggcgagttcgaccagcacctgaagggcagaaccgacttcatcaagggcatgaagaagaagagcagagccgagagaaagaccgagatcatcagaaagagactgcacaaggacatcccccaccacagcgtgatcatgctgaacttctgccccgacctgcagagcgtgcagccctgcctgagaaaggcccacggcgagttcatcttcctgatcgacagaagcagcagcatgagcggcatcagcatgcacagagtgaaggacgccatgctggtggccctgaagagcctgatgcccgcctgcctgttcaacatcatcggcttcggcagcaccttcaagagcctgttccccagcagccagacctacagcgaggacagcctggccatggcctgcgacgacatccagagaatgaaggccgacatgggcggcaccaacatcctgagccccctgaagtgggtgatcagacagcccgtgcacagaggccaccccagactgctgttcgtgatcaccgacggcgccgtgaacaacaccggcaaggtgctggagctggtgagaaaccacgccttcagcaccagatgctacagcttcggcatcggccccaacgtgtgccacagactggtgaagggcctggccagcgtgagcgagggcagcgccgagctgctgatggagggcgagagactgcagcccaagatggtgaagagcctgaagaaggccatggcccccgtgctgagcgacgtgaccgtggagtggatcttccccgagaccaccgaggtgctggtgagccccgtgagcgccagcagcctgttccccggcgagagactggtgggctacggcatcgtgtgcgacgccagcctgcacatcagcaaccccagaagcgacaagagaagaagatacagcatgctgcacagccaggagagcggcagcagcgtgttctaccacagccaggacgacggccccggcctggagggcggcgactgcgccaagaacagcggcgcccccttcatcctgggccaggccaagaacgccagactggccagcggcgacagcaccaccaagcacgacctgaacctgagccagagaagaagagcctacagcaccaaccagatcaccaaccacaagcccctgcccagagccaccatggccagcgaccccatgcccgccgccaagagataccccctgagaaaggccagactgcaggacctgaccaaccagaccagcctggacgtgcagagatggcagatcgacctgcagcccctgctgaacagcggccaggacctgaaccagggccccaagctgagaggccccggcgccagaagacccagcctgctgccccagggctgccagcccttcctgccctggggccaggagacccaggcctggagccccgtgagagagagaaccagcgacagcagaagccccggcgacctggagcccagccaccaccccagcgccttcgagaccgagaccagcagcgactgggacccccccgccgagagccaggagagagccagccccagcagacccgccacccccgcccccgtgctgggcaaggccctggtgaagggcctgcacgacagccagagactgcagtgggaggtgagcttcgagctgggcacccccggccccgagagaggcggcgcccaggacgccgacctgtggagcgagaccttccaccacctggccgccagagccatcatcagagacttcgagcagctggccgagagagagggcgagatcgagcagggcagcaacagaagataccaggtgagcgccctgcacaccagcaaggcctgcaacatcatcagcaagtacaccgccttcgtgcccgtggacgtgagcaagagcagatacctgcccaccgtggtggagtaccccaacagcgccgccctgagaatgctgggcagcagagccctggcccagcagtggagaggcaccagcagcggcttcggcagaccccagaccatgctgggcgaggacagcgcccccggcaacggcaagttccaggccctgaacatggaggccagccccaccgccctgttcagcgaggccagaagccccggcagagagaagcacggcgccagcgagggcccccagagaagcctggccaccaacaccctgagcagcatgaaggccagcgagaacctgttcggcagctggctgaacctgaacaagagcagactgctgaccagagccgccaagggcttcctgagcaagcccctgatcaaggccgtggagagcaccagcggcaaccagagcttcgactacatccccctggtgagcctgcagctggccagcggcgccttcctgctgaacgaggccttctgcgaggccacccacatccccatggagaagctgaagtggaccagccccttcacctgccacagagtgagcctgaccaccagacccagcgagagcaagacccccagcccccagctgtgcaccagcagcccccccagacaccccagctgcgacagcttcagcctggagcccctggccaagggcaagctgggcctggagcccagagccgtggtggagcacaccggcaagctgtgggccaccgtggtgggcctggcctggctggagcacagcagcgccagctacttcaccgagtgggagctggtggccgccaaggccaacagctggctggagcagcaggaggtgcccgagggcagaacccagggcaccctgaaggccgccgccagacagctgttcgtgctgctgagacactgggacgagaacctggagttcaacatgctgtgctacaaccccaactacgtgtag

SEQ ID NO: 4135 - DNA, 3051 bp, Artificial Sequence
  Description of Artificial Sequence: Synthetic coding sequence
atgcccggcctgctgaactggatcaccggcgccgccctgcccctgaccgccagcgacgtgaccagctgcgtgagcggctacgccctgggcctgaccgccagcctgacctacggcaacctggaggcccagcccttccagggcctgttcgtgtaccccctggacgagtgcaccaccgtgatcggcttcgaggccgtgatcgccgacagagtggtgaccgtgcagatcaaggacaaggccaagctggagagcggccacttcgacgccagccacgtgagaagccccaccgtgaccggcaacatcctgcaggacggcgtgagcatcgccccccacagctgcacccccggcaaggtgaccctggacgaggacctggagagaatcctgttcgtggccaacctgggcaccatcgcccccatggagaacgtgaccatcttcatcagcaccagcagcgagctgcccaccctgcccagcggcgccgtgagagtgctgctgcccgccgtgtgcgcccccaccgtgccccagttctgcaccaagagcaccggcaccagcaaccagcaggcccagggcaaggacagacactgcttcggcgcctgggcccccggcagctggaacaagctgtgcctggccaccctgctgaacaccgaggtgagcaaccccatggagtacgagttcaacttccagctggagatcagaggcccctgcctgctggccggcgtggagagccccacccacgagatcagagccgacgccgcccccagcgccagaagcgccaagagcatcatcatcaccctggccaacaagcacaccttcgacagacccgtggagatcctgatccaccccagcgagccccacatgccccacgtgctgatcgagaagggcgacatgaccctgggcgagttcgaccagcacctgaagggcagaaccgacttcatcaagggcatgaagaagaagagcagagccgagagaaagaccgagatcatcagaaagagactgcacaaggacatcccccaccacagcgtgatcatgctgaacttctgccccgacctgcagagcgtgcagccctgcctgagaaaggcccacggcgagttcatcttcctgatcgacagaagcagcagcatgagcggcatcagcatgcacagagtgaaggacgccatgctggtggccctgaagagcctgatgcccgcctgcctgttcaacatcatcggcttcggcagcaccttcaagagcctgttccccagcagccagacctacagcgaggacagcctggccatggcctgcgacgacatccagagaatgaaggccgacatgggcggcaccaacatcctgagccccctgaagtgggtgatcagacagcccgtgcacagaggccaccccagactgctgttcgtgatcaccgacggcgccgtgaacaacaccggcaaggtgctggagctggtgagaaaccacgccttcagcaccagatgctacagcttcggcatcggccccaacgtgtgccacagactggtgaagggcctggccagcgtgagcgagggcagcgccgagctgctgatggagggcgagagactgcagcccaagatggtgaagagcctgaagaaggccatggcccccgtgctgagcgacgtgaccgtggagtggatcttccccgagaccaccgaggtgctggtgagccccgtgagcgccagcagcctgttccccggcgagagactggtgggctacggcatcgtgtgcgacgccagcctgcacatcagcaaccccagaagcgacaagagaagaagatacagcatgctgcacagccaggagagcggcagcagcgtgttctaccacagccaggacgacggccccggcctggagggcggcgactgcgccaagaacagcggcgcccccttcatcctgggccaggccaagaacgccagactggccagcggcgacagcaccaccaagcacgacctgaacctgagccagagaagaagagcctacagcaccaaccagatcaccaaccacaagcccctgcccagagccaccatggccagcgaccccatgcccgccgccaagagataccccctgagaaaggccagactgcaggacctgaccaaccagaccagcctggacgtgcagagatggcagatcgacctgcagcccctgctgaacagcggccaggacctgaaccagggccccaagctgagaggccccggcgccagaagacccagcctgctgccccagggctgccagcccttcctgccctggggccaggagacccaggcctggagccccgtgagagagagaaccagcgacagcagaagccccggcgacctggagcccagccaccaccccagcgccttcgagaccgagaccagcagcgactgggacccccccgccgagagccaggagagagccagccccagcagacccgccacccccgcccccgtgctgggcaaggccctggtgaagggcctgcacgacagccagagactgcagtgggaggtgagcttcgagctgggcacccccggccccgagagaggcggcgcccaggacgccgacctgtggagcgagaccttccaccacctggccgccagagccatcatcagagacttcgagcagctggccgagagagagggcgagatcgagcagggcagcaacagaagataccaggtgagcgccctgcacaccagcaaggcctgcaacatcatcagcaagtacaccgccttcgtgcccgtggacgtgagcaagagcagatacctgcccaccgtggtggagtaccccaacagcgccgccctgagaatgctgggcagcagagccctggcccagcagtggagaggcaccagcagcggcttcggcagaccccagaccatgctgggcgaggacagcgcccccggcaacggccccagaaagtgcagccagaccctgatgggcttcaagaccaagaccgagaccgagcacagcgtgagaggctggaagcccagaggcgccctgcagaaccagagcgtgctgagcaccagctggagccactggccccccaagcccagaagaaccagcagcacccccgagcccagctag

SEQ ID NO: 4136 - DNA, 3663 bp, Artificial Sequence; identical to SEQ ID NO: 4134
  Description of Artificial Sequence: Synthetic coding sequence

SEQ ID NO: 4137 - DNA, 5235 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagtaccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagaggcagcagcacctggctgaccgccttcgtgctgaaggtgctgagcctggcccaggagcaggtgggcggcagccccgagaagctgcaggagaccagcaactggctgctgagccagcagcaggccgacggcagcttccaggacctgagccccgtgatccacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccagcagcttcctgggcgagaaggccagcgccggcctgctgggcgcccacgccgccgccatcaccgcctacgccctgaccctgaccaaggcccccgccgacctgagaggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 4138 - DNA, 1242 bp, Artificial Sequence
  Description of Artificial Sequence: Synthetic coding sequence
atgaagggcgccctgggcagccccgtggccgccgccggcgccgccatgcaggagagcttcggctgcgtggtggccaacagattccaccagctgctggacgacgagagcgaccccttcgacatcctgagagaggccgagagaagaagacagcagcagctgcagagaaagagaagagacgaggccgccgccgccgccggcgccggccccagaggcggcagaagccccgccggcgccagcggccacagagccggcgccggcggcagaagagagagccagaaggagagaaagagcctgcccgcccccgtggcccagagacccgacagccccggcggcggcctgcaggcccccggccagaagagaacccccagaagaggcgagcagcagggctggaacgacagcagaggccccgagggcatgctggagagagccgagagaagaagctacagagagtacagaccctacgagaccgagagacaggccgacttcaccgccgagaagttccccgacgagaagcccggcgacagattcgacagagacagacccctgagaggcagaggcggccccagaggcggcatgagaggcagaggcagaggcggccccggcaacagagtgttcgacgccttcgaccagagaggcaagagagagttcgagagatacggcggcaacgacaagatcgccgtgagaaccgaggacaacatgggcggctgcggcgtgagaacctggggcagcggcaaggacaccagcgacgtggagcccaccgcccccatggaggagcccaccgtggtggaggagagccagggcacccccgaggaggagagccccgccaaggtgcccgagctggaggtggaggaggagacccaggtgcaggagatgaccctggacgagtggaagaacctgcaggagcagaccagacccaagcccgagttcaacatcagaaagcccgagagcaccgtgcccagcaaggccgtggtgatccacaagagcaagtacagagacgacatggtgaaggacgactacgaggacgacagccacgtgttcagaaagcccgccaacgacatcaccagccagctggagatcaacttcggcaacctgcccagacccggcagaggcgccagaggcggcaccagaggcggcagaggcagaatcagaagagccgagaactacggccccagagccgaggtggtgatgcaggacgtggcccccaaccccgacgaccccgaggacttccccgccctgagctag

SEQ ID NO: 4139 - DNA, 927 bp, Artificial Sequence
  Description of Artificial Sequence: Synthetic coding sequence
atgaagggcgccctgggcagccccgtggccgccgccggcgccgccatgcaggagagcttcggctgcgtggtggccaacagattccaccagctgctggacgacgagagcgaccccttcgacatcctgagagaggccgagagaagaagacagcagcagctgcagagaaagagaagagacgaggccgccgccgccgccggcgccggccccagaggcggcagaagccccgccggcgccagcggccacagagccggcgccggcggcagaagagagagccagaaggagagaaagagcctgcccgcccccgtggcccagagacccgacagccccggcggcggcctgcaggcccccggccagaagagaacccccagaagaggcgagcagcagggctggaacgacagcagaggccccgagggcatgctggagagagccgagagaagaagctacagagagtacagaccctacgagaccgagagacaggccgacttcaccgccgagaagttccccgacgagaaggtgcccgagctggaggtggaggaggagacccaggtgcaggagatgaccctggacgagtggaagaacctgcaggagcagaccagacccaagcccgagttcaacatcagaaagcccgagagcaccgtgcccagcaaggccgtggtgatccacaagagcaagtacagagacgacatggtgaaggacgactacgaggacgacagccacgtgttcagaaagcccgccaacgacatcaccagccagctggagatcaacttcggcaacctgcccagacccggcagaggcgccagaggcggcaccagaggcggcagaggcagaatcagaagagccgagaactacggccccagagccgaggtggtgatgcaggacgtggcccccaaccccgacgaccccgaggacttccccgccctgagctag

SEQ ID NO: 4140 - DNA, 1437 bp, Artificial Sequence
  Description of Artificial Sequence: Synthetic coding sequence
atgcccagaagaggctacagcaagcccggcagctggggcagcttctgggccatgctgaccctggtgggcctggtgacccacgccgcccagagagccgacgtgggcggcgaggccgccggcaccagcatcaaccacagccaggccgtgctgcagagactgcaggagctgctgagacagggcaacgccagcgacgtggtgctgagagtgcaggccgccggcaccgacgaggtgagagtgttccacgcccacagactgctgctgggcctgcacagcgagctgttcctggagctgctgagcaaccagagcgaggccgtgctgcaggagccccaggactgcgccgccgtgttcgacaagttcatcagatacctgtactgcggcgagctgaccgtgctgctgacccaggccatccccctgcacagactggccaccaagtacggcgtgagcagcctgcagagaggcgtggccgactacatgagagcccacctggccggcggcgccggccccgccgtgggctggtaccactacgccgtgggcaccggcgacgaggccctgagagagagctgcctgcagttcctggcctggaacctgagcgccgtggccgccagcaccgagtggggcgccgtgagccccgagctgctgtggcagctgctgcagagaagcgacctggtgctgcaggacgagctggagctgttccacgccctggaggcctggctgggcagagccagacccccccccgccgtggccgagagagccctgagagccatcagataccccatgatcccccccgcccagctgttccagctgcaggccagaagcgccgccctggccagacacggccccgccgtggccgacctgctgctgcaggcctaccagttccacgccgccagccccctgcactacgccaagttcttcgacgtgaacggcagcgccttcctgcccagaaactacctggcccccgcctggggcgccccctgggtgatcaacaaccccgccagagacgacagaagcaccagcttccagacccagctgggccccagcggccacgacgccggcagaagagtgacctggaacgtgctgttcagccccagatggctgcccgtgagcctgagacccgtgtacgccgacgccgccggcaccgccctgcccgccgccagacccgaggacggcagacccagactggtggtgacccccgccagcagcggcggcgacgccgccggcgtgagcttccagaagaccgtgctggtgggcgccagacagcagggcagactgctggtgagacacgcctacagcttccaccagagcagcgaggaggccggcgacttcctggcccacgccgacctgcagagaagaaacagcgagtacctggtggagaacgccctgcacctgcacctgatcgtgaagcccgtgtaccacaccctgatcagaacccccaagtag

SEQ ID NO: 4141 - DNA, 477 bp, Artificial Sequence
  Description of Artificial Sequence: Synthetic coding sequence
atgtgctgccccggcggccactacaccctgatcctgagaagaggcaacagattcagaagagagaagagacccgccaaggtgaccggcgcccagaccgaggtgcagctggccccccccctgcccagaggcagagccagaagaagcccctggagcgtgcccatcagcctgagcatcgacagactggagttcgacctgctgtaccccgccatcaagggcgacaccatccagctgtacctgggcgccaagctgctggacagccagggcaaggtgaccaagtggttcaacaacagcgccgccagcctgaccatgcccaccctggacaacatccccttcagcctgatcgtgagccaggacgtggtgaaggccgccgtggccgccgtgctgagccccgaggagttcatggtgctgctggacagcgtgctgcccgagagcgcccacagactgaagagcagcatcggcctgatcaacgagaagtag

SEQ ID NO: 4142 - DNA, 771 bp, Artificial Sequence; identical to SEQ ID NO: 3949
  Description of Artificial Sequence: Synthetic coding sequence

SEQ ID NO: 4143 - DNA, 771 bp, Artificial Sequence; identical to SEQ ID NO: 3949
  Description of Artificial Sequence: Synthetic coding sequence

SEQ ID NO: 4144 - DNA, 657 bp, Artificial Sequence
  Description of Artificial Sequence: Synthetic coding sequence
atgatgtgccccctgtggagactgctgatcttcctgggcctgctggccctgcccctggccccccacaagcagccctggcccggcctggcccaggcccacagagacaacaagagcaccctggccagaatcatcgcccagggcctgatcaagcacaacgccgagagcagaatccagaacatccacttcggcgacagactgaacgccagcgcccaggtggcccccggcctggtgggctggctgatcagcggcagaaagcaccagcagcagcaggagagcagaagcttcgacaacaacatcgtgaagatgtgcgcccacatgagcatcgtggtggagttctggctggagaaggacgagttcggcagaagagacctggtgatcggcaagtgcgacgccgagcccagcagcgtgcacgtggccatcctgaccgaggccatcccccccaagatgaaccagttcctgtacaacctgaaggagaacctgcagaaggtgctgccccacatggtggagagccaggtgtgccccctgatcggcgagatcctgggccagctggacgtgaagctgctgaagagcctgatcgagcaggaggccgcccacgagcccacccaccacgagaccagccagcccagcgcctgccaggccggcgagagccccagctag

SEQ ID NO: 4145 - DNA, 765 bp, Artificial Sequence
  Description of Artificial Sequence: Synthetic coding sequence
atgatgtgccccctgtggagactgctgatcttcctgggcctgctggccctgcccctggccccccacaagcagccctggcccggcctggcccaggcccacagagacaacaagagcaccctggccagaatcatcgcccagggcctgatcaagcacaacgccgagagcagaatccagaacatccacttcggcgacagactgaacgccagcgcccaggtggcccccggcctggtgggctggctgatcagcggcagaaagcaccagcagcagcaggagagcagcatcaacatcaccaacatccagctggactgcggcggcatccagatcagcttccacaaggagtggttcagcgccaacatcagcctggagttcgacctggagctgagacccagcttcgacaacaacatcgtgaagatgtgcgcccacatgagcatcgtggtggagttctggctggagaaggacgagttcggcagaagagacctggtgatcggcaagtgcgacgccgagcccagcagcgtgcacgtggccatcctgaccgaggccatcccccccaagatgaaccagttcctgtacaacctgaaggagaacctgcagaaggtgctgccccacatggtggagagccaggtgtgccccctgatcggcgagatcctgggccagctggacgtgaagctgctgaagagcctgatcgagcaggaggccgcccacgagcccacccaccacgagaccagccagcccagcgcctgccaggccggcgagagccccagctag

SEQ ID NO: 4146 - DNA, 1635 bp, Artificial Sequence
  Description of Artificial Sequence: Synthetic coding sequence
atgaagatcagcatgatcaactacaagagcctgctggccctgctgttcatcctggccagctggatcatcttcaccgtgttccagaacagcaccaaggtgtggagcgccctgaacctgagcatcagcctgcactactggaacaacagcaccaagagcctgttccccaagacccccctgatcagcctgaagcccctgaccgagaccgagctgagaatcaaggagatcatcgagaagctggaccagcagatcccccccagacccttcacccacgtgaacaccaccaccagcgccacccacagcaccgccaccatcctgaaccccagagacacctactgcagaggcgaccagctgcacatcctgctggaggtgagagaccacctgggcagaagaaagcagtacggcggcgacttcctgagagccagaatgagcagccccgccctgatggccggcgccagcggcaaggtgaccgacttcaacaacggcacctacctggtgagcttcaccctgttctgggagggccaggtgagcctgagcctgctgctgatccaccccagcgagggcgtgagcgccctgtggagcgccagaaaccagggctacgacagagtgatcttcaccggccagttcgtgaacggcaccagccaggtgcacagcgagtgcggcctgatcctgaacaccaacgccgagctgtgccagtacctggacaacagagaccaggagggcttctactgcgtgagaccccagcacatgccctgcgccgccctgacccacatgtacagcaagaacaagaaggtgagctacctgagcaagcaggagaagagcctgttcgagagaagcaacgtgggcgtggagatcatggagaagttcaacaccatcagcgtgagcaagtgcaacaaggagaccgtggccatgaaggagaagtgcaagttcggcatgaccagcaccatccccagcggccacgtgtggagaaacacctggaaccccgtgagctgcagcctggccaccgtgaagatgaaggagtgcctgagaggcaagctgatctacctgatgggcgacagcaccatcagacagtggatggagtacttcaaggccagcatcaacaccctgaagagcgtggacctgcacgagagcggcaagctgcagcaccagctggccgtggacctggacagaaacatcaacatccagtggcagaagtactgctaccccctgatcggcagcatgacctacagcgtgaaggagatggagtacctgaccagagccatcgacagaaccggcggcgagaagaacaccgtgatcgtgatcagcctgggccagcacttcagacccttccccatcgacgtgttcatcagaagagccctgaacgtgcacaaggccatccagcacctgctgctgagaagccccgacaccatggtgatcatcaagaccgagaacatcagagagatgtacaacgacgccgagagattcagcgacttccacggctacatccagtacctgatcatcaaggacatcttccaggacctgagcgtgagcatcatcgacgcctgggacatcaccatcgcctacggcaccaacaacgtgcaccccccccagcacgtggtgggcaaccagatcaacatcctgctgaactacatctgctag

SEQ ID NO: 4147 - DNA, 1845 bp, Artificial Sequence
  Description of Artificial Sequence: Synthetic coding sequence
atgtggatggcctggtgcgtggccgccctgagcgtggtggccgtgtgcggcaccagccacgagaccaacaccgtgctgagagtgaccaaggacgtgctgagcaacgccatcagcggcatgctgcagcagagcgacgccctgcacagcgccctgagagaggtgcccctgggcgtgggcgacatcccctacaacgacttccacgtgagaggccccccccccgtgtacaccaacggcaagaagctggacggcatctaccagtacggccacatcgagaccaacgacaacaccgcccagctgggcggcaagtacagatacggcgagatcctggagagcgagggcagcatcagagacctgagaaacagcggctacagaagcgccgagaacgcctacggcggccacagaggcctgggcagatacagagccgcccccgtgggcagactgcacagaagagagctgcagcccggcgagatcccccccggcgtggccaccggcgccgtgggccccggcggcctgctgggcaccggcggcatgctggccgccgacggcatcctggccggccagggcggcctgctgggcggcggcggcctgctgggcgacggcggcctgctgggcggcggcggcgtgctgggcgtgctgggcgagggcggcatcctgagcaccgtgcagggcatcaccggcctgagaatcgtggagctgaccctgcccagagtgagcgtgagactgctgcccggcgtgggcgtgtacctgagcctgtacaccagagtggccatcaacggcaagagcctgatcggcttcctggacatcgccgtggaggtgaacatcaccgccaaggtgagactgaccatggacagaaccggctaccccagactggtgatcgagagatgcgacaccctgctgggcggcatcaaggtgaagctgctgagaggcctgctgcccaacctggtggacaacctggtgaacagagtgctggccgacgtgctgcccgacctgctgtgccccatcgtggacgtggtgctgggcctggtgaacgaccagctgggcctggtggacagcctgatccccctgggcatcctgggcagcgtgcagtacaccttcagcagcctgcccctggtgaccggcgagttcctggagctggacctgaacaccctggtgggcgaggccggcggcggcctgatcgactaccccctgggctggcccgccgtgagccccaagcccatgcccgagctgccccccatgggcgacaacaccaagagccagctggccatgagcgccaacttcctgggcagcgtgctgaccctgctgcagaagcagcacgccctggacctggacatcaccaacggcatgttcgaggagctgccccccctgaccaccgccaccctgggcgccctgatccccaaggtgttccagcagtaccccgagagctgccccctgatcatcagaatccaggtgctgaacccccccagcgtgatgctgcagaaggacaaggccctggtgaaggtgctggccaccgccgaggtgatggtgagccagcccaaggacctggagaccaccatctgcctgatcgacgtggacaccgagttcctggccagcttcagcaccgagggcgacaagctgatgatcgacgccaagctggagaagaccagcctgaacctgagaaccagcaacgtgggcaacttcgacatcggcctgatggaggtgctggtggagaagatcttcgacctggccttcatgcccgccatgaacgccgtgctgggcagcggcgtgcccctgcccaagatcctgaacatcgacttcagcaacgccgacatcgacgtgctggaggacctgctggtgctgagcgcctag

SEQ ID NO: 4148 - DNA, 1431 bp, Artificial Sequence
  Description of Artificial Sequence: Synthetic coding sequence
atgcagcccgtgatgctggccctgtggagcctgctgctgctgtggggcctggccaccccctgccaggagctgctggagaccgtgggcaccctggccagaatcgacaaggacgagctgggcaaggccatccagaacagcctggtgggcgagcccatcctgcagaacgtgctgggcagcgtgaccgccgtgaacagaggcctgctgggcagcggcggcctgctgggcggcggcggcctgctgggccacggcggcgtgttcggcgtggtggaggagctgagcggcctgaagatcgaggagctgaccctgcccaaggtgctgctgaagctgctgcccggcttcggcgtgcagctgagcctgcacaccaaggtgggcatgcactgcagcggccccctgggcggcctgctgcagctggccgccgaggtgaacgtgaccagcagagtggccctggccgtgagcagcagaggcacccccatcctgatcctgaagagatgcagcaccctgctgggccacatcagcctgttcagcggcctgctgcccacccccctgttcggcgtggtggagcagatgctgttcaaggtgctgcccggcctgctgtgccccgtggtggacagcgtgctgggcgtggtgaacgagctgctgggcgccgtgctgggcctggtgagcctgggcgccctgggcagcgtggagttcagcctggccaccctgcccctgatcagcaaccagtacatcgagctggacatcaaccccatcgtgaagagcgtggccggcgacatcatcgacttccccaagagcagagcccccgccaaggtgccccccaagaaggaccacaccagccaggtgatggtgcccctgtacctgttcaacaccaccttcggcctgctgcagaccaacggcgccctggacatggacatcacccccgagctggtgcccagcgacgtgcccctgaccaccaccgacctggccgccctgctgcccgaggccctgggcaagctgcccctgcaccagcagctgctgctgttcctgagagtgagagaggcccccaccgtgaccctgcacaacaagaaggccctggtgagcctgcccgccaacatccacgtgctgttctacgtgcccaagggcacccccgagagcctgttcgagctgaacagcgtgatgaccgtgagagcccagctggcccccagcgccaccaagctgcacatcagcctgagcctggagagactgagcgtgaaggtggccagcagcttcacccacgccttcgacggcagcagactggaggagtggctgagccacgtggtgggcgccgtgtacgcccccaagctgaacgtggccctggacgtgggcatccccctgcccaaggtgctgaacatcaacttcagcaacagcgtgctggagatcgtggagaacgccgtggtgctgaccgtggccagctag

SEQ ID NO: 4149 - DNA, 585 bp, Artificial Sequence
  Description of Artificial Sequence: Synthetic coding sequence
atgcaggacgcccccctgagctgcctgagccccaccaagtggagcagcgtgagcagcgccgacagcaccgagaagagcgccagcggcgccggcaccagaaacctgcccttccagttctgcctgagacaggccctgagaatgaaggccgccggcatcctgaccctgatcggctgcctggtgaccggcgccgagagcaagatctacaccagatgcaagctggccaagatcttcagcagagccggcctggacaactactggggcttcagcctgggcaactggatctgcatggcctactacgagagcggctacaacaccaccgcccagaccgtgctggacgacggcagcatcgactacggcatcttccagatcaacagcttcgcctggtgcagaagaggcaagctgaaggagaacaaccactgccacgtggcctgcagcgccctgatcaccgacgacctgaccgacgccatcatctgcgccagaaagatcgtgaaggagacccagggcatgaactactggcagggctggaagaagcactgcgagggcagagacctgagcgagtggaagaagggctgcgaggtgagctag

SEQ ID NO: 4150 - DNA, 1266 bp, Artificial Sequence
  Description of Artificial Sequence: Synthetic coding sequence
atgggcttcctgagccccatctacgtgatcttcttcttcttcggcgtgaaggtgcactgccagtacgagacctaccagtgggacgaggactacgaccaggagcccgacgacgactaccagaccggcttccccttcagacagaacgtggactacggcgtgcccttccaccagtacaccctgggctgcgtgagcgagtgcttctgccccaccaacttccccagcagcatgtactgcgacaacagaaagctgaagaccatccccaacatccccatgcacatccagcagctgtacctgcagttcaacgagatcgaggccgtgaccgccaacagcttcatcaacgccacccacctgaaggagatcaacctgagccacaacaagatcaagagccagaagatcgactacggcgtgttcgccaagctgcccaacctgctgcagctgcacctggagcacaacaacctggaggagttccccttccccctgcccaagagcctggagagactgctgctgggctacaacgagatcagcaagctgcagaccaacgccatggacggcctggtgaacctgaccatgctggacctgtgctacaactacctgcacgacagcctgctgaaggacaagatcttcgccaagatggagaagctgatgcagctgaacctgtgcagcaacagactggagagcatgccccccggcctgcccagcagcctgatgtacctgagcctggagaacaacagcatcagcagcatccccgagaagtacttcgacaagctgcccaagctgcacaccctgagaatgagccacaacaagctgcaggacatcccctacaacatcttcaacctgcccaacatcgtggagctgagcgtgggccacaacaagctgaagcaggccttctacatccccagaaacctggagcacctgtacctgcagaacaacgagatcgagaagatgaacctgaccgtgatgtgccccagcatcgaccccctgcactaccaccacctgacctacatcagagtggaccagaacaagctgaaggagcccatcagcagctacatcttcttctgcttcccccacatccacaccatctactacggcgagcagagaagcaccaacggccagaccatccagctgaagacccaggtgttcagaagattccccgacgacgacgacgagagcgaggaccacgacgaccccgacaacgcccacgagagccccgagcaggagggcgccgagggccacttcgacctgcactactacgagaaccaggagtag

SEQ ID NO: 4151 - DNA, 252 bp, Artificial Sequence
  Description of Artificial Sequence: Synthetic coding sequence
atgctgtgctgctgccccctggccgacgccctgctgatcttcctggagaccggcagctgcttccagcccggccagcagagcgagaccctgagccagaagcagaacaagaccaacaacaagaagtgggccggcggcgccggctgcagacccttcagactgtggtgggtgggcagaagcagaggcgccggcgtgcagctgtacagcaccaagaagggctggatcctgagaggcaagggcggcaccgaggcctag

SEQ ID NO: 4152 - DNA, 2559 bp, Artificial Sequence
  Description of Artificial Sequence: Synthetic coding sequence
atgctgcccaccgaggtgccccagagccaccccggccccagcgccctgctgctgctgcagctgctgctgccccccaccagcgccttcttccccaacatctggagcctgctggccgcccccggcagcatcacccaccaggacctgaccgaggaggccgccctgaacgtgaccctgcagctgttcctggagcagcccccccccggcagaccccccctgagactggaggacttcctgggcagaaccctgctggccgacgacctgttcgccgcctacttcggccccggcagcagcagaagattcagagccgccctgggcgaggtgagcagagccaacgccgcccaggacttcctgcccaccagcagaaacgaccccgacctgcacttcgacgccgagagactgggccagggcagagccagactggtgggcgccctgagagagaccgtggtggccgccagagccctggaccacaccctggccagacagagactgggcgccgccctgcacgccctgcaggacttctacagccacagcaactgggtggagctgggcgagcagcagccccacccccacctgctgtggcccagacaggagctgcagaacctggcccaggtggccgaccccacctgcagcgactgcgaggagctgagctgccccagaaactggctgggcttcaccctgctgaccagcggctacttcggcacccacccccccaagccccccggcaagtgcagccacggcggccacttcgacagaagcagcagccagccccccagaggcggcatcaacaaggacagcaccagccccggcttcagcccccaccacatgctgcacctgcaggccgccaagctggccctgctggccagcatccaggccttcagcctgctgagaagcagactgggcgacagagacttcagcagactgctggacatcacccccgccagcagcctgagcttcgtgctggacaccaccggcagcatgggcgaggagatcaacgccgccaagatccaggccagacacctggtggagcagagaagaggcagccccatggagcccgtgcactacgtgctggtgcccttccacgaccccggcttcggccccgtgttcaccaccagcgaccccgacagcttctggcagcagctgaacgagatccacgccctgggcggcggcgacgagcccgagatgtgcctgagcgccctgcagctggccctgctgcacaccccccccctgagcgacatcttcgtgttcaccgacgccagccccaaggacgccttcctgaccaaccaggtggagagcctgacccaggagagaagatgcagagtgaccttcctggtgaccgaggacaccagcagagtgcagggcagagccagaagagagatcctgagccccctgagattcgagccctacaaggccgtggccctggccagcggcggcgaggtgatcttcaccaaggaccagcacatcagagacgtggccgccatcgtgggcgagagcatggccgccctggtgaccctgcccctggacccccccgtggtggtgcccggccagcccctggtgttcagcgtggacggcctgctgcagaagatcaccgtgagaatccacggcgacatcagcagcttctggatcaagaaccccgccggcgtgagccagggccaggaggagggcggcggccccctgggccacaccagaagattcggccagttctggatggtgaccatggacgaccccccccagaccggcacctgggagatccaggtgaccgccgaggacacccccggcgtgagagtgcaggcccagaccagcctggacttcctgttccacttcggcatccccatggaggacggcccccaccccggcctgtaccccctgacccagcccgtggccggcctgcagacccagctgctggtggaggtgaccggcctgggcagcagagccaaccccggcgacccccagccccacttcagccacgtgatcctgagaggcgtgcccgagggcgccgagctgggccaggtgcccctggagcccgtgggcccccccgagagaggcctgctggccgccagcctgagccccaccctgctgagcacccccagacccttcagcctggagctgatcggccaggacgccgccggcagaagactgcacagagccgccccccagcccagcaccgtggtgcccgtgctgctggagctgagcggccccagcggcttcctggcccccggcagcaaggtgcccctgagcctgagaatcgccagcttcagcggcccccaggacctggacctgagaaccttcgtgaaccccagcttcagcctgaccagcaacctgagcagagcccacctggagctgaacgagagcgcctggggcagactgtggctggaggtgcccgacagcgccgcccccgacagcgtggtgatggtgaccgtgaccgccggcggcagagaggccaaccccgtgccccccacccacgccttcctgagactgctggtgagcgcccccgccccccaggtgagaaaccactacttccccagccagggccccgcccaccacccctacagactgatctag

SEQ ID NO: 4153 - DNA, 2676 bp, Artificial Sequence
  Description of Artificial Sequence: Synthetic coding sequence
atgctgcccaccgaggtgccccagagccaccccggccccagcgccctgctgctgctgcagctgctgctgccccccaccagcgccttcttccccaacatctggagcctgctggccgcccccggcagcatcacccaccaggacctgaccgaggaggccgccctgaacgtgaccctgcagctgttcctggagcagcccccccccggcagaccccccctgagactggaggacttcctgggcagaaccctgctggccgacgacctgttcgccgcctacttcggccccggcagcagcagaagattcagagccgccctgggcgaggtgagcagagccaacgccgcccaggacttcctgcccaccagcagaaacgaccccgacctgcacttcgacgccgagagactgggccagggcagagccagactggtgggcgccctgagagagaccgtggtggccgccagagccctggaccacaccctggccagacagagactgggcgccgccctgcacgccctgcaggacttctacagccacagcaactgggtggagctgggcgagcagcagccccacccccacctgctgtggcccagacaggagctgcagaacctggcccaggtggccgaccccacctgcagcgactgcgaggagctgagctgccccagaaactggctgggcttcaccctgctgaccagcggctacttcggcacccacccccccaagccccccggcaagtgcagccacggcggccacttcgacagaagcagcagccagccccccagaggcggcatcaacaaggacagcaccagccccggcttcagcccccaccacatgctgcacctgcaggccgccaagctggccctgctggccagcatccaggccttcagcctgctgagaagcagactgggcgacagagacttcagcagactgctggacatcacccccgccagcagcctgagcttcgtgctggacaccaccggcagcatgggcgaggagatcaacgccgccaagatccaggccagacacctggtggagcagagaagaggcagccccatggagcccgtgcactacgtgctggtgcccttccacgaccccggcttcggccccgtgttcaccaccagcgaccccgacagcttctggcagcagctgaacgagatccacgccctgggcggcggcgacgagcccgagatgtgcctgagcgccctgcagctggccctgctgcacaccccccccctgagcgacatcttcgtgttcaccgacgccagccccaaggacgccttcctgaccaaccaggtggagagcctgacccaggagagaagatgcagagtgaccttcctggtgaccgaggacaccagcagagtgcagggcagagccagaagagagatcctgagccccctgagattcgagccctacaaggccgtggccctggccagcggcggcgaggtgatcttcaccaaggaccagcacatcagagacgtggccgccatcgtgggcgagagcatggccgccctggtgaccctgcccctggacccccccgtggtggtgcccggccagcccctggtgttcagcgtggacggcctgctgcagaagatcaccgtgagaatccacggcgacatcagcagcttctggatcaagaaccccgccggcgtgagccagggccaggaggagggcggcggccccctgggccacaccagaagattcggccagttctggatggtgaccatggacgaccccccccagaccggcacctgggagatccaggtgaccgccgaggacacccccggcgtgagagtgcaggcccagaccagcctggacttcctgttccacttcggcatccccatggaggacggcccccaccccggcctgtaccccctgacccagcccgtggccggcctgcagacccagctgctggtggaggtgaccggcctgggcagcagagccaaccccggcgacccccagccccacttcagccacgtgatcctgagaggcgtgcccgagggcgccgagctgggccaggtgcccctggagcccgtgggcccccccgagagaggcctgctggccgccagcctgagccccaccctgctgagcacccccagacccttcagcctggagctgatcggccaggacgccgccggcagaagactgcacagagccgccccccagcccagcaccgtggtgcccgtgctgctggagctgagcggccccagcggcttcctggcccccggcagcaaggtgcccctgagcctgagaatcgccagcttcagcggcccccaggacctggacctgagaaccttcgtgaaccccagcttcagcctgaccagcaacctgagcagagcccacctggagctgaacgagagcgcctggggcagactgtggctggaggtgcccgacagcgccgcccccgacagcgtggtgatggtgaccgtgaccgccggcggcagagaggccaaccccgtgccccccacccacgccttcctgagactgctggtgagcgcccccgccccccaggacagacacaccacccccaccggcagcagcgaccccatcctgaccaccgccacccccgccttcagccccttcaccctggtgacccagggcagagccggcgccggcctggccgccggcagcccctggtggggcaccgtgggcggcgtgctgctgctgctgggcctggccagctggtag

SEQ ID NO: 4154 - DNA, 552 bp, Artificial Sequence
  Description of Artificial Sequence: Synthetic coding sequence
atggtgagaatctggaccaccatcatgatcgtgctgatcctgctgctgagaatcggccccaacaagcccagcctgagcggcagacaggcccccgcccaggcccagaccagcgacctggtgcccagcctgttccccctgggcctgtgggcccccggcttctgcacctggagcagccccgacgaggacaagagacccagaaagcccgtgcccggcaccggcaacagagacagcggcaccagaagaagactgcaggacgccaccgagcaggaccccagacccggcaacgacgtggccagcgccgagaccgccggcccccccagccccagcggcatcagagcccaggacagagcccccagacacagaagagccccccccgccagaatgcccgtggcccccgcccccagcgccgacggcgagcccctgcaggagcagggcggcggcctgttccacagaaccagaagcgtgtacaacggcctggagctgaacacctggatgaaggtggagagactgttcgtggagaagttccaccagagcttcagcctggacaactag

SEQ ID NO: 4155 - DNA, 444 bp, Artificial Sequence
  Description of Artificial Sequence: Synthetic coding sequence
atggccggccccgccggcagccagagcctgggccccctgtgcttccacagcagcccccaggccctgtacaccgtgctgctgatcgtgctggtgatgatgagcctggtgttcggcaagttcgtgcccgtgaactgggagcccccccagcccctgcccttccccaagtacctgagatgctacagatgcctgctggagaccaaggagctgggctgcctgctgggcagcgacatctgcctgacccccgccggcagcagctgcatcaccctgcacaagaagaacagcagcggcagcgacgtgatggtgagcgactgcagaagcaaggagcagatgagcgactgcagcaacaccagaaccagccccgtgagcggcttctggatcttcagccagtactgcttcctggacttctgcaacgacccccagaacagaggcctgtacaccccctag

SEQ ID NO: 4156 - DNA, 447 bp, Artificial Sequence
  Description of Artificial Sequence: Synthetic coding sequence
atgcagaccttccccgtggccggcgccctggaccccgccatcctggacaccagcagcccccaggccctgtacaccgtgctgctgatcgtgctggtgatgatgagcctggtgttcggcaagttcgtgcccgtgaactgggagcccccccagcccctgcccttccccaagtacctgagatgctacagatgcctgctggagaccaaggagctgggctgcctgctgggcagcgacatctgcctgacccccgccggcagcagctgcatcaccctgcacaagaagaacagcagcggcagcgacgtgatggtgagcgactgcagaagcaaggagcagatgagcgactgcagcaacaccagaaccagccccgtgagcggcttctggatcttcagccagtactgcttcctggacttctgcaacgacccccagaacagaggcctgtacaccccctag

SEQ ID NO: 4157 - DNA, 606 bp, Artificial Sequence
  Description of Artificial Sequence: Synthetic coding sequence
atgaaggtgcacatgctggtgggcgtgctggtgatggtgggcttcaccgtgggcaaggtgcccgtgcccgacatcagaacctgccacttctgcctggtggaggaccccagcgtgggctgcatcagcggcagcgagaagtgcaccatcagcagcagcagcctgtgcatggtgatcaccatctactacgacgtgaaggtgagattcatcgtgagaggctgcggccagtacatcagctacagatgccaggagaagagaaacacctacttcgccgagtactggtaccaggcccagtgctgccagtacgactactgcaacagctggagcagcccccagctgcagagcagcctgcccgagccccacgacagacccctggccctgcccctgagcgacagccagatccagtggttctaccaggccctgaacctgagcctgcccctgcccaacttccacgccggcaccgagcccgacggcctggaccccatggtgaccctgagcctgaacctgggcctgagcttcgccgagctgagaagaatgtacctgttcctgaacagcagcggcctgctggtgctgccccaggccggcctgctgaccccccaccccagctag

SEQ ID NO: 4158 - DNA, 345 bp, Artificial Sequence
  Description of Artificial Sequence: Synthetic coding sequence
atgctgggcggcgaggaggccagacccaacagctggccctggcaggtgagcctgcagtacagcagcaacggccagtggtaccacacctgcggcggcagcctgatcgccaacagctgggtgctgaccgccgcccactgcatcagacagatcatcaaggcccacaaggtgctgcagagatgcagcctgatcctgttcttcgtgagagacctgtgcagcagccagctggagctgaccggcgtgagcgccggcagcagcggcatctacagagtgatgctgggccagcacaacctgtacgtggccgagagcggcagcctggccgtgagcgtgagcaagatcgtggtgtag

SEQ ID NO: 4159 - DNA, 810 bp, Artificial Sequence
  Description of Artificial Sequence: Synthetic coding sequence
atgatcagaaccctgctgctgagcaccctggtggccggcgccctgagctgcggcgtgagcacctacgcccccgacatgagcagaatgctgggcggcgaggaggccagacccaacagctggccctggcaggtgagcctgcagtacagcagcaacggccagtggtaccacacctgcggcggcagcctgatcgccaacagctgggtgctgaccgccgcccactgcatcagcagcagcggcatctacagagtgatgctgggccagcacaacctgtacgtggccgagagcggcagcctggccgtgagcgtgagcaagatcgtggtgcacaaggactggaacagcgaccaggtgagcaagggcaacgacatcgccctgctgaagctggccaaccccgtgagcctgaccgacaagatccagctggcctgcctgccccccgccggcaccatcctgcccaacaactacccctgctacgtgaccggctggggcagactgcagaccaacggcgccctgcccgacgacctgaagcagggccagctgctggtggtggactacgccacctgcagcagcagcggctggtggggcagcaccgtgaagaccaacatgatctgcgccggcggcgacggcgtgatctgcacctgcaacggcgacagcggcggccccctgaactgccaggccagcgacggcagatgggaggtgcacggcatcggcagcctgaccagcgtgctgggctgcaactactactacaagcccagcatcttcaccagagtgagcaactacaacgactggatcaacagcgtgatcgccaacaactag

SEQ ID NO: 4160 - DNA, 567 bp, Artificial Sequence
  Description of Artificial Sequence: Synthetic coding sequence
atgttccaccagatctgggccgccctgctgtacttctacggcatcatcctgaacagcatctaccagtgccccgagcacagccagctgaccaccctgggcgtggacggcaaggagttccccgaggtgcacctgggccagtggtacttcatcgccggcgccgcccccaccaaggaggagctggccaccttcgaccccgtggacaacatcgtgttcaacatggccgccggcagcgcccccatgcagctgcacctgagagccaccatcagaatgaaggacggcctgtgcgtgcccagaaagtggatctaccacctgaccgagggcagcaccgacctgagaaccgagggcagacccgacatgaagaccgagctgttcagcagcagctgccccggcggcatcatgctgaacgagaccggccagggctaccagagattcctgctgtacaacagaagcccccacccccccgagaagtgcgtggaggagttcaagagcctgaccagctgcctggacagcaaggccttcctgctgacccccagaaaccaggaggcctgcgagctgagcaacaactag

SEQ ID NO: 4161 - DNA, 390 bp, Artificial Sequence
  Description of Artificial Sequence: Synthetic coding sequence
atggccgccggcagcgcccccatgcagctgcacctgagagccaccatcagaatgaaggacggcctgtgcgtgcccagaaagtggatctaccacctgaccgagggcagcaccgacctgagaaccgagggcagacccgacatgaagaccgagctgttcagcagcagctgccccggcggcatcatgctgaacgagaccggccagggctaccagagattcctgctgtacaacagaagcccccacccccccgagaagtgcgtggaggagttcaagagcctgaccagctgcctggacagcaaggccttcctgctgacccccagaaaccagggcaagggcctgaagagccacaagaccggcctgggcctgaccaagagcagcggcgtgaccggctag

SEQ ID NO: 4162 - DNA, 351 bp, Artificial Sequence
  Description of Artificial Sequence: Synthetic coding sequence
atggccgccggcagcgcccccatgcagctgcacctgagagccaccatcagaatgaaggacggcctgtgcgtgcccagaaagtggatctaccacctgaccgagggcagcaccgacctgagaaccgagggcagacccgacatgaagaccgagctgttcagcagcagctgccccggcggcatcatgctgaacgagaccggccagggctaccagagattcctgctgtacaacagaagcccccacccccccgagaagtgcgtggaggagttcaagagcctgaccagctgcctggacagcaaggccttcctgctgacccccagaaaccaggaggcctgcgagctgagcaacaactag

SEQ ID NO: 4163 - DNA, 435 bp, Artificial Sequence
  Description of Artificial Sequence: Synthetic coding sequence
atgatcagaaccctgctgctgagcaccctggtggccggcgccctgagctgcggcgaccccacctaccccccctacgtgaccagagtggtgggcggcgaggaggccagacccaacagctggccctggcaggtgagcctgcagtacagcagcaacggcaagtggtaccacacctgcggcggcagcctgatcgccaacagctgggtgctgaccgccgcccactgcatcagccagagcatggtgcagtgcgcccacaaggtgctgcagagatgcagcctgatcctgttcttcgtgagagacctgtgcagcagccagctggagctgaccggcgtgagcgccggcagcagcagaacctacagagtgggcctgggcagacacaacctgtacgtggccgagagcggcagcctggccgtgagcgtgagcaagatcgtggtgtag

SEQ ID NO: 4164 - DNA, 204 bp, Artificial Sequence
  Description of Artificial Sequence: Synthetic coding sequence
atgaagctgctgctgctgaccctgaccgtgctgctgctgctgagccagctgacccccggcggcacccagagatgctggaacctgtacggcaagtgcagatacagatgcagcaagaaggagagagtgtacgtgtactgcatcaacaacaagatgtgctgcgtgaagcccaagtaccagcccaaggagagatggtggcccttctag

SEQ ID NO: 4165 - DNA, 231 bp, Artificial Sequence
  Description of Artificial Sequence: Synthetic coding sequence
atgaagctgctgctgctgctgctgaccgtgaccctgctgctggcccaggtgacccccgtgatgaagtgctggggcaagagcggcagatgcagaaccacctgcaaggagagcgaggtgtactacatcctgtgcaagaccgaggccaagtgctgcgtggaccccaagtacgtgcccgtgaagcccaagctgaccgacaccaacaccagcctggagagcaccagcgccgtgtag

SEQ ID NO: 4166 - DNA, 267 bp, Artificial Sequence
  Description of Artificial Sequence: Synthetic coding sequence
atgaagctgctgtacctgttcctggccatcctgctggccatcgaggagcccgtgatcagcgtggagtgctggatggacggccactgcagactgctgtgcaaggacggcgaggacagcatcatcagatgcagaaacagaaagagatgctgcgtgcccagcagatacctgaccatccagcccgtgaccatccacggcatcctgggctggaccaccccccagatgagcaccaccgcccccaagatgaagaccaacatcaccaacagatag

SEQ ID NO: 4167 - DNA, 255 bp, Artificial Sequence
  Description of Artificial Sequence: Synthetic coding sequence
atgaagctgctgtacctgttcctggccatcctgctggccatcgaggagcccgtgatcagcggcaagagacacatcctgagatgcatgggcaacagcggcatctgcagagccagctgcaagaagaacgagcagccctacctgtactgcagaaactgccagagctgctgcctgcagagctacatgagaatcagcatcagcggcaaggaggagaacaccgactggagctacgagaagcagtggcccagactgccctag

SEQ ID NO: 4168 - DNA, 2631 bp, Artificial Sequence; identical to SEQ ID NO: 3583
  Description of Artificial Sequence: Synthetic coding sequence

SEQ ID NO: 4169 - DNA, 2742 bp, Artificial Sequence; identical to SEQ ID NO: 3799
  Description of Artificial Sequence: Synthetic coding sequence

SEQ ID NO: 4170 - DNA, 2631 bp, Artificial Sequence; identical to SEQ ID NO: 3583
  Description of Artificial Sequence: Synthetic coding sequence

SEQ ID NO: 4171 - DNA, 2631 bp, Artificial Sequence; identical to SEQ ID NO: 3583
  Description of Artificial Sequence: Synthetic coding sequence

SEQ ID NO: 4172 - DNA, 2760 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctacgtggagatggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggccgagagaagagtgctggaggaggagctgaccgtgcacctgagcgtgcccggcgacaccatcctgatcaacaacagacccggccccagagagccccccccctaccaggagcccagacccagaggcaaccccccccacagcgccccctgcgtgcccaacggcagcgccctgctgctgagcaaccccgcctacagactgctgctggccacctacgccagaccccccagaggccccggcccccccacccccgcctgggccaagcccaccaacacccaggcctacagcggcgactacatggagcccgagaagcccggcgcccccctgctgcccccccccccccagaacagcgtgccccactacgccgaggccgacatcgtgaccctgcagggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagcttcagcctgttcagcagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaacttcgtgcacagagacctggccaccagaaactgcctggtgggcgagaacttcaccatcaagatcgccgacttcggcatgagcagaaacctgtacgccggcgactactacagagtgcagggcagagccgtgctgcccatcagatggatggcctgggagtgcatcctgatgggcaagttcaccaccgccagcgacgtgtgggccttcggcgtgaccctgtgggaggtgctgatgctgtgcagagcccagcccttcggccagctgaccgacgagcaggtgatcgagaacgccggcgagttcttcagagaccagggcagacaggtgtacctgagcagaccccccgcctgcccccagggcctgtacgagctgatgctgagatgctggagcagagagagcgagcagagaccccccttcagccagctgcacagattcctggccgaggacgccctgaacaccgtgtag

SEQ ID NO: 4173 - DNA, 1041 bp, Artificial Sequence
  Description of Artificial Sequence: Synthetic coding sequence
atgctgaagaagcccctgagcgccgtgacctggctgtgcatcttcatcgtggccttcgtgagccaccccgcctggctgcagaagctgagcaagcacaagacccccgcccagccccagctgaaggccgccaactgctgcgaggaggtgaaggagctgaaggcccaggtggccaacctgagcagcctgctgagcgagctgaacaagaagcaggagagagactgggtgagcgtggtgatgcaggtgatggagctggagagcaacagcaagagaatggagagcagactgaccgacgccgagagcaagtacagcgagatgaacaaccagatcgacatcatgcagctgcaggccgcccagaccgtgacccagaccagcgccgacgccatctacgactgcagcagcctgtaccagaagaactacagaatcagcggcgtgtacaagctgccccccgacgacttcctgggcagccccgagctggaggtgttctgcgacatggagaccagcggcggcggctggaccatcatccagagaagaaagagcggcctggtgagcttctacagagactggaagcagtacaagcagggcttcggcagcatcagaggcgacttctggctgggcaacgagcacatccacagactgagcagacagcccaccagactgagagtggagatggaggactgggagggcaacctgagatacgccgagtacagccacttcgtgctgggcaacgagctgaacagctacagactgttcctgggcaactacaccggcaacgtgggcaacgacgccctgcagtaccacaacaacaccgccttcagcaccaaggacaaggacaacgacaactgcctggacaagtgcgcccagctgagaaagggcggctactggtacaactgctgcaccgacagcaacctgaacggcgtgtactacagactgggcgagcacaacaagcacctggacggcatcacctggtacggctggcacggcagcacctacagcctgaagagagtggagatgaagatcagacccgaggacttcaagccctag

SEQ ID NO: 4174 - DNA, 1056 bp, Artificial Sequence
  Description of Artificial Sequence: Synthetic coding sequence
atgaagggcagagccgtgagcttcgaccccctggcctgccagggcctgaacgccagccccggcagcctgaccagccccctgagaagaatcagaagcctgaccggcagagaggtgctgacccccttccccggcctgggcaccgccgccgcccccgcccagggcggcgcccacctgaagccccacagcctggtgctgcccatcaccgccctgccccccccccccctggccctgagaggcagacaggccaccagcaagctgccccccttcctgagcagccccttcccccccagcctgtgcccctgggtgcccgaccccggcttcaaggagaccgccttcctgtacgccgtgagcagcgccgccctgacccacaccctggccagagcctgcagcgccggcagaatggagagatgcacctgcgacgacagccccggcctggagagcagacaggcctggcagtggggcgtgtgcggcgacaacctgaagtacagcaccaagttcctgagcaacttcctgggcagcaagagaggcaacaaggacctgagagccagagccgacgcccacaacacccacgtgggcatcaaggccgtgaagagcggcctgagaaccacctgcaagtgccacggcgtgagcggcagctgcgccgtgagaacctgctggaagcagctgagccccttcagagagaccggccaggtgctgaagctgagatacgacagcgccgtgaaggtgagcagcgccaccaacgaggccctgggcagactggagctgtgggcccccgccagacagggcagcctgaccaagggcctggcccccagaagcggcgacctggtgtacatggaggacagccccagcttctgcagacccagcaagtacagccccggcaccgccggcagagtgtgcagcagagaggccagctgcagcagcctgtgctgcggcagaggctacgacacccagagcagactggtggccttcagctgccactgccaggtgcagtggtgctgctacgtggagtgccagcagtgcgtgcaggaggagctggtgtacacctgcaagcactag

SEQ ID NO: 4175 - DNA, 462 bp, Artificial Sequence
  Description of Artificial Sequence: Synthetic coding sequence
atgaagcacctgagaccccagttccccctgatcctggccatctactgcttctgcatgctgcagatccccagcagcggcttcccccagcccctggccgaccccagcgacggcctggacatcgtgcagctggagcagctggcctactgcctgagccagtgggcccccctgagcagacagcccaaggacaaccaggacatctacaagagattcctgttccactacagcagaacccaggaggccacccaccccgtgaagaccggcttcccccccgtgcaccccctgatgcacctggccgccaagctggccaacagaagaatgaagagaatcctgcagagaggcagcggcaccgccgccgtggacttcaccaagaaggaccacaccgccacctggggcagacccttcttcctgttcagacccagaaacggcagaaacatcgaggacgaggcccagatccagtggtag

SEQ ID NO: 4176 - DNA, 765 bp, Artificial Sequence
  Description of Artificial Sequence: Synthetic coding sequence
atggccgccgccagcgccggcgccaccagactgctgctgctgctgctgatggccgtggccgcccccagcagagccagaggcagcggctgcagagccggcaccggcgccagaggcgccggcgccgagggcagagagggcgaggcctgcggcaccgtgggcctgctgctggagcacagcttcgagatcgacgacagcgccaacttcagaaagagaggcagcctgctgtggaaccagcaggacggcaccctgagcctgagccagagacagctgagcgaggaggagagaggcagactgagagacgtggccgccctgaacggcctgtacagagtgagaatccccagaagacccggcgccctggacggcctggaggccggcggctacgtgagcagcttcgtgcccgcctgcagcctggtggagagccacctgagcgaccagctgaccctgcacgtggacgtggccggcaacgtggtgggcgtgagcgtggtgacccaccccggcggctgcagaggccacgaggtggaggacgtggacctggagctgttcaacaccagcgtgcagctgcagccccccaccaccgcccccggccccgagaccgccgccttcatcgagagactggagatggagcaggcccagaaggccaagaacccccaggagcagaagagcttcttcgccaagtactggcacatcatcctgggcggcgccgtgctgctgaccgccctgagacccgccgcccccggccccgccccccccccccaggaggcctag

SEQ ID NO: 4177 - DNA, 810 bp, Artificial Sequence
  Description of Artificial Sequence: Synthetic coding sequence
atggccgccgccagcgccggcgccaccagactgctgctgctgctgctgatggccgtggccgcccccagcagagccagaggcagcggctgcagagccggcaccggcgccagaggcgccggcgccgagggcagagagggcgaggcctgcggcaccgtgggcctgctgctggagcacagcttcgagatcgacgacagcgccaacttcagaaagagaggcagcctgctgtggaaccagcaggacggcaccctgagcctgagccagagacagctgagcgaggaggagagaggcagactgagagacgtggccgccctgaacggcctgtacagagtgagaatccccagaagacccggcgccctggacggcctggaggccggcggctacgtgagcagcttcgtgcccgcctgcagcctggtggagagccacctgagcgaccagctgaccctgcacgtggacgtggccggcaacgtggtgggcgtgagcgtggtgacccaccccggcggctgcagaggccacgaggtggaggacgtggacctggagctgttcaacaccagcgtgcagctgcagccccccaccaccgcccccggccccgagaccgccgccttcatcgagagactggagatggagcaggcccagaaggccaagaacccccaggagcagaagagcttcttcgccaagtactggatgtacatcatccccgtggtgctgttcctgatgatgagcggcgcccccgacaccggcggccagggcggcggcggcggcggcggcggcggcggcggcagcggcagatgctgcgtgccccccagcctgtag

SEQ ID NO: 4178 - DNA, 480 bp, Artificial Sequence
  Description of Artificial Sequence: Synthetic coding sequence
atgagcagcccccagagaagaaaggccatgccctgggccctgagcctgctgctgatgggcttccagctgctggtgacctacgcctggtgcagcgaggaggagatgggcggcaacaacaagatcgtgcaggaccccatgttcctggccaccgtggagttcgccctgaacaccttcaacgtgcagagcaaggaggagcacgcctacagactgctgagagtgctgagcagctggagagaggacagcatggacagaaagtggagaggcaagatggtgttcagcatgaacctgcagctgagacagaccgtgtgcagaaagttcgaggacgacatcgacaactgccccttccaggagagcctggagctgaacaacgtgagacagggcatcagcttcccccaggtgcacagctgcggctgctgcatgggctgcggcgtgggcaccggcgccgccgacaaggccatccccagagacaagggcaagtag

SEQ ID NO: 4179 - DNA, 1737 bp, Artificial Sequence
  Description of Artificial Sequence: Synthetic coding sequence
atgctgctgctgctgctgctggcccccctgttcctgagaccccccggcgccggcggcgcccagacccccaacgccaccagcgagggctgccagatcatccaccccccctgggagggcggcatcagatacagaggcctgaccagagaccaggtgaaggccatcaacttcctgcccgtggactacgagatcgagtacgtgtgcagaggcgagagagaggtggtgggccccaaggtgagaaagtgcctggccaacggcagctggaccgacatggacacccccagcagatgcgtgagaatctgcagcaagagctacctgaccctggagaacggcaaggtgttcctgaccggcggcgacctgcccgccctggacggcgccagagtggacttcagatgcgaccccgacttccacctggtgggcagcagcagaagcatctgcagccagggccagtggagcacccccaagccccactgccaggtgaacagaaccccccacagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcgtgatcagcagaacccacagccccacctag

SEQ ID NO: 4180 - DNA, 444 bp, Artificial Sequence
  Description of Artificial Sequence: Synthetic coding sequence
atgctgggcctgccctggaagggcggcctgagctgggccctgctgctgctgctgctgggcagccagatcctgctgatctacgcctggcacttccacgagcagagagactgcgacgagcacaacgtgatggccagatacctgcccgccaccgtggagttcgccgtgcacaccttcaaccagcagagcaaggactactacgcctacagactgggccacatcctgaacagctggaaggagcaggtggagagcaagaccgtgttcagcatggagctgctgctgggcagaaccagatgcggcaagttcgaggacgacatcgacaactgccacttccaggagagcaccgagctgaacaacaccttcacctgcttcttcaccatcagcaccagaccctggatgacccagttcagcctgctgaacaagacctgcctggagggcttccactag

SEQ ID NO: 4181 - DNA, 444 bp, Artificial Sequence
  Description of Artificial Sequence: Synthetic coding sequence
atgtggagcctgccccccagcagagccctgagctgcgcccccctgctgctgctgttcagcttccagttcctggtgacctacgcctggagattccaggaggaggaggagtggaacgaccagaagcagatcgccgtgtacctgccccccaccctggagttcgccgtgtacaccttcaacaagcagagcaaggactggtacgcctacaagctggtgcccgtgctggccagctggaaggagcagggctacgacaagatgaccttcagcatgaacctgcagctgggcagaaccatgtgcggcaagttcgaggacgacatcgacaactgccccttccaggagagccccgagctgaacaacacctgcacctgcttcttcaccatcggcatcgagccctggagaaccagattcgacctgtggaacaagacctgcagcggcggccacagctag

SEQ ID NO: 4182 - DNA, 2535 bp, Artificial Sequence; identical to SEQ ID NO: 3960
  Description of Artificial Sequence: Synthetic coding sequence

SEQ ID NO: 4183 - DNA, 2700 bp, Artificial Sequence
  Description of Artificial Sequence: Synthetic coding sequence
atgctgctgctgctgctgctggcccccctgttcctgagaccccccggcgccggcggcgcccagacccccaacgccaccagcgagggctgccagatcatccaccccccctgggagggcggcatcagatacagaggcctgaccagagaccaggtgaaggccatcaacttcctgcccgtggactacgagatcgagtacgtgtgcagaggcgagagagaggtggtgggccccaaggtgagaaagtgcctggccaacggcagctggaccgacatggacacccccagcagatgcgtgaacagaaccccccacagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcggcggcagcccccccgccgaccagaccctggtgatcaagaccttcagattcctgagccagaagctgttcatcagcgtgagcgtgctgagcagcctgggcatcgtgctggccgtggtgtgcctgagcttcaacatctacaacagccacgtgagatacatccagaacagccagcccaacctgaacaacctgaccgccgtgggctgcagcctggccctggccgccgtgttccccctgggcctggacggctaccacatcggcagaaaccagttccccttcgtgtgccaggccagactgtggctgctgggcctgggcttcagcctgggctacggcagcatgttcaccaagatctggtgggtgcacaccgtgttcaccaagaaggaggagaagaaggagtggagaaagaccctggagccctggaagctgtacgccaccgtgggcctgctggtgggcatggacgtgctgaccctggccatctggcagatcgtggaccccctgcacagaaccatcgagaccttcgccaaggaggagcccaaggaggacatcgacgtgagcatcctgccccagctggagcactgcagcagcagaaagatgaacacctggctgggcatcttctacggctacaagggcctgctgctgctgctgggcatcttcctggcctacgagaccaagagcgtgagcaccgagaagatcaacgaccacagagccgtgggcatggccatctacaacgtggccgtgctgtgcctgatcaccgcccccgtgaccatgatcctgagcagccagcaggacgccgccttcgccttcgccagcctggccatcgtgttcagcagctacatcaccctggtggtgctgttcgtgcccaagatgagaagactgatcaccagaggcgagtggcagagcgaggcccaggacaccatgaagaccggcagcagcaccaacaacaacgaggaggagaagagcagactgctggagaaggagaacagagagctggagaagatcatcgccgagaaggaggagagagtgagcgagctgagacaccagctgcagagcagacagcagctgagaagcagaagacacccccccaccccccccgagcccagcggcggcctgcccagaggcccccccgagccccccgacagactgagctgcgacggcagcagagtgcacctgctgtacaagtag

SEQ ID NO: 4184 - DNA, 2886 bp, Artificial Sequence
  Description of Artificial Sequence: Synthetic coding sequence
atgctgctgctgctgctgctggcccccctgttcctgagaccccccggcgccggcggcgcccagacccccaacgccaccagcgagggctgccagatcatccaccccccctgggagggcggcatcagatacagaggcctgaccagagaccaggtgaaggccatcaacttcctgcccgtggactacgagatcgagtacgtgtgcagaggcgagagagaggtggtgggccccaaggtgagaaagtgcctggccaacggcagctggaccgacatggacacccccagcagatgcgtgagaatctgcagcaagagctacctgaccctggagaacggcaaggtgttcctgaccggcggcgacctgcccgccctggacggcgccagagtggacttcagatgcgaccccgacttccacctggtgggcagcagcagaagcatctgcagccagggccagtggagcacccccaagccccactgccaggtgaacagaaccccccacagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcggcggcagcccccccgccgaccagaccctggtgatcaagaccttcagattcctgagccagaagctgttcatcagcgtgagcgtgctgagcagcctgggcatcgtgctggccgtggtgtgcctgagcttcaacatctacaacagccacgtgagatacatccagaacagccagcccaacctgaacaacctgaccgccgtgggctgcagcctggccctggccgccgtgttccccctgggcctggacggctaccacatcggcagaaaccagttccccttcgtgtgccaggccagactgtggctgctgggcctgggcttcagcctgggctacggcagcatgttcaccaagatctggtgggtgcacaccgtgttcaccaagaaggaggagaagaaggagtggagaaagaccctggagccctggaagctgtacgccaccgtgggcctgctggtgggcatggacgtgctgaccctggccatctggcagatcgtggaccccctgcacagaaccatcgagaccttcgccaaggaggagcccaaggaggacatcgacgtgagcatcctgccccagctggagcactgcagcagcagaaagatgaacacctggctgggcatcttctacggctacaagggcctgctgctgctgctgggcatcttcctggcctacgagaccaagagcgtgagcaccgagaagatcaacgaccacagagccgtgggcatggccatctacaacgtggccgtgctgtgcctgatcaccgcccccgtgaccatgatcctgagcagccagcaggacgccgccttcgccttcgccagcctggccatcgtgttcagcagctacatcaccctggtggtgctgttcgtgcccaagatgagaagactgatcaccagaggcgagtggcagagcgaggcccaggacaccatgaagaccggcagcagcaccaacaacaacgaggaggagaagagcagactgctggagaaggagaacagagagctggagaagatcatcgccgagaaggaggagagagtgagcgagctgagacaccagctgcagagcagacagcagctgagaagcagaagacacccccccaccccccccgagcccagcggcggcctgcccagaggcccccccgagccccccgacagactgagctgcgacggcagcagagtgcacctgctgtacaagtag

SEQ ID NO: 4185 - DNA, 882 bp, Artificial Sequence
  Description of Artificial Sequence: Synthetic coding sequence
atgaacaacctgagcttcagcgagctgtgctgcctgttctgctgccccccctgccccggcaagatcgccagcaagctggccttcctgccccccgaccccacctacaccctgatgtgcgacgagagcggcagcagatggaccctgcacctgagcgagagagccgactggcagtacagcagcagagagaaggacgccatcgagtgcttcatgaccagaaccagcaagggcaacagaatcgcctgcatgttcgtgagatgcagccccaacgccaagtacaccctgctgttcagccacggcaacgccgtggacctgggccagatgagcagcttctacatcggcctgggcagcagaatcaactgcaacatcttcagctacgactacagcggctacggcgccagcagcggcaagcccaccgagaagaacctgtacgccgacatcgaggccgcctggctggccctgagaaccagatacggcatcagacccgagaacgtgatcatctacggccagagcatcggcaccgtgcccagcgtggacctggccgccagatacgagagcgccgccgtgatcctgcacagccccctgaccagcggcatgagagtggccttccccgacaccaagaagacctactgcttcgacgccttccccaacatcgacaagatcagcaagatcaccagccccgtgctgatcatccacggcaccgaggacgaggtgatcgacttcagccacggcctggccctgttcgagagatgccagagacccgtggagcccctgtgggtggagggcgccggccacaacgacgtggagctgtacggccagtacctggagagactgaagcagttcgtgagccaggagctggtgcagaagcacaaggagggcaagtag

SEQ ID NO: 4186 - DNA, 1155 bp, Artificial Sequence
  Description of Artificial Sequence: Synthetic coding sequence
atgtggtacgtgagcaccagaggcgtggcccccagagtgaacttcgagggcgccctgttcagcggctacgcccccgacggcggcctgttcatgcccgaggagctgccccagctggacagaggcaccctgtgccagtggagcaccctgagctaccccggcctggtgaaggagctgtgcgccctgttcatcggcagcgagctgctgcccaaggacgagctgaacgacctgatcgacagagccttcagcagattcagacacagagaggtggtgcacctgagcagactgagaaacggcctgaacgtgctggagctgtggcacggcgtgacctacgccttcaaggacctgagcctgagctgcaccacccagttcctgcagtacttcctggagaagagagagaagcacgtgaccgtggtggtgggcaccagcggcgacaccggcagcgccgccatcgagagcgtgcagggcgccaagaacatggacatcatcgtgctgctgcccaagggccactgcaccaagatccaggagctgcagatgaccaccgtgctgaagcagaacgtgcacgtgttcggcgtggagggcaacagcgacgagctggacgagcccatcaagaccgtgttcgccgacgtggccttcgtgaagaagcacaacctgatgagcctgaacagcatcaactggagcagagtgctggtgcagatggcccaccacttcttcgcctacttccagtgcacccccagcctggacacccaccccctgcccctggtggaggtggtggtgcccaccggcgccgccggcaacctggccgccggctacatcgcccagaagatcggcctgcccatcagactggtggtggccgtgaacagaaacgacatcatccacagaaccgtgcagcagggcgacttcagcctgagcgaggccgtgaagagcaccctggccagcgccatggacatccaggtgccctacaacatggagagagtgttctggctgctgagcggcagcgacagccaggtgaccagagccctgatggagcagttcgagagaacccagagcgtgaacctgcccaaggagctgcacagcaagcacagccccgtgctgcccagaccctgcctgtgcagccaggtgcccggcagctgccccggctgctggcccgacccctag

SEQ ID NO: 4187 - DNA, 2889 bp, Artificial Sequence
  Description of Artificial Sequence: Synthetic coding sequence
atgctgagaagacccgcccccgccctggcccccgccgccagactgctgctggccggcctgctgtgcggcggcggcgtgtgggccgccagagtgaacaagcacaagccctggctggagcccacctaccacggcatcgtgaccgagaacgacaacaccgtgctgctggacccccccctgatcgccctggacaaggacgcccccctgagattcgccgagagcttcgaggtgaccgtgaccaaggagggcgagatctgcggcttcaagatccacggccagaacgtgcccttcgacgccgtggtggtggacaagagcaccggcgagggcgtgatcagaagcaaggagaagctggactgcgagctgcagaaggactacagcttcaccatccaggcctacgactgcggcaagggccccgacggcaccaacgtgaagaagagccacaaggccaccgtgcacatccaggtgaacgacgtgaacgagtacgcccccgtgttcaaggagaagagctacaaggccaccgtgatcgagggcaagcagtacgacagcatcctgagagtggaggccgtggacgccgactgcagcccccagttcagccagatctgcagctacgagatcatcacccccgacgtgcccttcaccgtggacaaggacggctacatcaagaacaccgagaagctgaactacggcaaggagcaccagtacaagctgaccgtgaccgcctacgactgcggcaagaagagagccaccgaggacgtgctggtgaagatcagcatcaagcccacctgcacccccggctggcagggctggaacaacagaatcgagtacgagcccggcaccggcgccctggccgtgttccccaacatccacctggagacctgcgacgagcccgtggccagcgtgcaggccaccgtggagctggagaccagccacatcggcaagggctgcgacagagacacctacagcgagaagagcctgcacagactgtgcggcgccgccgccggcaccgccgagctgctgcccagccccagcggcagcctgaactggaccatgggcctgcccaccgacaacggccacgacagcgaccaggtgttcgagttcaacggcacccaggccgtgagaatccccgacggcgtggtgagcgtgagccccaaggagcccttcaccatcagcgtgtggatgagacacggccccttcggcagaaagaaggagaccatcctgtgcagcagcgacaagaccgacatgaacagacaccactacagcctgtacgtgcacggctgcagactgatcttcctgttcagacaggaccccagcgaggagaagaagtacagacccgccgagttccactggaagctgaaccaggtgtgcgacgaggagtggcaccactacgtgctgaacgtggagttccccagcgtgaccctgtacgtggacggcaccagccacgagcccttcagcgtgaccgaggactaccccctgcaccccagcaagatcgagacccagctggtggtgggcgcctgctggcagggcggcgacctgcacatgacccagttcttcagaggcaacctggccggcctgaccctgagaagcggcaagctggccgacaagaaggtgatcgactgcctgtacacctgcaaggagggcctggacctgcaggtgctggaggacagcggcagaggcgtgcagatccaggcccaccccagccagctggtgctgaccctggagggcgaggacctgggcgagctggacaaggccatgcagcacatcagctacctgaacagcagacagttccccacccccggcatcagaagactgaagatcaccagcaccatcaagtgcttcaacgaggccacctgcatcagcgtgccccccgtggacggctacgtgatggtgctgcagcccgaggagcccaagatcagcctgagcggcgtgcaccacttcgccagagccgccagcgagttcgagagcagcgagggcgtgttcctgttccccgagctgagaatcatcagcaccatcaccagagaggtggagcccgagggcgacggcgccgaggaccccaccgtgcaggagagcctggtgagcgaggagatcgtgcacgacctggacacctgcgaggtgaccgtggagggcgaggagctgaaccacgagcaggagagcctggaggtggacatggccagactgcagcagaagggcatcgaggtgagcagcagcgagctgggcatgaccttcaccggcgtggacaccatggccagctacgaggaggtgctgcacctgctgagatacagaaactggcacgccagaagcctgctggacagaaagttcaagctgatctgcagcgagctgaacggcagatacatcagcaacgagttcaaggtggaggtgaacgtgatccacaccgccaaccccatggagcacgccaaccacatggccgcccagccccagttcgtgcaccccgagcacagaagcttcgtggacctgagcggccacaacctggccaacccccaccccttcgccgtggtgcccagcaccgccaccgtggtgatcgtggtgtgcgtgagcttcctggtgttcatgatcatcctgggcgtgttcagaatcagagccgcccacagaagaaccatgagagaccaggacaccggcaaggagaacgagatggactgggacgacagcgccctgaccatcaccgtgaaccccatggagacctacgaggaccagcacagcagcgaggaggaggaggaggaggaggaggaggaggagagcgaggacggcgaggaggaggacgacatcaccagcgccgagagcgagagcagcgaggaggaggagggcgagcagggcgacccccagaacgccaccagacagcagcagctggagtgggacgacagcaccctgagctactag

SEQ ID NO: 4188 - DNA, 2946 bp, Artificial Sequence
  Description of Artificial Sequence: Synthetic coding sequence
atgctgagaagacccgcccccgccctggcccccgccgccagactgctgctggccggcctgctgtgcggcggcggcgtgtgggccgccagagtgaacaagcacaagccctggctggagcccacctaccacggcatcgtgaccgagaacgacaacaccgtgctgctggacccccccctgatcgccctggacaaggacgcccccctgagattcgccgagagcttcgaggtgaccgtgaccaaggagggcgagatctgcggcttcaagatccacggccagaacgtgcccttcgacgccgtggtggtggacaagagcaccggcgagggcgtgatcagaagcaaggagaagctggactgcgagctgcagaaggactacagcttcaccatccaggcctacgactgcggcaagggccccgacggcaccaacgtgaagaagagccacaaggccaccgtgcacatccaggtgaacgacgtgaacgagtacgcccccgtgttcaaggagaagagctacaaggccaccgtgatcgagggcaagcagtacgacagcatcctgagagtggaggccgtggacgccgactgcagcccccagttcagccagatctgcagctacgagatcatcacccccgacgtgcccttcaccgtggacaaggacggctacatcaagaacaccgagaagctgaactacggcaaggagcaccagtacaagctgaccgtgaccgcctacgactgcggcaagaagagagccaccgaggacgtgctggtgaagatcagcatcaagcccacctgcacccccggctggcagggctggaacaacagaatcgagtacgagcccggcaccggcgccctggccgtgttccccaacatccacctggagacctgcgacgagcccgtggccagcgtgcaggccaccgtggagctggagaccagccacatcggcaagggctgcgacagagacacctacagcgagaagagcctgcacagactgtgcggcgccgccgccggcaccgccgagctgctgcccagccccagcggcagcctgaactggaccatgggcctgcccaccgacaacggccacgacagcgaccaggtgttcgagttcaacggcacccaggccgtgagaatccccgacggcgtggtgagcgtgagccccaaggagcccttcaccatcagcgtgtggatgagacacggccccttcggcagaaagaaggagaccatcctgtgcagcagcgacaagaccgacatgaacagacaccactacagcctgtacgtgcacggctgcagactgatcttcctgttcagacaggaccccagcgaggagaagaagtacagacccgccgagttccactggaagctgaaccaggtgtgcgacgaggagtggcaccactacgtgctgaacgtggagttccccagcgtgaccctgtacgtggacggcaccagccacgagcccttcagcgtgaccgaggactaccccctgcaccccagcaagatcgagacccagctggtggtgggcgcctgctggcaggagttcagcggcgtggagaacgacaacgagaccgagcccgtgaccgtggccagcgccggcggcgacctgcacatgacccagttcttcagaggcaacctggccggcctgaccctgagaagcggcaagctggccgacaagaaggtgatcgactgcctgtacacctgcaaggagggcctggacctgcaggtgctggaggacagcggcagaggcgtgcagatccaggcccaccccagccagctggtgctgaccctggagggcgaggacctgggcgagctggacaaggccatgcagcacatcagctacctgaacagcagacagttccccacccccggcatcagaagactgaagatcaccagcaccatcaagtgcttcaacgaggccacctgcatcagcgtgccccccgtggacggctacgtgatggtgctgcagcccgaggagcccaagatcagcctgagcggcgtgcaccacttcgccagagccgccagcgagttcgagagcagcgagggcgtgttcctgttccccgagctgagaatcatcagcaccatcaccagagaggtggagcccgagggcgacggcgccgaggaccccaccgtgcaggagagcctggtgagcgaggagatcgtgcacgacctggacacctgcgaggtgaccgtggagggcgaggagctgaaccacgagcaggagagcctggaggtggacatggccagactgcagcagaagggcatcgaggtgagcagcagcgagctgggcatgaccttcaccggcgtggacaccatggccagctacgaggaggtgctgcacctgctgagatacagaaactggcacgccagaagcctgctggacagaaagttcaagctgatctgcagcgagctgaacggcagatacatcagcaacgagttcaaggtggaggtgaacgtgatccacaccgccaaccccatggagcacgccaaccacatggccgcccagccccagttcgtgcaccccgagcacagaagcttcgtggacctgagcggccacaacctggccaacccccaccccttcgccgtggtgcccagcaccgccaccgtggtgatcgtggtgtgcgtgagcttcctggtgttcatgatcatcctgggcgtgttcagaatcagagccgcccacagaagaaccatgagagaccaggacaccggcaaggagaacgagatggactgggacgacagcgccctgaccatcaccgtgaaccccatggagacctacgaggaccagcacagcagcgaggaggaggaggaggaggaggaggaggaggagagcgaggacggcgaggaggaggacgacatcaccagcgccgagagcgagagcagcgaggaggaggagggcgagcagggcgacccccagaacgccaccagacagcagcagctggagtgggacgacagcaccctgagctactag

SEQ ID NO: 4189 - DNA, 678 bp, Artificial Sequence
  Description of Artificial Sequence: Synthetic coding sequence
atgagcggctgcagcaagagatgcaagctgggcttcgtgaagttcgcccagaccatcttcaagctgatcaccggcaccctgagcaaggacaagatcgaggacgagctggagatgaccatggtgtgccacagacccgagggcctggagcagctggaggcccagaccaacttcaccaagagagagctgcaggtgctgtacagaggcttcaagaacgagtgccccagcggcgtggtgaacgaggacaccttcaagcagatctacgcccagttcttcccccacggcgacgccagcacctacgcccactacctgttcaacgccttcgacaccacccagaccggcagcgtgaagttcgaggacttcgtgaccgccctgagcatcctgctgagaggcaccgtgcacgagaagctgagatggaccttcaacctgtacgacatcaacaaggacggctacatcaacaaggaggagatgatggacatcgtgaaggccatctacgacatgatgggcaagtacacctaccccgtgctgaaggaggacacccccagacagcacgtggacgtgttcttccagaagatggacaagaacaaggacggcatcgtgaccctggacgagttcctggagagctgccaggaggacgacaacatcatgagaagcctgcagctgttccagaacgtgatgtag

SEQ ID NO: 4190 - DNA, 420 bp, Artificial Sequence
  Description of Artificial Sequence: Synthetic coding sequence
atgtacaagctggccagctgctgcctgctgttcatcggcttcctgaaccccctgctgagcctgcccctgctggacagcagagagatcagcttccagctgagcgccccccacgaggacgccagactgacccccgaggagctggagagagccagcctgctgcagatcctgcccgagatgctgggcgccgagagaggcgacatcctgagaaaggccgacagcagcaccaacatcttcaaccccagaggcaacctgagaaagttccaggacttcagcggccaggaccccaacatcctgctgagccacctgctggccagaatctggaagccctacaagaagcagagaagaaagctgagacaggacctgagactgtggaagaaggagcccggcctgagaatcttcaagaactacgtgtgggtgtag

SEQ ID NO: 4191 - DNA, 879 bp, Artificial Sequence
  Description of Artificial Sequence: Synthetic coding sequence
atggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacagactggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagctacctggacctgaacttcgagatcagcttcggcggcatccccacccccggcagaagcagagccttcagaagaaagagcttccacggctgcctggagaacctgtactacaacggcgtggacgtgaccgagctggccaagaagcacaagccccagatcctgatgatggagctggcccacggcctgcaggaccagaacctgaagatcagcctgaccgtgtgccaccagaccacccagtag

SEQ ID NO: 4192 - DNA, 783 bp, Artificial Sequence
  Description of Artificial Sequence: Synthetic coding sequence
atgaagaccagcgacggcttcaccctgaacgccgagagctacgtgagcttcaccaccaagctggacatccccaccgccgccaagtacgagtacggcgtgcccctgcagaccagcgacagcttcctgagattccccagcagcctgaccagcagcctgtgcaccgacaacaaccccgccgccttcctggtgaaccaggccgtgaagtgcaccagaaagatcaacctggagcagtgcgaggagatcgaggccctgagcatggccttctacagcagccccgagatcctgagagtgcccgacagcagaaagaaggtgcccatcaccgtgcagagcatcgtgatccagagcctgaacaagaccctgaccagaagagaggacaccgacgtgctgcagcccaccctggtgaacgccggccacttcagcctgtgcgtgaacgtggtgctggaggtgaagtacagcctgacctacaccgacgccggcgaggtgaccaaggccgacctgagcttcgtgctgggcaccgtgagcagcgtggtggtgcccctgcagcagaagttcgagatccacttcctgcagaccgactggagcagccccgtgagcgccagaagcaccgagggcgaggagcccgccgtgggccccggcctgcccagactgagaggccccttctggaagttccccggccccggccacgccggcctgggcgcccaccccctgcaccaccccgtgatccagcaggagggcttcctgcccgcccccagaggcttcggctacagaagcgaggtggactag

SEQ ID NO: 4193 - DNA, 3624 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacgcccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacagactggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagctacctggacctgaacttcgagatcagcttcggcggcatccccacccccggcagaagcagagccttcagaagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgagaagaggcagcggcagcttcgtgctgttcctgaaggacggcaagctgaagctgagcctgttccagcccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcggctgcctggacaacagcagcggcagcggctgcaagagccccctgggcggcttccagggctgcctgagactgatcaccatcggcgacaaggccgtggaccccatcctggtgcagcagggcgccctgggcagcttcagagacctgcagatcgacagctgcggcatcaccgacagatgcctgcccagctactgcgagcacggcggcgagtgcagccagagctgggacaccttcagctgcgactgcctgggcaccggctacaccggcgagacctgccacagcagcctgtacgagcagagctgcgaggcccacaagcacagaggcaaccccagcggcctgtactacatcgacgccgacggcagcggccccctgggccccttcctggtgtactgcaacatgaccgacgccgcctggaccgtggtgcagcacggcggccccgacgccgtgaccctgagaggcgcccccagcggccaccccagaagcgccgtgagcttcgcctacgccgccggcgccggccagctgagaagcgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggcagaaacgagtggaccagcgacaccatcgtgctgagccagaaggagcacctgcccgtgacccagatcgtgatgaccgacgccggcagaccccacagcgaggccgcctacaccctgggccccctgctgtgcagaggcgaccagagcttctggaacagcgccagcttcaacaccgagaccagctacctgcacttccccgccttccacggcgagctgaccgccgacgtgtgcttcttcttcaagaccaccgtgagcagcggcgtgttcatggagaacctgggcatcaccgacttcatcagaatcgagctgagagcccccaccgaggtgaccttcagcttcgacgtgggcaacggcccctgcgaggtgaccgtgcagagccccacccccttcaacgacaaccagtggcaccacgtgagagccgagagaaacgtgaagggcgccagcctgcaggtggaccagctgccccagaagatgcagcccgcccccgccgacggccacgtgagactgcagctgaacagccagctgttcatcgagatcagcgcctacttcgccaccggcagcagcatgacctaccacttccaggagcactacaccctgagcgagaacagcagcagcctggtgagcagcctgcacagagacgtgaccctgaccagagagatgatcaccctgagcttcagaaccaccagaacccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgaaccagagcaccaagaagcaggtgatcctgagcagcggcaccgagttcaacgccgtgaagagcctgatcctgggcaaggtgctggaggccgccggcgccgaccccgacaccagaagagccgccaccagcggcttcaccggctgcctgagcgccgtgagattcggcagagccgcccccctgaaggccgccctgagacccagcggccccagcagagtgaccgtgagaggccacgtggcccccatggccagatgcgccgccggcgccgccagcggcagccccgccagagagctggcccccagactggccggcggcgccggcagaagcggccccgccgacgagggcgagcccctggtgaacgccgacagaagagacagcgccgtgatcggcggcgtgatcgccgtggtgatcttcatcctgctgtgcatcaccgccatcgccatcagaatctaccagcagagaaagctgagaaaggagaacgagagcaaggtgagcaagaaggaggagtgctag

SEQ ID NO: 4194 - DNA, 2238 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacgcccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacagactggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagctacctggacctgaacttcgagatcagcttcggcggcatccccacccccggcagaagcagagccttcagaagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgagaagaggcagcggcagcttcgtgctgttcctgaaggacggcaagctgaagctgagcctgttccagcccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcggctgcctggacaacagcagcggcagcggctgcaagagccccctgggcggcttccagggctgcctgagactgatcaccatcggcgacaaggccgtggaccccatcctggtgcagcagggcgccctgggcagcttcagagacctgcagatcgacagctgcggcatcaccgacagatgcctgcccagctactgcgagcacggcggcgagtgcagccagagctgggacaccttcagctgcgactgcctgggcaccggctacaccggcgagacctgccacagcagcctgtacgagcagagctgcgaggcccacaagcacagaggcaaccccagcggcctgtactacatcgacgccgacggcagcggccccctgggccccttcctggtgtactgcaacatgaccgacgccgcctggaccgtggtgcagcacggcggccccgacgccgtgaccctgagaggcgcccccagcggccaccccagaagcgccgtgagcttcgcctacgccgccggcgccggccagctgagaagcgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggcagaaacgagtggtag

SEQ ID NO: 4195 - DNA, 549 bp, Artificial Sequence
  Description of Artificial Sequence: Synthetic coding sequence
atggagccccagctgggccccgaggccgccgccctgagacccggctggctggccctgctgctgtgggtgagcgccctgagctgcagcttcagcctgcccgccagcagcctgagcagcctggtgccccaggtgagaaccagctacaacttcggcagaaccttcctgggcctggacaagtgcaacgcctgcatcggcaccagcatctgcaagaagttcttcaaggaggagatcagaagcgacaactggctggccagccacctgggcctgccccccgacagcctgctgagctaccccgccaactacagcgacgacagcaagatctggagacccgtggagatcttcagactggtgagcaagtaccagaacgagatcagcgacagaagaatctgcgccagcgccagcgcccccaagacctgcagcatcgagagagtgctgagaaagaccgagagattccagaagtggctgcaggccaagagactgacccccgacctggtgcaggactgccaccagggccagagagagctgaagttcctgtgcatgctgagatag

SEQ ID NO: 4196 - DNA, 282 bp, Artificial Sequence
  Description of Artificial Sequence: Synthetic coding sequence
atggacagcctgagaaagatgctgatcagcgtggccatgctgggcgccggcgccggcgtgggctacgccctgctggtgatcgtgacccccggcgagagaagaaagcaggagatgctgaaggagatgcccctgcaggaccccagaagcagagaggaggccgccagaacccagcagctgctgctggccaccctgcaggaggccgccaccacccaggagaacgtggcctggagaaagaactggatggtgggcggcgagggcggcgccggcggcagaagcccctag

SEQ ID NO: 4197 - DNA, 387 bp, Artificial Sequence
  Description of Artificial Sequence: Synthetic coding sequence
atgggcaagagcgccagcaagcagttccacaacgaggtgctgaaggcccacaacgagtacagacagaagcacggcgtgccccccctgaagctgtgcaagaacctgaacagagaggcccagcagtacagcgaggccctggccagcaccagaatcctgaagcacagccccgagagcagcagaggccagtgcggcgagaacctggcctgggccagctacgaccagaccggccacttcaccgccatggtgtggaagaacaccaagaagatgggcgtgggcaaggccagcgccagcgacggcagcagcttcgtggtggccagatacttccccgccggcaacgtggtgaacgagggcttcttcgaggagaacgtgctgccccccaagaagtag

SEQ ID NO: 4198 - DNA, 465 bp, Artificial Sequence
  Description of Artificial Sequence: Synthetic coding sequence
atgggcaagagcgccagcaagcagttccacaacgaggtgctgaaggcccacaacgagtacagacagaagcacggcgtgccccccctgaagctgtgcaagaacctgaacagagaggcccagcagtacagcgaggccctggccagcaccagaatcctgaagcacagccccgagagcagcagaggccagtgcggcgagaacctggcctgggccagctacgaccagaccggcaaggaggtggccgacagatggtacagcgagatcaagaactacaacttccagcagcccggcttcaccagcggcaccggccacttcaccgccatggtgtggaagaacaccaagaagatgggcgtgggcaaggccagcgccagcgacggcagcagcttcgtggtggccagatacttccccgccggcaacgtggtgaacgagggcttcttcgaggagaacgtgctgccccccaagaagtag

SEQ ID NO: 4199 - DNA, 831 bp, Artificial Sequence
  Description of Artificial Sequence: Synthetic coding sequence
atggacagcagcagagagcccaccctgggcagactggacgccgccggcttctggcaggtgtggcagagattcgacgccgacgagaagggctacatcgaggagaaggagctggacgccttcttcctgcacatgctgatgaagctgggcaccgacgacaccgtgatgaaggccaacctgcacaaggtgaagcagcagttcatgaccacccaggacgccagcaaggacggcagaatcagaatgaaggagctggccggcatgttcctgagcgaggacgagaacttcctgctgctgttcagaagagagaaccccctggacagcagcgtggagttcatgcagatctggagaaagtacgacgccgacagcagcggcttcatcagcgccgccgagctgagaaacttcctgagagacctgttcctgcaccacaagaaggccatcagcgaggccaagctggaggagtacaccggcaccatgatgaagatcttcgacagaaacaaggacggcagactggacctgaacgacctggccagaatcctggccctgcaggagaacttcctgctgcagttcaagatggacgcctgcagcaccgaggagagaaagagagacttcgagaagatcttcgcctactacgacgtgagcaagaccggcgccctggagggccccgaggtggacggcttcgtgaaggacatgatggagctggtgcagcccagcatcagcggcgtggacctggacaagttcagagagatcctgctgagacactgcgacgtgaacaaggacggcaagatccagaagagcgagctggccctgtgcctgggcctgaagatcaacccctag

SEQ ID NO: 4200 - DNA, 216 bp, Artificial Sequence
  Description of Artificial Sequence: Synthetic coding sequence
atgcccgccggcgtgcccatgagcacctacctgaagatgttcgccgccagcctgctggccatgtgcgccggcgccgaggtggtgcacagatactacagacccgacctgaccatccccgagatcccccccaagagaggcgagctgaagaccgagctgctgggcctgaaggagagaaagcacaagccccaggtgagccagcaggaggagctgaagtag

SEQ ID NO: 4201 - DNA, 1287 bp, Artificial Sequence
  Description of Artificial Sequence: Synthetic coding sequence
atgaagcccatgctgaaggacttcagcaacctgctgctggtggtgctgtgcgactacgtgctgggcgaggccgagtacctgctgctgagagagcccggccacgtggccctgagcaacgacaccgtgtacgtggacttccagtacttcgacggcgccaacggcaccctgagaaacgtgagcgtgctgctgctggaggccaacaccaaccagaccgtgaccaccaagtacctgctgaccaaccagagccagggcaccctgaagttcgagtgcttctacttcaaggaggccggcgactactggttcaccatgacccccgaggccaccgacaacagcacccccttcccctggtgggagaagagcgccttcctgaaggtggagtggcccgtgttccacgtggacctgaacagaagcgccaaggccgccgagggcaccttccaggtgggcctgttcaccagccagcccctgtgccccttccccgtggacaagcccaacatcgtggtggacgtgatcttcaccaacagcctgcccgaggccagaagaaacagcagacagcccctggagatcagaaccagcaagagaaccgagctggcccagggccagtgggtggagttcggctgcgcccccctgggccccgaggcctacgtgaccgtggtgctgaagctgctgggcagagacagcgtgatcaccagcaccggccccatcgacctggcccagaagttcggctacaagctggtgatggtgcccgagctgacctgcgagagcggcgtggaggtgaccgtgctgccccccccctgcaccttcgtgcagggcgtggtgaccgtgttcaaggaggcccccagataccccggcaagagaaccatccacctggccgagaacagcctgcccctgggcgagagaagaaccatcttcaactgcaccctgttcgacatgggcaagaacaagtactgcttcgacttcggcatcagcagcagaagccacttcagcgccaaggaggagtgcatgctgatccagagaaacaccgagacctggggcctgtggcagccctggagccagtgcagcgccacctgcggcgacggcgtgagagagagaagaagagtgtgcctgaccagcttccccagcagccccgtgtgccccggcatgagcctggaggccagcctgtgcagcctggaggagtgcgccggcagattcagaagctgctgccccggctggagcgccatggtgagaagcagactgaccaacagcgccagcagagtgcaggccatcctgctgccccagcccctggcctag

SEQ ID NO: 4202 - DNA, 312 bp, Artificial Sequence
  Description of Artificial Sequence: Synthetic coding sequence
atgaagctgtgcgtgaccgtgctgagcctgctggtgctggtggccgccttctgcagcctggccctgagcgcccccatgggcagcgacccccccaccgcctgctgcttcagctacaccgccagaaagctgcccagaaacttcgtggtggactactacgagaccagcagcctgtgcagccagcccgccgtggtgtacagagagagcgccagcagcgccgcccccggcagaatccccagcaccagagccgccccccacggcccctggagcggcagaggcagatgcctgccccaggccagagacaaggccagatag

SEQ ID NO: 4203 - DNA, 279 bp, Artificial Sequence
  Description of Artificial Sequence: Synthetic coding sequence
atgaagctgtgcgtgaccgtgctgagcctgctggtgctggtggccgccttctgcagcctggccctgagcgcccccatgggcagcgacccccccaccgcctgctgcttcagctacaccgccagaaagctgcccagaaacttcgtggtggactactacgagaccagcagcctgtgcagccagcccgccgtgccctgggacagcaacctgggcaagcaggtgtgcgccgaccccagcgagagctgggtgcaggagtacgtgtacgacctggagctgaactag

SEQ ID NO: 4204 - DNA, 282 bp, Artificial Sequence
  Description of Artificial Sequence: Synthetic coding sequence
atgcaggtgagcaccgccgccctggccgtgctgctgtgcaccatggccctgtgcaaccaggtgctgagcgcccccctggccgccgacacccccaccgcctgctgcttcagctacaccagcagacagatcccccagaacttcatcgccgactacttcgagaccagcagccagtgcagcaagcccagcgtgatcttcctgaccaagagaggcagacaggtgtgcgccgaccccagcgaggagtgggtgcagaagtacgtgagcgacctggagctgagcgcctag

SEQ ID NO: 4205 - DNA, 1869 bp, Artificial Sequence
  Description of Artificial Sequence: Synthetic coding sequence
atgggcaagagcgagggccccgtgggcatggtggagagcgccggcagagccggccagaagagacccggcttcctggagggcggcctgctgctgctgctgctgctggtgaccgccgccctggtggccctgggcgtgctgtacgccgacagaagaggcaagcagctgcccagactggccagcagactgtgcttcctgcaggaggagagaaccttcgtgaagagaaagcccagaggcatccccgaggcccaggaggtgagcgaggtgtgcaccacccccggctgcgtgatcgccgccgccagaatcctgcagaacatggaccccaccaccgagccctgcgacgacttctaccagttcgcctgcggcggctggctgagaagacacgtgatccccgagaccaacagcagatacagcatcttcgacgtgctgagagacgagctggaggtgatcctgaaggtggagctggagacccagctggccaaggccaccgtgccccaggaggagagacacgacgtgatcgccctgtaccacagaatgggcctggaggagctgcagagccagttcggcctgaagggcttcaactggaccctgttcatccagaccgtgctgagcagcgtgaagatcaagctgctgcccgacgaggaggtggtggtgtacggcatcccctacctgcagaacctggagaacatcatcgacacctacagcgccagaaccatccagaactacctggtgtggagactggtgctggacagaatcggcagcctgagccagagattcaaggacaccagagtgaactacagaaaggccctgttcggcaccatggtggaggaggtgagatggagagagtgcgtgggctacgtgaacagcaacatggagaacgccgtgggcagcctgtacgtgagagaggccttccccggcgacagcaagagcatggtgagagagctgatcgacaaggtgagaaccgtgttcgtggagaccctggacgagctgggctggatggacgaggagagcaagaagaaggcccaggagaaggccatgagcatcagagagcagatcggccaccccgactacatcctggaggagatgaacagaagactggacgaggagtacagcaacctgaacttcagcgaggacctgtacttcgagaacagcctgcagaacctgaaggtgggcgcccagagaagcctgagaaagctgagagagaaggtggaccccaacctgtggatcatcggcgccgccgtggtgaacgccttctacagccccaacagaaaccagatcgtgttccccgccggcatcctgcagccccccttcttcagcaaggagcagccccaggccctgaacttcggcggcatcggcatggtgatcggccacgagatcacccacggcttcgacgacaacggcagaaacttcgacaagaacggcaacatgatggactggtggagcaacttcagcacccagcacttcagagagcagagcgagtgcatgatctaccagtacggcaactacagctgggacctggccgacgagcagaacgtgaacggcttcaacaccctgggcgagaacatcgccgacaacggcggcgtgagacaggcctacaaggcctacctgaagtggatggccgagggcggcaaggaccagcagctgcccggcctggacctgacccacgagcagctgttcttcatcaactacgcccaggtgtggtgcggcagctacagacccgagttcgccatccagagcatcaagaccgacgtgcacagccccctgaagtacagagtgctgggcagcctgcagaacctggccgccttcgccgacaccttccactgcgccagaggcacccccatgcaccccaaggagagatgcagagtgtggtag

SEQ ID NO: 4206 - DNA, 2340 bp, Artificial Sequence
  Description of Artificial Sequence: Synthetic coding sequence
atgggcaagagcgagggccccgtgggcatggtggagagcgccggcagagccggccagaagagacccggcttcctggagggcggcctgctgctgctgctgctgctggtgaccgccgccctggtggccctgggcgtgctgtacgccgacagaagaggcaagcagctgcccagactggccagcagactgtgcttcctgcaggaggagagaaccttcgtgaagagaaagcccagaggcatccccgaggcccaggaggtgagcgaggtgtgcaccacccccggctgcgtgatcgccgccgccagaatcctgcagaacatggaccccaccaccgagccctgcgacgacttctaccagttcgcctgcggcggctggctgagaagacacgtgatccccgagaccaacagcagatacagcatcttcgacgtgctgagagacgagctggaggtgatcctgaaggccgtgctggagaacagcaccgccaaggacagacccgccgtggagaaggccagaaccctgtacagaagctgcatgaaccagagcgtgatcgagaagagaggcagccagcccctgctggacatcctggaggtggtgggcggctggcccgtggccatggacagatggaacgagaccgtgggcctggagtgggagctggagagacagctggccctgatgaacagccagttcaacagaagagtgctgatcgacctgttcatctggaacgacgaccagaacagcagcagacacatcatctacatcgaccagcccaccctgggcatgcccagcagagagtactacttcaacggcggcagcaacagaaaggtgagagaggcctacctgcagttcatggtgagcgtggccaccctgctgagagaggacgccaacctgcccagagacagctgcctggtgcaggaggacatggtgcaggtgctggagctggagacccagctggccaaggccaccgtgccccaggaggagagacacgacgtgatcgccctgtaccacagaatgggcctggaggagctgcagagccagttcggcctgaagggcttcaactggaccctgttcatccagaccgtgctgagcagcgtgaagatcaagctgctgcccgacgaggaggtggtggtgtacggcatcccctacctgcagaacctggagaacatcatcgacacctacagcgccagaaccatccagaactacctggtgtggagactggtgctggacagaatcggcagcctgagccagagattcaaggacaccagagtgaactacagaaaggccctgttcggcaccatggtggaggaggtgagatggagagagtgcgtgggctacgtgaacagcaacatggagaacgccgtgggcagcctgtacgtgagagaggccttccccggcgacagcaagagcatggtgagagagctgatcgacaaggtgagaaccgtgttcgtggagaccctggacgagctgggctggatggacgaggagagcaagaagaaggcccaggagaaggccatgagcatcagagagcagatcggccaccccgactacatcctggaggagatgaacagaagactggacgaggagtacagcaacctgaacttcagcgaggacctgtacttcgagaacagcctgcagaacctgaaggtgggcgcccagagaagcctgagaaagctgagagagaaggtggaccccaacctgtggatcatcggcgccgccgtggtgaacgccttctacagccccaacagaaaccagatcgtgttccccgccggcatcctgcagccccccttcttcagcaaggagcagccccaggccctgaacttcggcggcatcggcatggtgatcggccacgagatcacccacggcttcgacgacaacggcagaaacttcgacaagaacggcaacatgatggactggtggagcaacttcagcacccagcacttcagagagcagagcgagtgcatgatctaccagtacggcaactacagctgggacctggccgacgagcagaacgtgaacggcttcaacaccctgggcgagaacatcgccgacaacggcggcgtgagacaggcctacaaggcctacctgaagtggatggccgagggcggcaaggaccagcagctgcccggcctggacctgacccacgagcagctgttcttcatcaactacgcccaggtgtggtgcggcagctacagacccgagttcgccatccagagcatcaagaccgacgtgcacagccccctgaagtacagagtgctgggcagcctgcagaacctggccgccttcgccgacaccttccactgcgccagaggcacccccatgcaccccaaggagagatgcagagtgtggtag

SEQ ID NO: 4207 - DNA, 258 bp, Artificial Sequence
  Description of Artificial Sequence: Synthetic coding sequence
atgagcgtgcacatgcccgccatgaagatctgcgagaagctgaagaagctggacagccagatctgcgagctgaagtacgagaagaccctggacctggccagcgtggacctgagaaagatgagagtggccgagctgaagcagatcctgcacagctggggcgaggagtgcagagcctgcgccgagaagaccgactacgtgaacctgatccaggagctggcccccaagtacgccgccacccaccccaagaccgagctgtag

SEQ ID NO: 4208 - DNA, 657 bp, Artificial Sequence
  Description of Artificial Sequence: Synthetic coding sequence
atgggcagagtgttcctgaccggcgagaaggccaacagcatcctgaagagataccccagagccaacggcttcttcgaggagatcagacagggcaacatcgagagagagtgcaaggaggagttctgcaccttcgaggaggccagagaggccttcgagaacaacgagaagaccaaggagttctggagcacctacaccaaggcccagcagggcgagagcaacagaggcagcgactggttccagttctacctgaccttccccctgatcttcggcctgttcatcatcctgctggtgatcttcctgatctggagatgcttcctgagaaacaagaccagaagacagaccgtgaccgagggccacatccccttcccccagcacctgaacatcatcacccccccccccccccccgacgaggtgttcgacagcagcggcctgagccccggcttcctgggctacgtggtgggcagaagcgacagcgtgagcaccagactgagcaactgcgaccccccccccacctacgaggaggccaccggccaggtgaacctgcagagaagcgagaccgagccccacctggaccccccccccgagtacgaggacatcgtgaacagcaacagcgccagcgccatccccatggtgcccgtggtgaccaccatcaagtag

SEQ ID NO: 4209 - DNA, 1365 bp, Artificial Sequence; identical to SEQ ID NO: 3691
  Description of Artificial Sequence: Synthetic coding sequence

SEQ ID NO: 4210 - DNA, 417 bp, Artificial Sequence
  Description of Artificial Sequence: Synthetic coding sequence
atgacctggagacaggccgtgctgctgagctgcttcagcgccgtggtgctgctgagcatgctgagagagggcaccagcgtgagcgtgggcaccatgcagatggccggcgaggaggccagcgaggacgccaagcagaagatcttcatgcaggagagcgacgccagcaacttcctgaagagaagaggcaagagaagccccaagagcagagacgaggtgaacgtggagaacagacagaagctgagagtggacgagctgagaagagagtactacgaggagcagagaaacgagttcgagaacttcgtggaggagcagaacgacgagcaggaggagagaagcagagaggccgtggagcagtggagacagtggcactacgacggcctgcaccccagctacctgtacaacagacaccacacctag

SEQ ID NO: 4211 - DNA, 729 bp, Artificial Sequence
  Description of Artificial Sequence: Synthetic coding sequence
atggccctgaagaacaagttcagctgcctgtggatcctgggcctgtgcctggtggccaccaccagcagcaagatccccagcatcaccgacccccacttcatcgacaactgcatcgaggcccacaacgagtggagaggcaaggtgaacccccccgccgccgacatgaagtacatgatctgggacaagggcctggccaagatggccaaggcctgggccaaccagtgcaagttcgagcacaacgactgcctggacaagagctacaagtgctacgccgccttcgagtacgtgggcgagaacatctggctgggcggcatcaagagcttcacccccagacacgccatcaccgcctggtacaacgagacccagttctacgacttcgacagcctgagctgcagcagagtgtgcggccactacacccagctggtgtgggccaacagcttctacgtgggctgcgccgtggccatgtgccccaacctgggcggcgccagcaccgccatcttcgtgtgcaactacggccccgccggcaacttcgccaacatgcccccctacgtgagaggcgagagctgcagcctgtgcagcaaggaggagaagtgcgtgaagaacctgtgcagaaccccccagctgatcatccccaaccagaaccccttcctgaagcccaccggcagagccccccagcagaccgccttcaaccccttcagcctgggcttcctgctgctgagaatcttctag

SEQ ID NO: 4212 - DNA, 813 bp, Artificial Sequence
  Description of Artificial Sequence: Synthetic coding sequence
atgctgagacagctgctgctggccgccctgtgcctggccggcccccccgcccccgccagagcctgccagctgcccagcgagtggagacccctgagcgagggctgcagagccgagctggccgagaccatcgtgtacgccagagtgctggccctgcaccccgaggcccccggcctgtacaaccacctgccctggcagtaccacgccggccagggcggcctgttctacagcgccgaggtggagatgctgtgcgaccaggcctggggcagcatgctggaggtgcccgccggcagcagactgaacctgaccggcctgggctacttcagctgccacagccacaccgtggtgcaggactacagctacttcttcttcctgagaatggacgagaactacaacctgctgccccacggcgtgaacttccaggacgccatcttccccgacacccaggagaacagaagaatgttcagcagcctgttccagttcagcaactgcagccagggccagcagctggccaccttcagcagcgactgggagatccaggaggacagcagactgatgtgcagcagcgtgcagaaggccctgttcgaggaggaggaccacgtgaagaagctgcagcagaaggtggccaccctggagaagagaaacagacagctgagagagagagtgaagaaggtgaagagaagcctgagacaggccagaaagaagggcagacacctggagctggccaaccagaagctgagcgagaagctggccgccggcgccctgccccacatcaacgccagaggccccgtgagacccccctacctgagaggctag

SEQ ID NO: 4213 - DNA, 438 bp, Artificial Sequence
  Description of Artificial Sequence: Synthetic coding sequence
atggacgagaactacaacctgctgccccacggcgtgaacttccaggacgccatcttccccgacacccaggagaacagaagaatgttcagcagcctgttccagttcagcaactgcagccagggccagcagctggccaccttcagcagcgactgggagatccaggaggacagcagactgatgtgcagcagcgtgcagaaggccctgttcgaggaggaggaccacgtgaagaagctgcagcagaaggtggccaccctggagaagagaaacagacagctgagagagagagtgaagaaggtgaagagaagcctgagacaggccagaaagaagggcagacacctggagctggccaaccagaagctgagcgagaagctggccgccggcgccctgccccacatcaacgccagaggccccgtgagacccccctacctgagaggctag

SEQ ID NO: 4214 - DNA, 1830 bp, Artificial Sequence
  Description of Artificial Sequence: Synthetic coding sequence
atggagctgggctgctggacccagctgggcctgaccttcctgcagctgctgctgatcagcagcctgcccagagagtacaccgtgatcaacgaggcctgccccggcgccgagtggaacatcatgtgcagagagtgctgcgagtacgaccagatcgagtgcgtgtgccccggcaagagagaggtggtgggctacaccatcccctgctgcagaaacgaggagaacgagtgcgacagctgcctgatccaccccggctgcaccatcttcgagaactgcaagagctgcagaaacggcagctggggcggcaccctggacgacttctacgtgaagggcttctactgcgccgagtgcagagccggctggtacggcggcgactgcatgccctgcagcagcagcccctgcttccacgacggcacctgcgtgctggacaaggccggcagctacaagtgcgcctgcctggccggctacaccggccagagatgcgagaacctgctggaggagagaaactgcagcgaccccggcggccccgtgaacggctaccagaagatcaccggcggccccggcctgatcaacggcagacacgccaagatcggcaccgtggtgagcttcttctgcaacaacagctacgtgctgagcggcaacgagaagagaacctgccagcagaacggcgagtggagcggcaagcagcccatctgcatcaaggcctgcagagagcccaagatcagcgacctggtgagaagaagagtgctgcccatgcaggtgcagagcagagagacccccctgcaccagctgtacagcgccgccttcagcaagcagaagctgcagagcgcccccaccaagaagcccgccctgcccttcggcgacctgcccatgggctaccagcacctgcacacccagctgcagtacgagtgcatcagccccttctacagaagactgggcagcagcagaagaacctgcctgagaaccggcaagtggagcggcagagcccccagctgcatccccatctgcggcaagatcgagaacatcaccgcccccaagacccagggcctgagatggccctggcaggccgccatctacagaagaaccagcggcgtgcacgacggcagcctgcacaagggcgcctggttcctggtgtgcagcggcgccctggtgaacgagagaaccgtggtggtggccgcccactgcgtgaccgacctgggcaaggtgaccatgatcaagaccgccgacctgaaggtggtgctgggcaagttctacagagacgacgacagagacgagaagaccatccagagcctgcagatcagcgccatcatcctgcaccccaactacgaccccatcctgctggacgccgacatcgccatcctgaagctgctggacaaggccagaatcagcaccagagtgcagcccatctgcctggccgccagcagagacctgagcaccagcttccaggagagccacatcaccgtggccggctggaacgtgctggccgacgtgagaagccccggcttcaagaacgacaccctgagaagcggcgtggtgagcgtggtggacagcctgctgtgcgaggagcagcacgaggaccacggcatccccgtgagcgtgaccgacaacatgttctgcgccagctgggagcccaccgcccccagcgacatctgcaccgccgagaccggcggcatcgccgccgtgagcttccccggcagagccagccccgagcccagatggcacctgatgggcctggtgagctggagctacgacaagacctgcagccacagactgagcaccgccttcaccaaggtgctgcccttcaaggactggatcgagagaaacatgaagtag

SEQ ID NO: 4215 - DNA, 2163 bp, Artificial Sequence
  Description of Artificial Sequence: Synthetic coding sequence
atggagctgggctgctggacccagctgggcctgaccttcctgcagctgctgctgatcagcagcctgcccagagagtacaccgtgatcaacgaggcctgccccggcgccgagtggaacatcatgtgcagagagtgctgcgagtacgaccagatcgagtgcgtgtgccccggcaagagagaggtggtgggctacaccatcccctgctgcagaaacgaggagaacgagtgcgacagctgcctgatccaccccggctgcaccatcttcgagaactgcaagagctgcagaaacggcagctggggcggcaccctggacgacttctacgtgaagggcttctactgcgccgagtgcagagccggctggtacggcggcgactgcatgagatgcggccaggtgctgagagcccccaagggccagatcctgctggagagctaccccctgaacgcccactgcgagtggaccatccacgccaagcccggcttcgtgatccagctgagattcgtgatgctgagcctggagttcgactacatgtgccagtacgactacgtggaggtgagagacggcgacaacagagacggccagatcatcaagagagtgtgcggcaacgagagacccgcccccatccagagcatcggcagcagcctgcacgtgctgttccacagcgacggcagcaagaacttcgacggcttccacgccatctacgaggagatcaccgcctgcagcagcagcccctgcttccacgacggcacctgcgtgctggacaaggccggcagctacaagtgcgcctgcctggccggctacaccggccagagatgcgagaacctgctggaggagagaaactgcagcgaccccggcggccccgtgaacggctaccagaagatcaccggcggccccggcctgatcaacggcagacacgccaagatcggcaccgtggtgagcttcttctgcaacaacagctacgtgctgagcggcaacgagaagagaacctgccagcagaacggcgagtggagcggcaagcagcccatctgcatcaaggcctgcagagagcccaagatcagcgacctggtgagaagaagagtgctgcccatgcaggtgcagagcagagagacccccctgcaccagctgtacagcgccgccttcagcaagcagaagctgcagagcgcccccaccaagaagcccgccctgcccttcggcgacctgcccatgggctaccagcacctgcacacccagctgcagtacgagtgcatcagccccttctacagaagactgggcagcagcagaagaacctgcctgagaaccggcaagtggagcggcagagcccccagctgcatccccatctgcggcaagatcgagaacatcaccgcccccaagacccagggcctgagatggccctggcaggccgccatctacagaagaaccagcggcgtgcacgacggcagcctgcacaagggcgcctggttcctggtgtgcagcggcgccctggtgaacgagagaaccgtggtggtggccgcccactgcgtgaccgacctgggcaaggtgaccatgatcaagaccgccgacctgaaggtggtgctgggcaagttctacagagacgacgacagagacgagaagaccatccagagcctgcagatcagcgccatcatcctgcaccccaactacgaccccatcctgctggacgccgacatcgccatcctgaagctgctggacaaggccagaatcagcaccagagtgcagcccatctgcctggccgccagcagagacctgagcaccagcttccaggagagccacatcaccgtggccggctggaacgtgctggccgacgtgagaagccccggcttcaagaacgacaccctgagaagcggcgtggtgagcgtggtggacagcctgctgtgcgaggagcagcacgaggaccacggcatccccgtgagcgtgaccgacaacatgttctgcgccagctgggagcccaccgcccccagcgacatctgcaccgccgagaccggcggcatcgccgccgtgagcttccccggcagagccagccccgagcccagatggcacctgatgggcctggtgagctggagctacgacaagacctgcagccacagactgagcaccgccttcaccaaggtgctgcccttcaaggactggatcgagagaaacatgaagtag

SEQ ID NO: 4216 - DNA, 1134 bp, Artificial Sequence
  Description of Artificial Sequence: Synthetic coding sequence
atggaggccctgctgctgggcgccggcctgctgctgggcgcctacgtgctggtgtactacaacctggtgaaggcccccccctgcggcggcatgggcaacctgagaggcagaaccgccgtggtgaccggcgccaacagcggcatcggcaagatgaccgccctggagctggccagaagaggcgccagagtggtgctggcctgcagaagccaggagagaggcgaggccgccgccttcgacctgagacaggagagcggcaacaacgaggtgatcttcatggccctggacctggccagcctggccagcgtgagagccttcgccaccgccttcctgagcagcgagcccagactggacatcctgatccacaacgccggcatcagcagctgcggcagaaccagagaggccttcaacctgctgctgagagtgaaccacatcggccccttcctgctgacccacctgctgctgccctgcctgaaggcctgcgcccccagcagagtggtggtggtggccagcgccgcccactgcagaggcagactggacttcaagagactggacagacccgtggtgggctggagacaggagctgagagcctacgccgacaccaagctggccaacgtgctgttcgccagagagctggccaaccagctggaggccaccggcgtgacctgctacgccgcccaccccggccccgtgaacagcgagctgttcctgagacacgtgcccggctggctgagacccctgctgagacccctggcctggctggtgctgagagcccccagaggcggcgcccagacccccctgtactgcgccctgcaggagggcatcgagcccctgagcggcagatacttcgccaactgccacgtggaggaggtgccccccgccgccagagacgacagagccgcccacagactgtgggaggccagcaagagactggccggcctgggccccggcgaggacgccgagcccgacgaggacccccagagcgaggacagcgaggcccccagcagcctgagcaccccccaccccgaggagcccaccgtgagccagccctaccccagcccccagagcagccccgacctgagcaagatgacccacagaatccaggccaaggtggagcccgagatccagctgagctag

SEQ ID NO: 4217 - DNA, 381 bp, Artificial Sequence
  Description of Artificial Sequence: Synthetic coding sequence
atgatcagcttccacgtgatcttcctgagcctgggcagaggcaagctgttcctgcccgtgaacttctgcttcctgaagctgaagaacagccaggtgagaatccccaaggacttcacctgcaacctgcacgtgctgttcagaaccgtgcagggcgaggacagaaacaccatgttcagaggccactggagcatctacagcagaaacttccccctggccgtggtgcccgcctacgtgaccgaggacggcaagaacaccagccacagagccagcggccagttctgcaacgccctgagccagggcgagatccccagcagcctgcagctggtgaacagctacgccctggagcccagaaccgacatgccctgcaacttcctgacctag

SEQ ID NO: 4218 - DNA, 876 bp, Artificial Sequence
  Description of Artificial Sequence: Synthetic coding sequence
atggccgtgaccctgagcctgctgctgggcggcagagtgtgcgccgccgtgaccagatgcggcttcgccaccagaggcgtggccggccccggccccatcggcagagagcccgaccccgacagcgactgggagcccgaggagagagagctgcaggaggtggagagcaccctgaagagacagaagcaggccatcagattccagaagatcagaagacagatggaggcccccggcgccccccccagaaccctgacctgggaggccatggagcagatcagatacctgcacgaggagttccccgagagctggagcgtgcccagactggccgagggcttcgacgtgagcaccgacgtgatcagaagagtgctgaagagcaagttcctgcccaccctggagcagaagctgaagcaggaccagaaggtgctgaagaaggccggcctggcccacagcctgcagcacctgagaggcagcggcaacaccagcaagctgctgcccgccggccacagcgtgagcggcagcctgctgatgcccggccacgaggccagcagcaaggaccccaaccacagcaccgccctgaaggtgatcgagagcgacacccacagaaccaacacccccagaagaagaaagggcagaaacaaggagatccaggacctggaggagagcttcgtgcccgtggccgcccccctgggccaccccagagagctgcagaagtacagcagcgacagcgagagccccagaggcaccggcagcggcgccctgcccagcggccagaagctggaggagctgaaggccgaggagcccgacaacttcagcagcaaggtggtgcagagaggcagagagttcttcgacagcaacggcaacttcctgtacagaatctag

SEQ ID NO: 4219 - DNA, 2541 bp, Artificial Sequence
  Description of Artificial Sequence: Synthetic coding sequence
atgttcaagtgctggagcgtggtgctggtgctgggcttcatcttcctggagagcgagggcagacccaccaaggagggcggctacggcctgaagagctaccagcccctgatgagactgagacacaaggagaagaaccaggagagcagcagagtgaagggcttcatgatccaggacggccccttcggcagctgcgagaacaagtactgcggcctgggcagacactgcgtgaccagcagagagaccggccaggccgagtgcgcctgcatggacctgtgcaagagacactacaagcccgtgtgcggcagcgacggcgagttctacgagaaccactgcgaggtgcacagagccgcctgcctgaagaagcagaagatcaccatcgtgcacaacgaggactgcttcttcaagggcgacaagtgcaagaccaccgagtacagcaagatgaagaacatgctgctggacctgcagaaccagaagtacatcatgcaggagaacgagaaccccaacggcgacgacatcagcagaaagaagctgctggtggaccagatgttcaagtacttcgacgccgacagcaacggcctggtggacatcaacgagctgacccaggtgatcaagcaggaggagctgggcaaggacctgttcgactgcaccctgtacgtgctgctgaagtacgacgacttcaacgccgacaagcacctggccctggaggagttctacagagccttccaggtgatccagctgagcctgcccgaggaccagaagctgagcatcaccgccgccaccgtgggccagagcgccgtgctgagctgcgccatccagggcaccctgagaccccccatcatctggaagagaaacaacatcatcctgaacaacctggacctggaggacatcaacgacttcggcgacgacggcagcctgtacatcaccaaggtgaccaccacccacgtgggcaactacacctgctacgccgacggctacgagcaggtgtaccagacccacatcttccaggtgaacgtgccccccgtgatcagagtgtaccccgagagccaggccagagagcccggcgtgaccgccagcctgagatgccacgccgagggcatccccaagccccagctgggctggctgaagaacggcatcgacatcacccccaagctgagcaagcagctgaccctgcaggccaacggcagcgaggtgcacatcagcaacgtgagatacgaggacaccggcgcctacacctgcatcgccaagaacgaggccggcgtggacgaggacatcagcagcctgttcgtggaggacagcgccagaaagaccctggccaacatcctgtggagagaggagggcctgggcatcggcaacatgttctacgtgttctacgaggacggcatcaaggtgatccagcccatcgagtgcgagttccagagacacatcaagcccagcgagaagctgctgggcttccaggacgaggtgtgccccaaggccgagggcgacgaggtgcagagatgcgtgtgggccagcgccgtgaacgtgaaggacaagttcatctacgtggcccagcccaccctggacagagtgctgatcgtggacgtgcagagccagaaggtggtgcaggccgtgagcaccgaccccgtgcccgtgaagctgcactacgacaagagccacgaccaggtgtgggtgctgagctggggcaccctggagaagaccagccccaccctgcaggtgatcaccctggccagcggcaacgtgccccaccacaccatccacacccagcccgtgggcaagcagttcgacagagtggacgacttcttcatccccaccaccaccctgatcatcacccacatgagattcggcttcatcctgcacaaggacgaggccgccctgcagaagatcgacctggagaccatgagctacatcaagaccatcaacctgaaggactacaagtgcgtgccccagagcctggcctacacccacctgggcggctactacttcatcggctgcaagcccgacagcaccggcgccgtgagcccccaggtgatggtggacggcgtgaccgacagcgtgatcggcttcaacagcgacgtgaccggcaccccctacgtgagccccgacggccactacctggtgagcatcaacgacgtgaagggcctggtgagagtgcagtacatcaccatcagaggcgagatccaggaggccttcgacatctacaccaacctgcacatcagcgacctggccttccagcccagcttcaccgaggcccaccagtacaacatctacggcagcagcagcacccagaccgacgtgctgttcgtggagctgagcagcggcaaggtgaagatgatcaagagcctgaaggagcccctgaaggccgaggagtggccctggaacagaaagaacagacagatccaggacagcggcctgttcggccagtacctgatgacccccagcaaggacagcctgttcatcctggacggcagactgaacaagctgaactgcgagatcaccgaggtggagaagggcaacaccgtgatctgggtgggcgacgcctag

SEQ ID NO: 4220 - DNA, 291 bp, Artificial Sequence
  Description of Artificial Sequence: Synthetic coding sequence
atgagagtgaccagcgccacctgcgccctgctgctggccctgatctgcagcgtgcagctgggcgacgcctgcctggacatcgacaagctgctggccaacgtggtgttcgacgtgagccaggacctgctgaaggaggagctggccagatacaaccccagccccctgaccgaggagagcttcctgaacgtgcagcagtgcttcgccaacgtgagcgtgaccgagagattcgcccacagcgtggtgatcaagaagatcctgcagagcaacgactgcatcgaggccgccttctag

SEQ ID NO: 4221 - DNA, 1971 bp, Artificial Sequence
  Description of Artificial Sequence: Synthetic coding sequence
atgagaaccgtggtgctgaccatgaaggccagcgtgatcgagatgttcctggtgctgctggtgaccggcgtgcacagcaacaaggagaccgccaagaagatcaagagacccaagttcaccgtgccccagatcaactgcgacgtgaaggccggcaagatcatcgaccccgagttcatcgtgaagtgccccgccggctgccaggaccccaagtaccacgtgtacggcaccgacgtgtacgccagctacagcagcgtgtgcggcgccgccgtgcacagcggcgtgctggacaacagcggcggcaagatcctggtgagaaaggtggccggccagagcggctacaagggcagctacagcaacggcgtgcagagcctgagcctgcccagatggagagagagcttcatcgtgctggagagcaagcccaagaagggcgtgacctaccccagcgccctgacctacagcagcagcaagagccccgccgcccaggccggcgagaccaccaaggcctaccagagaccccccatccccggcaccaccgcccagcccgtgaccctgatgcagctgctggccgtgaccgtggccgtggccacccccaccaccctgcccagacccagccccagcgccgccagcaccaccagcatccccagaccccagagcgtgggccacagaagccaggagatggacctgtggagcaccgccacctacaccagcagccagaacagacccagagccgaccccggcctggtgcccaaggaggagctgagcacccagagcctggagcccgtgagcctgggcgaccccaactgcaagatcgacctgagcttcctgatcgacggcagcaccagcatcggcaagagaagattcagaatccagaagcagctgctggccgacgtggcccaggccctggacatcggccccgccggccccctgatgggcgtggtgcagtacggcgacaaccccgccacccacttcaacctgaagacccacaccaacagcagagacctgaagaccgccatcgagaagatcacccagagaggcggcctgagcaacgtgggcagagccatcagcttcgtgaccaagaacttcttcagcaaggccaacggcaacagaagcggcgcccccaacgtggtggtggtgatggtggacggctggcccaccgacaaggtggaggaggccagcagactggccagagagagcggcatcaacatcttcttcatcaccatcgagggcgccgccgagaacgagaagcagtacgtggtggagcccaacttcgccaacaaggccgtgtgcagaaccaacggcttctacagcctgcacgtgcagagctggttcggcctgcacaagaccctgcagcccctggtgaagagagtgtgcgacaccgacagactggcctgcagcaagacctgcctgaacagcgccgacatcggcttcgtgatcgacggcagcagcagcgtgggcaccggcaacttcagaaccgtgctgcagttcgtgaccaacctgaccaaggagttcgagatcagcgacaccgacaccagaatcggcgccgtgcagtacacctacgagcagagactggagttcggcttcgacaagtacagcagcaagcccgacatcctgaacgccatcaagagagtgggctactggagcggcggcaccagcaccggcgccgccatcaacttcgccctggagcagctgttcaagaagagcaagcccaacaagagaaagctgatgatcctgatcaccgacggcagaagctacgacgacgtgagaatccccgccatggccgcccacctgaagggcgtgatcacctacgccatcggcgtggcctgggccgcccaggaggagctggaggtgatcgccacccaccccgccagagaccacagcttcttcgtggacgagttcgacaacctgcaccagtacgtgcccagaatcatccagaacatctgcaccgagttcaacagccagcccagaaactag

SEQ ID NO: 4222 - DNA, 2082 bp, Artificial Sequence
  Description of Artificial Sequence: Synthetic coding sequence
atgagaaccgtggtgctgaccatgaaggccagcgtgatcgagatgttcctggtgctgctggtgaccggcgtgcacagcaacaaggagaccgccaagaagatcaagagacccaagttcaccgtgccccagatcaactgcgacgtgaaggccggcaagatcatcgaccccgagttcatcgtgaagtgccccgccggctgccaggaccccaagtaccacgtgtacggcaccgacgtgtacgccagctacagcagcgtgtgcggcgccgccgtgcacagcggcgtgctggacaacagcggcggcaagatcctggtgagaaaggtggccggccagagcggctacaagggcagctacagcaacggcgtgcagagcctgagcctgcccagatggagagagagcttcatcgtgctggagagcaagcccaagaagggcgtgacctaccccagcgccctgacctacagcagcagcaagagccccgccgcccaggccggcgagaccaccaaggcctaccagagaccccccatccccggcaccaccgcccagcccgtgaccctgatgcagctgctggccgtgaccgtggccgtggccacccccaccaccctgcccagacccagccccagcgccgccagcaccaccagcatccccagaccccagagcgtgggccacagaagccaggagatggacctgtggagcaccgccacctacaccagcagccagaacagacccagagccgaccccggcatccagagacaggaccccagcggcgccgccttccagaagcccgtgggcgccgacgtgagcctgggcgagatggacagctggaagcccggcagcgtgctgctggacgagggcctggtgcccaaggaggagctgagcacccagagcctggagcccgtgagcctgggcgaccccaactgcaagatcgacctgagcttcctgatcgacggcagcaccagcatcggcaagagaagattcagaatccagaagcagctgctggccgacgtggcccaggccctggacatcggccccgccggccccctgatgggcgtggtgcagtacggcgacaaccccgccacccacttcaacctgaagacccacaccaacagcagagacctgaagaccgccatcgagaagatcacccagagaggcggcctgagcaacgtgggcagagccatcagcttcgtgaccaagaacttcttcagcaaggccaacggcaacagaagcggcgcccccaacgtggtggtggtgatggtggacggctggcccaccgacaaggtggaggaggccagcagactggccagagagagcggcatcaacatcttcttcatcaccatcgagggcgccgccgagaacgagaagcagtacgtggtggagcccaacttcgccaacaaggccgtgtgcagaaccaacggcttctacagcctgcacgtgcagagctggttcggcctgcacaagaccctgcagcccctggtgaagagagtgtgcgacaccgacagactggcctgcagcaagacctgcctgaacagcgccgacatcggcttcgtgatcgacggcagcagcagcgtgggcaccggcaacttcagaaccgtgctgcagttcgtgaccaacctgaccaaggagttcgagatcagcgacaccgacaccagaatcggcgccgtgcagtacacctacgagcagagactggagttcggcttcgacaagtacagcagcaagcccgacatcctgaacgccatcaagagagtgggctactggagcggcggcaccagcaccggcgccgccatcaacttcgccctggagcagctgttcaagaagagcaagcccaacaagagaaagctgatgatcctgatcaccgacggcagaagctacgacgacgtgagaatccccgccatggccgcccacctgaagggcgtgatcacctacgccatcggcgtggcctgggccgcccaggaggagctggaggtgatcgccacccaccccgccagagaccacagcttcttcgtggacgagttcgacaacctgcaccagtacgtgcccagaatcatccagaacatctgcaccgagttcaacagccagcccagaaactag

SEQ ID NO: 4223 - DNA, 555 bp, Artificial Sequence
  Description of Artificial Sequence: Synthetic coding sequence
atgttctgcctgctgcacctgtgcttctacctggccaacttcgccagcagcatcaagagaacccacgccgtgaacggctgctgcggcctgcagatgatcgccctgtgggcccagagcagcggcaacgccgacgccagagtggaggagatcctggccggcgaggagagaagactggccgccctgctgggcagccagggcatgagattctgggtgtgcctggccgcctgcagagccatgtggggcctggccgccagaagaggcagagccgaggacagcagcagcagccccgtggacgccagcaagttcccctggagaggcggccagcacagaaccaccatgatgccctgcctgctgagagtgggcgtgttcagaccctgccacgtgagacccaccggcgaccccagctgcgacgtgcagccccccagactgggcttcagcagagtgcccgacacccaggtggccttctacggcagcggccactgggaccccacccccttcagcgtgcacagctgcttcttcaacttccaggtgagaaagatcatcttcctgctgtag

SEQ ID NO: 4224 - DNA, 864 bp, Artificial Sequence
  Description of Artificial Sequence: Synthetic coding sequence
atgaccagcgccgcccactactaccccaagctgatgagcatcatgggcaacgtgctgagattcctgcccgccttcgtgagaatgaagcagctgatcgaggagggctacgtgggcgagcccctggtgtgcgaggtgcaggtgcacggcggcagcctgctgggcaagaagtacaactggagctgcgacgacctgatgggcggcggcggcctgcacagcgtgggcacctacatcatcgacctgctgaccttcctgaccggccagaaggccgtgaaggtgcacggcctgctgaagaccttcgtgaagcagaccgaccacatcaagggcatcagacagatcaccagcgacgacttctgcaccttccagatggtgctggagggcggcgtgtgctgcaccgtgaccctgaacttcaacgtgcccggcgagttcaagcaggacgtgaccgtggtgggcagcgccggcagactgctggccgtgggcaccgacctgtacggccagagaaacagcgcccccgagcaggagctgctggtgcaggacgccacccccgtgagcaacagcctgctgcccgagaaggccttcagcgacatccccagcccctacctgagaggcaccatcaagatgatgcaggccgtgagacaggccttccaggaccaggacgacagaagaacctgggacggcagacccctgaccatggccgccaccttcgacgactgcctgtacgccctgtgcgtggtggacaccatcaagagaagcagccagaccggcgagtggcagaacatcgccatcatgaccgaggagcccgagctgagccccgcctacctgatcagcgaggccatgagaagaagcagaatgagcctgtactgctag

SEQ ID NO: 4225 - DNA, 1173 bp, Artificial Sequence
  Description of Artificial Sequence: Synthetic coding sequence
atgctgcccggcgtgggcgtgttcggcaccagcctgaccgccagagtgatcatccccctgctgaaggacgagggcttcgccgtgaaggccctgtggggcagaacccaggaggaggccgaggagctggccaaggagatgagcgtgcccttctacaccagcagaatcgacgaggtgctgctgcaccaggacgtggacctggtgtgcatcaacctgcccccccccctgaccagacagatcgccgtgaagaccctgggcatcggcaagaacgtgatctgcgacagaaccgccacccccctggacgccttcagaatgaccagcgccgcccactactaccccaagctgatgagcatcatgggcaacgtgctgagattcctgcccgccttcgtgagaatgaagcagctgatcgaggagggctacgtgggcgagcccctggtgtgcgaggtgcaggtgcacggcggcagcctgctgggcaagaagtacaactggagctgcgacgacctgatgggcggcggcggcctgcacagcgtgggcacctacatcatcgacctgctgaccttcctgaccggccagaaggccgtgaaggtgcacggcctgctgaagaccttcgtgaagcagaccgaccacatcaagggcatcagacagatcaccagcgacgacttctgcaccttccagatggtgctggagggcggcgtgtgctgcaccgtgaccctgaacttcaacgtgcccggcgagttcaagcaggacgtgaccgtggtgggcagcgccggcagactgctggccgtgggcaccgacctgtacggccagagaaacagcgcccccgagcaggagctgctggtgcaggacgccacccccgtgagcaacagcctgctgcccgagaaggccttcagcgacatccccagcccctacctgagaggcaccatcaagatgatgcaggccgtgagacaggccttccaggaccaggacgacagaagaacctgggacggcagacccctgaccatggccgccaccttcgacgactgcctgtacgccctgtgcgtggtggacaccatcaagagaagcagccagaccggcgagtggcagaacatcgccatcatgaccgaggagcccgagctgagccccgcctacctgatcagcgaggccatgagaagaagcagaatgagcctgtactgctag

SEQ ID NO: 4226 - DNA, 5718 bp, Artificial Sequence
  Description of Artificial Sequence: Synthetic coding sequence
atgcagagcagactgctgctgctgggcgcccccggcggccacggcggccccgccagcagaagaatgagactgctgctgagacaggtggtgcagagaagacccggcggcgacagacagagacccgaggtgagactgctgcacgccggcagcggcgccgacaccggcgacaccgtgaacatcggcgacgtgagctacaagctgaagatccccaagaaccccgagctggtgccccagaactacatcagcgacagcctggcccagagcgtggtgcagcacctgagatggatcatgcagaaggacctgctgggccaggacgtgttcctgatcggcccccccggccccctgagaagaagcatcgccatgcagtacctggagctgaccaagagagaggtggagtacatcgccctgagcagagacaccaccgagaccgacctgaagcagagaagagagatcagagccggcaccgccttctacatcgaccagtgcgccgtgagagccgccaccgagggcagaaccctgatcctggagggcctggagaaggccgagagaaacgtgctgcccgtgctgaacaacctgctggagaacagagagatgcagctggaggacggcagattcctgatgagcgccgagagatacgacaagctgctgagagaccacaccaagaaggagctggacagctggaagatcgtgagagtgagcgagaacttcagagtgatcgccctgggcctgcccgtgcccagatacagcggcaaccccctggacccccccctgagaagcagattccaggccagagacatctactacctgcccttcaaggaccagctgaagctgctgtacagcatcggcgccaacgtgagcgccgagaaggtgagccagctgctgagcttcgccaccaccctgtgcagccaggagagcagcaccctgggcctgcccgacttccccctggacagcctggccgccgccgtgcagatcctggacagcttccccatgatgcccatcaagcacgccatccagtggctgtacccctacagcatcctgctgggccacgagggcaagatggccgtggagggcgtgctgaagagattcgagctgcaggacagcggcagcagcctgctgcccaaggagatcgtgaaggtggagaagatgatggagaaccacgtgagccaggccagcgtgaccatcagaatcgccgacaaggaggtgaccatcaaggtgcccgccggcaccagactgctgagccagccctgcgccagcgacagattcatccagaccctgagccacaagcagctgcaggccgagatgatgcagagccacatggtgaaggacatctgcctgatcggcggcaagggctgcggcaagaccgtgatcgccaagaacttcgccgacaccctgggctacaacatcgagcccatcatgctgtaccaggacatgaccgccagagacctgctgcagcagagatacaccctgcccaacggcgacaccgcctggagaagcagccccctggtgaacgccgccctggagggcaagctggtgctgctggacggcatccacagagtgaacgccggcaccctggccgtgctgcagagactgatccacgacagagagctgagcctgtacgacggcagcagactgctgagagaggacagatacatgagactgaaggaggagctgcagctgagcgacgagcagctgcagaagagaagcatcttccccatccaccccagcttcagaatcatcgccctggccgagccccccgtgatcggcagcaccgcccaccagtggctgggccccgagttcctgaccatgttcttcttccactacatgaagcccctggtgaagagcgaggagatccaggtgatcaaggagaaggtgcccaacgtgccccaggaggccctggacaagctgctgagcttcacccacaagctgagagagacccaggaccccaccgcccagagcctggccgccagcctgagcaccagacagctgctgagaatcagcagaagactgagccagtaccccaacgagaacctgcacagcgccgtgaccaaggcctgcctgagcagattcctgcccagcctggccagaagcgccctggagaagaacctggccgacgccaccatcgagatcaacaccgacgacaacctggagcccgagctgaaggactacaagtgcgaggtgaccagcggcaccctgagaatcggcgccgtgagcgcccccatctacaacgcccacgagaagatgaaggtgcccgacgtgctgttctacgacaacatccagcacgtgatcgtgatggaggacatgctgaaggacttcctgctgggcgagcacctgctgctggtgggcaaccagggcgtgggcaagaacaagatcgtggacagattcctgcacctgctgaacagacccagagagtacatccagctgcacagagacaccaccgtgcagaccctgaccctgcagcccagcgtgaaggacggcctgatcgtgtacgaggacagccccctggtgaaggccgtgaagctgggccacatcctggtggtggacgaggccgacaaggcccccaccaacgtgacctgcatcctgaagaccctggtggagaacggcgagatgatcctggccgacggcagaagaatcgtggccaacagcgccaacgtgaacggcagagagaacgtggtggtgatccaccccgacttcagaatgatcgtgctggccaacagacccggcttccccttcctgggcaacgacttcttcggcaccctgggcgacatcttcagctgccacgccgtggacaaccccaagccccacagcgagctggagatgctgagacagtacggccccaacgtgcccgagcccatcctgcagaagctggtggccgccttcggcgagctgagaagcctggccgaccagggcatcatcaactacccctacagcaccagagaggtggtgaacatcgtgaagcacctgcagaagttccccaccgagggcctgagcagcgtggtgagaaacgtgttcgacttcgacagctacaacaacgacatgagagagatcctgatcaacaccctgcacaagtacggcatccccatcggcgccaagcccaccagcgtgcagctggccaaggagctgaccctgcccgagcagaccttcatgggctactggaccatcggccaggccagaagcggcatgcagaagctgctgtgccccgtggagacccaccacatcgacatcaagggccccgccctgatcaacatccaggagtaccccatcgagagacacgaggagagaagcctgaacttcaccgaggagtgcgccagctggagaatccccctggacgagatcaacatcatctgcgacatcgccaccagccacgagaacgagcagaacaccctgtacgtggtgacctgcaaccccgccagcctgtacttcatgaacatgaccggcaagagcggcttcttcgtggacttcttcgacatcttccccagaaccgccaacggcgtgtggcaccccttcgtgaccgtggcccccctgggcagccccctgaagggccaggtggtgctgcacgagcagcagagcaacgtgatcctgctgctggacaccaccggcagagccctgcacagactgatcctgcccagcgagaagttcaccagcaagaagcccttctggtggaacaaggaggaggccgagacctacaagatgtgcaaggagttcagccacaagaactggctggtgttctacaaggagaagggcaacagcctgaccgtgctggacgtgctggagggcagaacccacaccatcagcctgcccatcaacctgaagaccgtgttcctggtggccgaggacaagtggctgctggtggagagcaagaccaaccagaagtacctgctgaccaagcccgcccacatcgagagcgagggcagcggcgtgtgccagctgtacgtgctgaaggaggagccccccagcaccggcttcggcgtgacccaggagaccgagttcagcatcccccacaagatcagcagcgaccagctgagcagcgagcacctgagcagcgccgtggagcagaagatcgccagccccaacagaatcctgagcgacgagaagaactacgccaccatcgtggtgggcttccccgacctgatgagccccagcgaggtgtacagctggaagagacccagcagcctgcacaagagaagcggcaccgacaccagcttctacagaggcaagaagaagagaggcacccccaagcagagcaactgcgtgaccctgctggacaccaaccaggtggtgagaatcctgccccccggcgaggtgcccctgaaggacatctaccccaaggacgtgacccccccccagaccagcggctacatcgaggtgaccgacctgcagagcaagaagctgagatacatccccatccccagaagcgagagcctgagcccctacaccacctggctgagcaccatcagcgacaccgacgccctgctggccgagtgggacaagagcggcgtggtgaccgtggacatgggcggccacatcagactgtgggagaccggcctggagagactgcagagaagcctgatggagtggagaaacatgatcggccaggacgacagaaacatgcagatcaccatcaacagagacagcggcgaggacgtgagcagccccaagcacggcaaggaggaccccgacaacatgccccacgtgggcggcaacacctgggccggcggcaccggcggcagagacaccgccggcctgggcggcaagggcggcccctacagactggacgccggccacaccgtgtaccaggtgagccaggccgagaaggacgccgtgcccgaggaggtgaagagagccgccagagagatgggccagagagccttccagcagagactgaaggagatccagatgagcgagtacgacgccgccacctacgagagattcagcggcgccgtgagaagacaggtgcacagcctgagaatcatcctggacaacctgcaggccaagggcaaggagagacagtggctgagacaccaggccaccggcgagctggacgacgccaagatcatcgacggcctgaccggcgagaaggccatctacaagagaagaggcgagctggagccccagctgggcagcccccagcagaagcccaagagactgagactggtggtggacgtgagcggcagcatgtacagattcaacagaatggacggcagactggagagaaccatggaggccgtgtgcatggtgatggaggccttcgagaactacgaggagaagttccagtacgacatcgtgggccacagcggcgacggctacaacatcggcctggtgcccatgaacaagatccccaaggacaacaagcagagactggagatcctgaagaccatgcacgcccacagccagttctgcatgagcggcgaccacaccctggagggcaccgagcacgccatcaaggagatcgtgaaggaggaggccgacgagtacttcgtgatcgtgctgagcgacgccaacctgagcagatacggcatccaccccgccaagttcgcccagatcctgaccagagacccccaggtgaacgccttcgccatcttcatcggcagcctgggcgaccaggccaccagactgcagagaaccctgcccgccggcagaagcttcgtggccatggacaccaaggacatcccccagatcctgcagcagatcttcaccagcaccatgctgagcagcgtgtag

SEQ ID NO: 4227 - DNA, 561 bp, Artificial Sequence
  Description of Artificial Sequence: Synthetic coding sequence
atggaggccctgcccctgctggccgccaccacccccgaccacggcagacacagaagactgctgctgctgcccctgctgctgttcctgctgcccgccggcgccgtgcagggctgggagaccgaggagagacccagaaccagagaggaggagtgccacttctacgccggcggccaggtgtaccccggcgaggccagcagagtgagcgtggccgaccacagcctgcacctgagcaaggccaagatcagcaagcccgccccctactgggagggcaccgccgtgatcgacggcgagttcaaggagctgaagctgaccgactacagaggcaagtacctggtgttcttcttctaccccctggacttcaccttcgtgtgccccaccgagatcatcgccttcggcgacagactggaggagttcagaagcatcaacaccgaggtggtggcctgcagcgtggacagccagttcacccacctggcctggagcgtgagctacacctacatcagaagaaagaagagaatggacctgctgctgaagcacggccagatcaccctggacatgatctag

SEQ ID NO: 4228 - DNA, 816 bp, Artificial Sequence
  Description of Artificial Sequence: Synthetic coding sequence
atggaggccctgcccctgctggccgccaccacccccgaccacggcagacacagaagactgctgctgctgcccctgctgctgttcctgctgcccgccggcgccgtgcagggctgggagaccgaggagagacccagaaccagagaggaggagtgccacttctacgccggcggccaggtgtaccccggcgaggccagcagagtgagcgtggccgaccacagcctgcacctgagcaaggccaagatcagcaagcccgccccctactgggagggcaccgccgtgatcgacggcgagttcaaggagctgaagctgaccgactacagaggcaagtacctggtgttcttcttctaccccctggacttcaccttcgtgtgccccaccgagatcatcgccttcggcgacagactggaggagttcagaagcatcaacaccgaggtggtggcctgcagcgtggacagccagttcacccacctggcctggatcaacacccccagaagacagggcggcctgggccccatcagaatccccctgctgagcgacctgacccaccagatcagcaaggactacggcgtgtacctggaggacagcggccacaccctgagaggcctgttcatcatcgacgacaagggcatcctgagacagatcaccctgaacgacctgcccgtgggcagaagcgtggacgagaccctgagactggtgcaggccttccagtacaccgacaagcacggcgaggtgtgccccgccggctggaagcccggcagcgagaccatcatccccgaccccgccggcaagctgaagtacttcgacaagctgaactag

SEQ ID NO: 4229 - DNA, 558 bp, Artificial Sequence
  Description of Artificial Sequence: Synthetic coding sequence
atggaccacagaagcagactgagaggcaccggcctgaacagaatccccggcacccagagcagagcccccagagtgcccctgcccttccacgtgcagcaggaggccagagagggcgaggactgggagagagagccccccagacagagaccccccatctacgagccccccgagagcgaggagctgcccgacaacgtgatggtgagcaagcccgccccctactgggagggcaccgccgtgatcgacggcgagttcaaggagctgaagctgaccgactacagaggcaagtacctggtgttcttcttctaccccctggacttcaccttcgtgtgccccaccgagatcatcgccttcggcgacagactggaggagttcagaagcatcaacaccgaggtggtggcctgcagcgtggacagccagttcacccacctggcctggatcaacacccccagaagacagggcggcctgggccccatcagaatccccctgctgagcgacctgacccaccagatcagcaaggactacggcgtgtacctggaggacagcggccacaccctgtag

SEQ ID NO: 4230 - DNA, 843 bp, Artificial Sequence
  Description of Artificial Sequence: Synthetic coding sequence
atggccagattctgggtgtgcgtggccggcgccggcttcttcctggccttcctggtgctgcacagcagattctgcggcagccccgtgctgagaaacttcaccttcgccgtgagctggagaaccgagaagatcctgtacagactggacgtgggctggcccaagcaccccgagtacttcaccggcaccaccttctgcgtggccgtggacagcctgaacggcctggtgtacatcggccagagaggcgacaacatccccaagatcctggtgttcaccgaggacggctacttcctgagagcctggaactacaccgtggacaccccccacggcatcttcgccgccagcaccctgtacgagcagagcgtgtggatcaccgacgtgggcagcgacttcatgatcctgtggctgcacggcgagaacggcaccggccccgccaagttcaacatcccccacagcgtgaccctggacagcgccggcagagtgtgggtggccgacagaggcaacaagagaatccaggtgttcgacaaggacaccggcgagtggctgggcgcctggaacaactgcttcaccgaggagggccccagcagcgtgagattcacccccgacggcaagtacctgatcgtggcccagctgaacctgagcagactgagcgtggtggccgccccccccgtgggcagcatcggcgagtgcagcgtgatcagcaccatccagctggccgaccaggtgctgccccacctgctggaggtggacagaaagaccggcgccgtgtacgtggccgagatcggcgccaagcaggtgcagaagtacgtgcccctgaacagctacgtgcccagcttcggcagctag

SEQ ID NO: 4231 - DNA, 1044 bp, Artificial Sequence
  Description of Artificial Sequence: Synthetic coding sequence
atggccagattctgggtgtgcgtggccggcgccggcttcttcctggccttcctggtgctgcacagcagattctgcggcagccccgtgctgagaaacttcaccttcgccgtgagctggagaaccgagaagatcctgtacagactggacgtgggctggcccaagcaccccgagtacttcaccggcaccaccttctgcgtggccgtggacagcctgaacggcctggtgtacatcggccagagaggcgacaacatccccaagatcctggtgttcaccgaggacggctacttcctgagagcctggaactacaccgtggacaccccccacggcatcttcgccgccagcaccctgtacgagcagagcgtgtggatcaccgacgtgggcagcggcttcttcggccacaccgtgaagaagtacagcagcttcggcgacctggtgcaggtgctgggcacccccggcaagaagggcaccagcctgaaccccctgcagttcgacaaccccgccgagctgtacgtggaggacaccggcgacatctacatcgtggacggcgacggcggcctgaacaacagactgatcaagctgagccaggacttcatgatcctgtggctgcacggcgagaacggcaccggccccgccaagttcaacatcccccacagcgtgaccctggacagcgccggcagagtgtgggtggccgacagaggcaacaagagaatccaggtgttcgacaaggacaccggcgagtggctgggcgcctggaacaactgcttcaccgaggagggccccagcagcgtgagattcacccccgacggcaagtacctgatcgtggcccagctgaacctgagcagactgagcgtggtggccgccccccccgtgggcagcatcggcgagtgcagcgtgatcagcaccatccagctggccgaccaggtgctgccccacctgctggaggtggacagaaagaccggcgccgtgtacgtggccgagatcggcgccaagcaggtgcagaagtacgtgcccctgaacagctacgtgcccagcttcggcagctag

SEQ ID NO: 4232 - DNA, 1707 bp, Artificial Sequence
  Description of Artificial Sequence: Synthetic coding sequence
atggtgctgctgcactggtgcctgctgtggctgctgttccccctgagcagcagaacccagaagctgcccaccagagacgaggagctgttccagatgcagatcagagacaaggccttcttccacgacagcagcgtgatccccgacggcgccgagatcagcagctacctgttcagagacacccccaagagatacttcttcgtggtggaggaggacaacacccccctgagcgtgaccgtgaccccctgcgacgcccccctggagtggaagctgagcctgcaggagctgcccgaggacagaagcggcgagggcagcggcgacctggagcccctggagcagcagaagcagcagatcatcaacgaggagggcaccgagctgttcagctacaagggcaacgacgtggagtacttcatcagcagcagcagccccagcggcctgtaccagctggacctgctgagcaccgagaaggacacccacttcaaggtgtacgccaccaccacccccgagagcgaccagccctaccccgagctgccctacgaccccagagtggacgtgaccagcctgggcagaaccaccgtgaccctggcctggaagcccagccccaccgccagcctgctgaagcagcccatccagtactgcgtggtgatcaacaaggagcacaacttcaagagcctgtgcgccgtggaggccaagctgagcgccgacgacgccttcatgatggcccccaagcccggcctggacttcagccccttcgacttcgcccacttcggcttccccagcgacaacagcggcaaggagagaagcttccaggccaagcccagccccaagctgggcagacacgtgtacagcagacccaaggtggacatccagaagatctgcatcggcaacaagaacatcttcaccgtgagcgacctgaagcccgacacccagtactacttcgacgtgttcgtggtgaacatcaacagcaacatgagcaccgcctacgtgggcaccttcgccagaaccaaggaggaggccaagcagaagaccgtggagctgaaggacggcaagatcaccgacgtgttcgtgaagagaaagggcgccaagttcctgagattcgcccccgtgagcagccaccagaaggtgaccttcttcatccacagctgcctggacgccgtgcagatccaggtgagaagagacggcaagctgctgctgagccagaacgtggagggcatccagcagttccagctgagaggcaagcccaaggccaagtacctggtgagactgaagggcaacaagaagggcgccagcatgctgaagatcctggccaccaccagacccaccaagcagagcttccccagcctgcccgaggacaccagaatcaaggccttcgacaagctgagaacctgcagcagcgccaccgtggcctggctgggcacccaggagagaaacaagttctgcatctacaagaaggaggtggacgacaactacaacgaggaccagaagaagagagagcagaaccagtgcctgggccccgacatcagaaagaagagcgagaaggtgctgtgcaagtacttccacagccagaacctgcagaaggccgtgaccaccgagaccatcaagggcctgcagcccggcaagagctacctgctggacgtgtacgtgatcggccacggcggccacagcgtgaagtaccagagcaaggtggtgaagaccagaaagttctgctag

SEQ ID NO: 4233 - DNA, 489 bp, Artificial Sequence
  Description of Artificial Sequence: Synthetic coding sequence
atgaagggcttcaccgccaccctgttcctgtggaccctgatcttccccagctgcagcggcggcggcggcggcaaggcctggcccacccacgtggtgtgcagcgacagcggcctggaggtgctgtaccagagctgcgaccccctgcaggacttcggcttcagcgtggagaagtgcagcaagcagctgaagagcaacatcaacatcagattcggcatcatcctgagagaggacatcaaggagctgttcctggacctggccctgatgagccagggcagcagcgtgctgaacttcagctaccccatctgcgaggccgccctgcccaagttcagcttctgcggcagaagaaagggcgagcagatctactacgccggccccgtgaacaaccccgagttcaccatcccccagggcgagtaccaggtgctgctggagctgtacaccgagaagagaagcaccgtggcctgcgccaacgccaccatcatgtgcagctag

SEQ ID NO: 4234 - DNA, 1698 bp, Artificial Sequence
  Description of Artificial Sequence: Synthetic coding sequence
atggacttcctgctggccctggtgctggtgagcagcctgtacctgcaggccgccgccgagttcgacggcagatggcccagacagatcgtgagcagcatcggcctgtgcagatacggcggcagaatcgactgctgctggggctgggccagacagagctggggccagtgccagcccgtgtgccagcccagatgcaagcacggcgagtgcatcggccccaacaagtgcaagtgccaccccggctacgccggcaagacctgcaaccaggacctgaacgagtgcggcctgaagcccagaccctgcaagcacagatgcatgaacacctacggcagctacaagtgctactgcctgaacggctacatgctgatgcccgacggcagctgcagcagcgccctgacctgcagcatggccaactgccagtacggctgcgacgtggtgaagggccagatcagatgccagtgccccagccccggcctgcagctggcccccgacggcagaacctgcgtggacgtggacgagtgcgccaccggcagagccagctgccccagattcagacagtgcgtgaacaccttcggcagctacatctgcaagtgccacaagggcttcgacctgatgtacatcggcggcaagtaccagtgccacgacatcgacgagtgcagcctgggccagtaccagtgcagcagcttcgccagatgctacaacatcagaggcagctacaagtgcaagtgcaaggagggctaccagggcgacggcctgacctgcgtgtacatccccaaggtgatgatcgagcccagcggccccatccacgtgcccaagggcaacggcaccatcctgaagggcgacaccggcaacaacaactggatccccgacgtgggcagcacctggtggccccccaagaccccctacatcccccccatcatcaccaacagacccaccagcaagcccaccaccagacccacccccaagcccacccccatccccaccccccccccccccccccccctgcccaccgagctgagaacccccctgccccccaccacccccgagagacccaccaccggcctgaccaccatcgcccccgccgccagcaccccccccggcggcatcaccgtggacaacagagtgcagaccgacccccagaagcccagaggcgacgtgttcatccccagacagcccagcaacgacctgttcgagatcttcgagatcgagagaggcgtgagcgccgacgacgaggccaaggacgaccccggcgtgctggtgcacagctgcaacttcgaccacggcctgtgcggctggatcagagagaaggacaacgacctgcactgggagcccatcagagaccccgccggcggccagtacctgaccgtgagcgccgccaaggcccccggcggcaaggccgccagactggtgctgcccctgggcagactgatgcacagcggcgacctgtgcctgagcttcagacacaaggtgaccggcctgcacagcggcaccctgcaggtgttcgtgagaaagcacggcgcccacggcgccgccctgtggggcagaaacggcggccacggctggagacagacccagatcaccctgagaggcgccgacatcaagagcgtggtgttcaagggcgagaagagaagaggccacaccggcgagatcggcctggacgacgtgagcctgaagaagggccactgcagcgaggagagatag

SEQ ID NO: 4235 - DNA, 1413 bp, Artificial Sequence
  Description of Artificial Sequence: Synthetic coding sequence
atgaagagaagcgtggccgtgtggctgctggtgggcctgagcctgggcgtgccccagttcggcaagggcgacatctgcgaccccaacccctgcgagaacggcggcatctgcctgcccggcctggccgacggcagcttcagctgcgagtgccccgacggcttcaccgaccccaactgcagcagcgtggtggaggtgggcccctgcacccccaacccctgccacaacggcggcacctgcgagatcagcgaggcctacagaggcgacaccttcatcggctacgtgtgcaagtgccccagaggcttcaacggcatccactgccagcacaacatcaacgagtgcgaggtggagccctgcaagaacggcggcatctgcaccgacctggtggccaactacagctgcgagtgccccggcgagttcatgggcagaaactgccagtacaagtgcagcggccccctgggcatcgagggcggcatcatcagcaaccagcagatcaccgccagcagcacccacagagccctgttcggcctgcagaagtggtacccctactacgccagactgaacaagaagggcctgatcaacgcctggaccgccgccgagaacgacagatggccctggatccagatcaacctgcagagaaagatgagagtgaccggcgtgatcacccagggcgccaagagaatcggcagccccgagtacatcaagagctacaagatcgcctacagcaacgacggcaagacctgggccatgtacaaggtgaagggcaccaacgaggacatggtgttcagaggcaacatcgacaacaacaccccctacgccaacagcttcaccccccccatcaaggcccagtacgtgagactgtacccccaggtgtgcagaagacactgcaccctgagaatggagctgctgggctgcgagctgagcggctgcagcgagcccctgggcatgaagagcggccacatccaggactaccagatcaccgccagcagcatcttcagaaccctgaacatggacatgttcacctgggagcccagaaaggccagactggacaagcagggcaaggtgaacgcctggaccagcggccacaacgaccagagccagtggctgcaggtggacctgctggtgcccaccaaggtgaccggcatcatcacccagggcgccaaggacttcggccacgtgcagttcgtgggcagctacaagctggcctacagcaacgacggcgagcactggaccgtgtaccaggacgagaagcagagaaaggacaaggtgttccagggcaacttcgacaacgacacccacagaaagaacgtgatcgacccccccatctacgccagacacatcagaatcctgccctggagctggtacggcagaatcaccctgagaagcgagctgctgggctgcaccgaggaggagtag

SEQ ID NO: 4236 - DNA, 1254 bp, Artificial Sequence
  Description of Artificial Sequence: Synthetic coding sequence
atggccagctacctgtacggcgtgctgttcgccgtgggcctgtgcgcccccatctactgcgtgagccccgccaacgcccccagcgcctaccccagacccagcagcaccaagagcacccccgccagccaggtgtacagcctgaacaccgacttcgccttcagactgtacagaagactggtgctggagacccccagccagaacatcttcttcagccccgtgagcgtgagcaccagcctggccatgctgagcctgggcgcccacagcgtgaccaagacccagatcctgcagggcctgggcttcaacctgacccacacccccgagagcgccatccaccagggcttccagcacctggtgcacagcctgaccgtgcccagcaaggacctgaccctgaagatgggcagcgccctgttcgtgaagaaggagctgcagctgcaggccaacttcctgggcaacgtgaagagactgtacgaggccgaggtgttcagcaccgacttcagcaaccccagcatcgcccaggccagaatcaacagccacgtgaagaagaagacccagggcaaggtggtggacatcatccagggcctggacctgctgaccgccatggtgctggtgaaccacatcttcttcaaggccaagtgggagaagcccttccaccccgagtacaccagaaagaacttccccttcctggtgggcgagcaggtgaccgtgcacgtgcccatgatgcaccagaaggagcagttcgccttcggcgtggacaccgagctgaactgcttcgtgctgcagatggactacaagggcgacgccgtggccttcttcgtgctgcccagcaagggcaagatgagacagctggagcaggccctgagcgccagaaccctgagaaagtggagccacagcctgcagaagagatggatcgaggtgttcatccccagattcagcatcagcgccagctacaacctggagaccatcctgcccaagatgggcatccagaacgtgttcgacaagaacgccgacttcagcggcatcgccaagagagacagcctgcaggtgagcaaggccacccacaaggccgtgctggacgtgagcgaggagggcaccgaggccaccgccgccaccaccaccaagttcatcgtgagaagcaaggacggccccagctacttcaccgtgagcttcaacagaaccttcctgatgatgatcaccaacaaggccaccgacggcatcctgttcctgggcaaggtggagaaccccaccaagagctag

SEQ ID NO: 4237 - DNA, 486 bp, Artificial Sequence
  Description of Artificial Sequence: Synthetic coding sequence
atgctgatgcccgtgcacttcctgctgctgctgctgctgctgctgggcggccccagaaccggcctgccccacaagttctacaaggccaagcccatcttcagctgcctgaacaccgccctgagcgaggccgagaagggccagtgggaggacgccagcctgctgagcaagagaagcttccactacctgagaagcagagacgccagcagcggcgaggaggaggagggcaaggagaagaagaccttccccatcagcggcgccagaggcggcgccagaggcaccagatacagatacgtgagccaggcccagcccagaggcaagcccagacaggacaccgccaagagcccccacagaaccaagttcaccctgagcctggacgtgcccaccaacatcatgaacctgctgttcaacatcgccaaggccaagaacctgagagcccaggccgccgccaacgcccacctgatggcccagatcggcagaaagaagtag

SEQ ID NO: 4238 - DNA, 2091 bp, Artificial Sequence
  Description of Artificial Sequence: Synthetic coding sequence
atggccatggccagactgggcagctggctgggcgaggcccagtggctggccctggtgagcctgttcgtggccgccctggccaccgtgggcctgtacctggcccagtgggccctggccagagccagaccccagccccagagaagagccgtggagcccggcgagggccccagacccggcagcgacgccctgctgagctggatcctgaccctgggcagctggagaagccagtggcaggccgcctgggtgaccgccctgaacgaggaggccgagagaaagggcggcccccccttcctgagcttcgaggaggaccccagacagcaggccctggagctggtggtgcaggaggtgagcagcgtgctgagaagcgccgaggagaaggtggtggtgtgccacgtggtgggccaggccatccagttcctggtgagcgagacccccgccctgggcgccggctgcagactgtacgacatgagactgagccccttccacctgcagctggagttccacatgaaggagaagagagaggacctgcagatcagctggagcttcatcagcgtgcccgagatggccgtgaacatccagcccaaggccctgggcgaggaccaggtggccgagaccagcgccatgagcgacgtgctgaaggacatcctgaagcacctggccggcagcgccagccccagcgtggtgctgatcaccaagcccaccaccgtgaaggaggcccagaacctgcagtgcgccgccagcaccgcccaggagagctgcccccccaagccccccagagcccacgagctgaagctgctggtgagaaacatccacgtgctgctgctgagcgagcccggcgccagcggccacatcaacgccgtgtgcgtggtgcagctgaacgaccccgtgcagagattcagcagcaccctgaccaagaacacccccgacctgatgtgggaggaggagttcaccttcgagctgaacgccaagagcaaggagctgcacctgcagatcagcgaggccggcagaagcagcgagggcctgctggccaccgccaccgtgcccctggacctgttcaagaagcagcccagcggcccccagagcttcaccctgaccagcggcagcgcctgcggcagcagcgtgctgggcagcgtgaccgccgagttcagctacatggagcccggcgagctgaagagctggcccatccccccccccgtgcccgccgccaagatcgagaaggacagaaccgtgatgccctgcggcaccgtggtgaccaccgtgaccgccgtgaagaccaagcccagagtggacgtgggcagagccagccccctgagcagcgacagccccgtgaagacccccatcaaggtgaaggtgatcgagaaggacatcagcgtgcaggccatcgcctgcagaagcgcccccgtgagcaagaccctgagcagcagcgacaccgagctgctggtgctgaacggcagcgaccccgtggccgaggtggccatcagacagctgagcgagagcagcaagctgaagctgaagagccccagaaagaagagcaccatcatcatcagcggcatcagcaagaccagcctgagccaggaccacgacgccgccctgatgcagggctacaccgccagcgtggacagcacccaccaggaggacgcccccagccaccccgagagagccgccgccagcgccccccccgaggaggccgagagcgcccaggccagcctggcccccaagccccaggaggacgagctggacagctgggacctggagaaggagccccaggccgccgcctggagcagccaggtgctgctggaccccgacggcgacgagctgagcgagagcagcatgagcgtgctggagcccggcaccgccaagaagcacaagggcggcatcctgagaaagggcgccaagctgttcttcagaagaagacaccagcagaaggaccccggcatgagccagagccacaacgacctggtgttcctggagcagcccgagggcagcagaagaaagggcatcaccctgaccagaatcctgaacaagaagctgctgagcagacacagaaacaagaacaccatgaacggcgcccccgtggagccctgcacctag

SEQ ID NO: 4239 - DNA, 669 bp, Artificial Sequence
  Description of Artificial Sequence: Synthetic coding sequence
atgcccgccagcagccccttcctgctggcccccaagggcccccccggcaacatgggcggccccgtgagagagcccgccctgagcgtggccctgtggctgagctggggcgccgccctgggcgccgtggcctgcgccatggccctgctgacccagcagaccgagctgcagagcctgagaagagaggtgagcagactgcagggcaccggcggccccagccagaacggcgagggctacccctggcagagcctgcccgagcagcacagcgtgctgcacctggtgcccatcaacgccaccagcaaggacgacagcgacgtgaccgaggtgatgtggcagcccgccctgagaagaggcagaggcctgcaggcccagggctacggcgtgagaatccaggacgccggcgtgtacctgctgtacagccaggtgctgttccaggacgtgaccttcaccatgggccaggtggtgagcagagagggccagggcagacaggagaccctgttcagatgcatcagaagcatgcccagccaccccgacagagcctacaacagctgctacagcgccggcgtgttccacctgcaccagggcgacatcctgagcgtgatcatccccagagccagagccaagctgaacctgagcccccacggcaccttcctgggcttcgtgaagctgtag

SEQ ID NO: 4240 - DNA, 2205 bp, Artificial Sequence
  Description of Artificial Sequence: Synthetic coding sequence
atgtggggcctgctgctggccctggccgccttcgcccccgccgtgggccccgccctgggcgcccccagaaacagcgtgctgggcctggcccagcccggcaccaccaaggtgcccggcagcacccccgccctgcacagcagccccgcccagccccccgccgagaccgccaacggcaccagcgagcagcacgtgagaatcagagtgatcaagaagaagaaggtgatcatgaagaagagaaagaagctgaccctgaccagacccacccccctggtgaccgccggccccctggtgacccccacccccgccggcaccctggaccccgccgagaagcaggagaccggctgcccccccctgggcctggagagcctgagagtgagcgacagcagactggaggccagcagcagccagagcttcggcctgggcccccacagaggcagactgaacatccagagcggcctggaggacggcgacctgtacgacggcgcctggtgcgccgaggagcaggacgccgacccctggttccaggtggacgccggccaccccaccagattcagcggcgtgatcacccagggcagaaacagcgtgtggagatacgactgggtgaccagctacaaggtgcagttcagcaacgacagcagaacctggtggggcagcagaaaccacagcagcggcatggacgccgtgttccccgccaacagcgaccccgagacccccgtgctgaacctgctgcccgagccccaggtggccagattcatcagactgctgccccagacctggctgcagggcggcgccccctgcctgagagccgagatcctggcctgccccgtgagcgaccccaacgacctgttcctggaggcccccgccagcggcagcagcgaccccctggacttccagcaccacaactacaaggccatgagaaagctgatgaagcaggtgcaggagcagtgccccaacatcaccagaatctacagcatcggcaagagctaccagggcctgaagctgtacgtgatggagatgagcgacaagcccggcgagcacgagctgggcgagcccgaggtgagatacgtggccggcatgcacggcaacgaggccctgggcagagagctgctgctgctgctgatgcagttcctgtgccacgagttcctgagaggcaaccccagagtgaccagactgctgagcgagatgagaatccacctgctgcccagcatgaaccccgacggctacgagatcgcctaccacagaggcagcgagctggtgggctgggccgagggcagatggaacaaccagagcatcgacctgaaccacaacttcgccgacctgaacacccccctgtgggaggcccaggacgacggcaaggtgccccacatcgtgcccaaccaccacctgcccctgcccacctactacaccctgcccaacgccaccgtggcccccgagaccagagccgtgatcaagtggatgaagagaatccccttcgtgctgagcgccaacctgcacggcggcgagctggtggtgagctaccccttcgacatgaccagaaccccctgggccgccagagagctgacccccacccccgacgacgccgtgttcagatggctgagcaccgtgtacgccggcagcaacctggccatgcaggacaccagcagaagaccctgccacagccaggacttcagcgtgcacggcaacatcatcaacggcgccgactggcacaccgtgcccggcagcatgaacgacttcagctacctgcacaccaactgcttcgaggtgaccgtggagctgagctgcgacaagttcccccacgagaacgagctgccccaggagtgggagaacaacaaggacgccctgctgacctacctggagcaggtgagaatgggcatcgccggcgtggtgagagacaaggacaccgagctgggcatcgccgacgccgtgatcgccgtggacggcatcaaccacgacgtgaccaccgcctggggcggcgactactggagactgctgacccccggcgactacatggtgaccgccagcgccgagggctaccacagcgtgaccagaaactgcagagtgaccttcgaggagggccccttcccctgcaacttcgtgctgaccaagacccccaagcagagactgagagagctgctggccgccggcgccaaggtgccccccgacctgagaagaagactggagagactgagaggccagaaggactag

SEQ ID NO: 4241 - DNA, 759 bp, Artificial Sequence
  Description of Artificial Sequence: Synthetic coding sequence
atgagagcccccctgctgccccccgcccccgtggtgctgagcctgctgatcctgggcagcggccactacgccgccggcctggacctgaacgacacctacagcggcaagagagagcccttcagcggcgaccacagcgccgacggcttcgaggtgaccagcagaagcgagatgagcagcggcagcgagatcagccccgtgagcgagatgcccagcagcagcgagcccagcagcggcgccgactacgactacagcgaggagtacgacaacgagccccagatccccggctacatcgtggacgacagcgtgagagtggagcaggtggtgaagcccccccagaacaagaccgagagcgagaacaccagcgacaagcccaagagaaagaagaagggcggcaagaacggcaagaacagaagaaacagaaagaagaagaacccctgcaacgccgagttccagaacttctgcatccacggcgagtgcaagtacatcgagcacctggaggccgtgacctgcaagtgccagcaggagtacttcggcgagagatgcggcgagaagagcatgaagacccacagcatgatcgacagcagcctgagcaagatcgccctggccgccatcgccgccttcatgagcgccgtgatcctgaccgccgtggccgtgatcaccgtgcagctgagaagacagtacgtgagaaagtacgagggcgaggccgaggagagaaagaagctgagacaggagaacggcaacgtgcacgccatcgcctag

SEQ ID NO: 4242 - DNA, 8487 bp, Artificial Sequence
  Description of Artificial Sequence: Synthetic coding sequence
atgcccaagagagcccactggggcgccctgagcgtggtgctgatcctgctgtggggccaccccagagtggccctggcctgcccccacccctgcgcctgctacgtgcccagcgaggtgcactgcaccttcagaagcctggccagcgtgcccgccggcatcgccaagcacgtggagagaatcaacctgggcttcaacagcatccaggccctgagcgagaccagcttcgccggcctgaccaagctggagctgctgatgatccacggcaacgagatccccagcatccccgacggcgccctgagagacctgagcagcctgcaggtgttcaagttcagctacaacaagctgagagtgatcaccggccagaccctgcagggcctgagcaacctgatgagactgcacatcgaccacaacaagatcgagttcatccacccccaggccttcaacggcctgaccagcctgagactgctgcacctggagggcaacctgctgcaccagctgcaccccagcaccttcagcaccttcaccttcctggactacttcagactgagcaccatcagacacctgtacctggccgagaacatggtgagaaccctgcccgccagcatgctgagaaacatgcccctgctggagaacctgtacctgcagggcaacccctggacctgcgactgcgagatgagatggttcctggagtgggacgccaagagcagaggcatcctgaagtgcaagaaggacaaggcctacgagggcggccagctgtgcgccatgtgcttcagccccaagaagctgtacaagcacgagatccacaagctgaaggacatgacctgcctgaagcccagcatcgagagccccctgagacagaacagaagcagaagcatcgaggaggagcaggagcaggaggaggacggcggcagccagctgatcctggagaagttccagctgccccagtggagcatcagcctgaacatgaccgacgagcacggcaacatggtgaacctggtgtgcgacatcaagaagcccatggacgtgtacaagatccacctgaaccagaccgacccccccgacatcgacatcaacgccaccgtggccctggacttcgagtgccccatgaccagagagaactacgagaagctgtggaagctgatcgcctactacagcgaggtgcccgtgaagctgcacagagagctgatgctgagcaaggaccccagagtgagctaccagtacagacaggacgccgacgaggaggccctgtactacaccggcgtgagagcccagatcctggccgagcccgagtgggtgatgcagcccagcatcgacatccagctgaacagaagacagagcaccgccaagaaggtgctgctgagctactacacccagtacagccagaccatcagcaccaaggacaccagacaggccagaggcagaagctgggtgatgatcgagcccagcggcgccgtgcagagagaccagaccgtgctggagggcggcccctgccagctgagctgcaacgtgaaggccagcgagagccccagcatcttctgggtgctgcccgacggcagcatcctgaaggcccccatggacgaccccgacagcaagttcagcatcctgagcagcggctggctgagaatcaagagcatggagcccagcgacagcggcctgtaccagtgcatcgcccaggtgagagacgagatggacagaatggtgtacagagtgctggtgcagagccccagcacccagcccgccgagaaggacaccgtgaccatcggcaagaaccccggcgagagcgtgaccctgccctgcaacgccctggccatccccgaggcccacctgagctggatcctgcccaacagaagaatcatcaacgacctggccaacaccagccacgtgtacatgctgcccaacggcaccctgagcatccccaaggtgcaggtgagcgacagcggctactacagatgcgtggccgtgaaccagcagggcgccgaccacttcaccgtgggcatcaccgtgaccaagaagggcagcggcctgcccagcaagagaggcagaagacccggcgccaaggccctgagcagagtgagagaggacatcgtggaggacgagggcggcagcggcatgggcgacgaggagaacaccagcagaagactgctgcaccccaaggaccaggaggtgttcctgaagaccaaggacgacgccatcaacggcgacaagaaggccaagaagggcagaagaaagctgaagctgtggaagcacagcgagaaggagcccgagaccaacgtggccgagggcagaagagtgttcgagagcagaagaagaatcaacatggccaacaagcagatcaaccccgagagatgggccgacatcctggccaaggtgagaggcaagaacctgcccaagggcaccgaggtgccccccctgatcaagaccaccagcccccccagcctgagcctggaggtgaccccccccttccccgccatcagcccccccagcgccagccccgtgcagaccgtgaccagcgccgaggagagcagcgccgacgtgcccctgctgggcgaggaggagcacgtgctgggcaccatcagcagcgccagcatgggcctggagcacaaccacaacggcgtgatcctggtggagcccgaggtgaccagcacccccctggaggaggtggtggacgacctgagcgagaagaccgaggagatcaccagcaccgagggcgacctgaagggcaccgccgcccccaccctgatcagcgagccctacgagcccagccccaccctgcacaccctggacaccgtgtacgagaagcccacccacgaggagaccgccaccgagggctggagcgccgccgacgtgggcagcagccccgagcccaccagcagcgagtacgagccccccctggacgccgtgagcctggccgagagcgagcccatgcagtacttcgaccccgacctggagaccaagagccagcccgacgaggacaagatgaaggaggacaccttcgcccacctgacccccacccccaccatctgggtgaacgacagcagcaccagccagctgttcgaggacagcaccatcggcgagcccggcgtgcccggccagagccacctgcagggcctgaccgacaacatccacctggtgaagagcagcctgagcacccaggacaccctgctgatcaagaagggcatgaaggagatgagccagaccctgcagggcggcaacatgctggagggcgaccccacccacagcagaagcagcgagagcgagggccaggagagcaagagcatcaccctgcccgacagcaccctgggcatcatgagcagcatgagccccgtgaagaagcccgccgagaccaccgtgggcaccctgctggacaaggacaccaccaccgccaccaccacccccagacagaaggtggcccccagcagcaccatgagcacccaccccagcagaagaagacccaacggcagaagaagactgagacccaacaagttcagacacagacacaagcagaccccccccaccaccttcgcccccagcgagaccttcagcacccagcccacccaggcccccgacatcaagatcagcagccaggtggagagcagcctggtgcccaccgcctgggtggacaacaccgtgaacacccccaagcagctggagatggagaagaacgccgagcccaccagcaagggcacccccagaagaaagcacggcaagagacccaacaagcacagatacacccccagcaccgtgagcagcagagccagcggcagcaagcccagccccagccccgagaacaagcacagaaacatcgtgacccccagcagcgagaccatcctgctgcccagaaccgtgagcctgaagaccgagggcccctacgacagcctggactacatgaccaccaccagaaagatctacagcagctaccccaaggtgcaggagaccctgcccgtgacctacaagcccaccagcgacggcaaggagatcaaggacgacgtggccaccaacgtggacaagcacaagagcgacatcctggtgaccggcgagagcatcaccaacgccatccccaccagcagaagcctggtgagcaccatgggcgagttcaaggaggagagcagccccgtgggcttccccggcacccccacctggaaccccagcagaaccgcccagcccggcagactgcagaccggcatccccgtgaccaccagcggcgagaacctgaccgacccccccctgctgaaggagctggaggacgtggacttcaccagcgagttcctgagcagcctgaccgtgagcacccccttccaccaggaggaggccggcagcagcaccaccctgagcagcatcaaggtggaggtggccagcagccaggccgagaccaccaccctggaccaggaccacctggagaccaccgtggccatcctgctgagcgagaccagaccccagaaccacacccccaccgccgccagaatgaaggagcccgccagcagcagccccagcaccatcctgatgagcctgggccagaccaccaccaccaagcccgccctgcccagccccagaatcagccaggccagcagagacagcaaggagaacgtgttcctgaactacgtgggcaaccccgagaccgaggccacccccgtgaacaacgagggcacccagcacatgagcggccccaacgagctgagcacccccagcagcgaccaggacgccttcaacctgagcaccaagctggagctggagaagcaggtgttcggcagcagaagcctgcccagaggccccgacagccagagacaggacggcagagtgcacgccagccaccagctgaccagagtgcccgccaagcccatcctgcccaccgccaccgtgagactgcccgagatgagcacccagagcgccagcagatacttcgtgaccagccagagccccagacactggaccaacaagcccgagatcaccacctaccccagcggcgccctgcccgagaacaagcagttcaccacccccagactgagcagcaccaccatccccctgcccctgcacatgagcaagcccagcatccccagcaagttcaccgacagaagaaccgaccagttcaacggctacagcaaggtgttcggcaacaacaacatccccgaggccagaaaccccgtgggcaagccccccagccccagaatcccccactacagcaacggcagactgcccttcttcaccaacaagaccctgagcttcccccagctgggcgtgaccagaagaccccagatccccaccagccccgcccccgtgatgagagagagaaaggtgatccccggcagctacaacagaatccacagccacagcaccttccacctggacttcggcccccccgccccccccctgctgcacaccccccagaccaccggcagccccagcaccaacctgcagaacatccccatggtgagcagcacccagagcagcatcagcttcatcaccagcagcgtgcagagcagcggcagcttccaccagagcagcagcaagttcttcgccggcggcccccccgccagcaagttctggagcctgggcgagaagccccagatcctgaccaagagcccccagaccgtgagcgtgaccgccgagaccgacaccgtgttcccctgcgaggccaccggcaagcccaagcccttcgtgacctggaccaaggtgagcaccggcgccctgatgacccccaacaccagaatccagagattcgaggtgctgaagaacggcaccctggtgatcagaaaggtgcaggtgcaggacagaggccagtacatgtgcaccgccagcaacctgcacggcctggacagaatggtggtgctgctgagcgtgaccgtgcagcagccccagatcctggccagccactaccaggacgtgaccgtgtacctgggcgacaccatcgccatggagtgcctggccaagggcacccccgccccccagatcagctggatcttccccgacagaagagtgtggcagaccgtgagccccgtggagggcagaatcaccctgcacgagaacagaaccctgagcatcaaggaggccagcttcagcgacagaggcgtgtacaagtgcgtggccagcaacgccgccggcgccgacagcctggccatcagactgcacgtggccgccctgccccccgtgatccaccaggagaagctggagaacatcagcctgccccccggcctgagcatccacatccactgcaccgccaaggccgcccccctgcccagcgtgagatgggtgctgggcgacggcacccagatcagacccagccagttcctgcacggcaacctgttcgtgttccccaacggcaccctgtacatcagaaacctggcccccaaggacagcggcagatacgagtgcgtggccgccaacctggtgggcagcgccagaagaaccgtgcagctgaacgtgcagagagccgccgccaacgccagaatcaccggcaccagccccagaagaaccgacgtgagatacggcggcaccctgaagctggactgcagcgccagcggcgacccctggcccagaatcctgtggagactgcccagcaagagaatgatcgacgccctgttcagcttcgacagcagaatcaaggtgttcgccaacggcaccctggtggtgaagagcgtgaccgacaaggacgccggcgactacctgtgcgtggccagaaacaaggtgggcgacgactacgtggtgctgaaggtggacgtggtgatgaagcccgccaagatcgagcacaaggaggagaacgaccacaaggtgttctacggcggcgacctgaaggtggactgcgtggccaccggcctgcccaaccccgagatcagctggagcctgcccgacggcagcctggtgaacagcttcatgcagagcgacgacagcggcggcagaaccaagagatacgtggtgttcaacaacggcaccctgtacttcaacgaggtgggcatgagagaggagggcgactacacctgcttcgccgagaaccaggtgggcaaggacgagatgagagtgagagtgaaggtggtgaccgcccccgccaccatcagaaacaagacctacctggccgtgcaggtgccctacggcgacgtggtgaccgtggcctgcgaggccaagggcgagcccatgcccaaggtgacctggctgagccccaccaacaaggtgatccccaccagcagcgagaagtaccagatctaccaggacggcaccctgctgatccagaaggcccagagaagcgacagcggcaactacacctgcctggtgagaaacagcgccggcgaggacagaaagaccgtgtggatccacgtgaacgtgcagccccccaagatcaacggcaaccccaaccccatcaccaccgtgagagagatcgccgccggcggcagcagaaagctgatcgactgcaaggccgagggcatccccacccccagagtgctgtgggccttccccgagggcgtggtgctgcccgccccctactacggcaacagaatcaccgtgcacggcaacggcagcctggacatcagaagcctgagaaagagcgacagcgtgcagctggtgtgcatggccagaaacgagggcggcgaggccagactgatcctgcagctgaccgtgctggagcccatggagaagcccatcttccacgaccccatcagcgagaagatcaccgccatggccggccacaccatcagcctgaactgcagcgccgccggcacccccacccccagcctggtgtgggtgctgcccaacggcaccgacctgcagagcggccagcagctgcagagattctaccacaaggccgacggcatgctgcacatcagcggcctgagcagcgtggacgccggcgcctacagatgcgtggccagaaacgccgccggccacaccgagagactggtgagcctgaaggtgggcctgaagcccgaggccaacaagcagtaccacaacctggtgagcatcatcaacggcgagaccctgaagctgccctgcaccccccccggcgccggccagggcagattcagctggaccctgcccaacggcatgcacctggagggcccccagaccctgggcagagtgagcctgctggacaacggcaccctgaccgtgagagaggccagcgtgttcgacagaggcacctacgtgtgcagaatggagaccgagtacggccccagcgtgaccagcatccccgtgatcgtgatcgcctacccccccagaatcaccagcgagcccacccccgtgatctacaccagacccggcaacaccgtgaagctgaactgcatggccatgggcatccccaaggccgacatcacctgggagctgcccgacaagagccacctgaaggccggcgtgcaggccagactgtacggcaacagattcctgcacccccagggcagcctgaccatccagcacgccacccagagagacgccggcttctacaagtgcatggccaagaacatcctgggcagcgacagcaagaccacctacatccacgtgttctag

SEQ ID NO: 4243 - DNA, 3330 bp, Artificial Sequence
  Description of Artificial Sequence: Synthetic coding sequence
atgagactgctgctgctggtgcccctgctgctggcccccgcccccggcagcagcgcccccaaggtgagaagacagagcgacacctggggcccctggagccagtggagcccctgcagcagaacctgcggcggcggcgtgagcttcagagagagaccctgctacagccagagaagagacggcggcagcagctgcgtgggccccgccagaagccacagaagctgcagaaccgagagctgccccgacggcgccagagacttcagagccgagcagtgcgccgagttcgacggcgccgagttccagggcagaagatacagatggctgccctactacagcgcccccaacaagtgcgagctgaactgcatccccaagggcgagaacttctactacaagcacagagaggccgtggtggacggcaccccctgcgagcccggcaagagagacgtgtgcgtggacggcagctgcagagtggtgggctgcgaccacgagctggacagcagcaagcaggaggacaagtgcctgagatgcggcggcgacggcaccacctgctaccccgtggccggcaccttcgacgccaacgacctgagcagaggctacaaccagatcctgatcgtgcccatgggcgccaccagcatcctgatcgacgaggccgccgccagcagaaacttcctggccgtgaagaacgtgagaggcgagtactacctgaacggccactggaccatcgaggccgccagagccctgcccgccgccagcaccatcctgcactacgagagaggcgccgagggcgacctggcccccgagagactgcacgccagaggccccaccagcgagcccctggtgatcgagctgatcagccaggagcccaaccccggcgtgcactacgagtaccacctgcccctgagaagacccagccccggcttcagctggagccacggcagctggagcgactgcagcgccgagtgcggcggcggccaccagagcagactggtgttctgcaccatcgaccacgaggcctaccccgaccacatgtgccagagacagcccagacccgccgacagaagaagctgcaacctgcacccctgccccgagaccaagagatggaaggccggcccctgggccccctgcagcgccagctgcggcggcggcagccagagcagaagcgtgtactgcatcagcagcgacggcgccggcatccaggaggccgtggaggaggccgagtgcgccggcctgcccggcaagccccccgccatccaggcctgcaacctgcagagatgcgccgcctggagccccgagccctggggcgagtgcagcgtgagctgcggcgtgggcgtgagaaagagaagcgtgacctgcagaggcgagagaggcagcctgctgcacaccgccgcctgcagcctggaggacagaccccccctgaccgagccctgcgtgcacgaggactgccccctgctgagcgaccaggcctggcacgtgggcacctggggcctgtgcagcaagagctgcagcagcggcaccagaagaagacaggtgatctgcgccatcggcccccccagccactgcggcagcctgcagcacagcaagcccgtggacgtggagccctgcaacacccagccctgccacctgccccaggaggtgcccagcatgcaggacgtgcacacccccgccagcaacccctggatgcccctgggcccccaggagagccccgccagcgacagcagaggccagtggtgggccgcccaggagcaccccagcgccagaggcgaccacagaggcgagagaggcgaccccagaggcgaccagggcacccacctgagcgccctgggccccgcccccagcctgcagcagcccccctaccagcagcccctgagaagcggcagcggcccccacgactgcagacacagcccccacggctgctgccccgacggccacaccgccagcctgggcccccagtggcagggctgccccggcgccccctgccagcagagcagatacggctgctgccccgacagagtgagcgtggccgagggcccccaccacgccggctgcaccaagagctacggcggcgacagcaccggcggcatgcccagaagcagagccgtggccagcaccgtgcacaacacccaccagccccaggcccagcagaacgagcccagcgagtgcagaggcagccagttcggctgctgctacgacaacgtggccaccgccgccggccccctgggcgagggctgcgtgggccagcccagccacgcctaccccgtgagatgcctgctgcccagcgcccacggcagctgcgccgactgggccgccagatggtacttcgtggccagcgtgggccagtgcaacagattctggtacggcggctgccacggcaacgccaacaacttcgccagcgagcaggagtgcatgagcagctgccagggcagcctgcacggccccagaagaccccagcccggcgccagcggcagaagcacccacaccgacggcggcggcagcagccccgccggcgagcaggagcccagccagcacagaaccggcgccgccgtgcagagaaagccctggcccagcggcggcctgtggagacaggaccagcagcccggccccggcgaggccccccacacccaggccttcggcgagtggccctggggccaggagctgggcagcagagcccccggcctgggcggcgacgccggcagccccgccccccccttccacagcagcagctacagaatcagcctggccggcgtggagcccagcctggtgcaggccgccctgggccagctggtgagactgagctgcagcgacgacaccgcccccgagagccaggccgcctggcagaaggacggccagcccatcagcagcgacagacacagactgcagttcgacggcagcctgatcatccaccccctgcaggccgaggacgccggcacctacagctgcggcagcaccagacccggcagagacagccagaagatccagctgagaatcatcggcggcgacatggccgtgctgagcgaggccgagctgagcagattcccccagcccagagaccccgcccaggacttcggccaggccggcgccgccggccccctgggcgccatccccagcagccacccccagcccgccaacagactgagactggaccagaaccagcccagagtggtggacgccagccccggccagagaatcagaatgacctgcagagccgagggcttccccccccccgccatcgagtggcagagagacggccagcccgtgagcagccccagcacccacagacccgcccagggcccctggcagggcctgagaagacccgccagagccggccagctgtag

SEQ ID NO: 4244 - DNA, 405 bp, Artificial Sequence
  Description of Artificial Sequence: Synthetic coding sequence
atgaagagcgtgctgctgctgaccaccctgctggtgcccgcccacctggtggccgcctggagcaacaactacgccgtggactgcccccagcactgcgacagcagcgagtgcaagagcagccccagatgcaagagaaccgtgctggacgactgcggctgctgcagagtgtgcgccgccggcagaggcgagacctgctacagaaccgtgagcggcatggacggcatgaagtgcggccccggcctgagatgccagcccagcaacggcgaggaccccttcggcgaggagttcggcatctgcaaggagcacgacatggccagcggcgacggcaacatcgtgagagaggaggtggtgaaggagaacgccgccggcagccccgtgatgagaaagtggctgaaccccagatag

SEQ ID NO: 4245 - DNA, 555 bp, Artificial Sequence
  Description of Artificial Sequence: Synthetic coding sequence
atgaagagcgtgctgctgctgaccaccctgctggtgcccgcccacctggtggccgcctggagcaacaactacgccgtggactgcccccagcactgcgacagcagcgagtgcaagagcagccccagatgcaagagaaccgtgctggacgactgcggctgctgcagagtgtgcgccgccggcagaggcgagacctgctacagaaccgtgagcggcatggacggcatgaagtgcggccccggcctgagatgccagcccagcaacggcgaggaccccttcggcgaggagttcggcatctgcaaggactgcccctacggcaccttcggcatggactgcagagagacctgcaactgccagagcggcatctgcgacagaggcaccggcaagtgcctgaagttccccttcttccagtacagcgtgaccaagagcagcaacagattcgtgagcctgaccgagcacgacatggccagcggcgacggcaacatcgtgagagaggaggtggtgaaggagaacgccgccggcagccccgtgatgagaaagtggctgaaccccagatag

SEQ ID NO: 4246 - DNA, 597 bp, Artificial Sequence
  Description of Artificial Sequence: Synthetic coding sequence
atgcccatccccgccagccccctgcacccccccctgcccagcctgctgctgtacctgctgctggagctggccggcgtgacccacgtgttccacgtgcagcagaccgagatgagccagaccgtgagcaccggcgagagcatcatcctgagctgcagcgtgcccaacaccctgcccaacggccccgtgctgtggttcaagggcaccggccccaacagaaagctgatctacaacttcaagcagggcaacttccccagagtgaaggagatcggcgacaccaccaagcccggcaacaccgacttcagcaccagaatcagagagatcagcctggccgacgccggcacctactactgcgtgaagttcatcaagggcagagccatcaaggagtaccagagcggcagaggcacccaggtgttcgtgaccgccgagcagaaccccagaccccccaagaacagacccgccggcagagccggcagcagagcccaccacgacgcccacacctgcctgagcgccctgcccgagagaaacagcaccaactacttcgtgcagccctgctgctgcctgagactgctgggcctgaccggcctgctgagcaagtag

SEQ ID NO: 4247 - DNA, 594 bp, Artificial Sequence
  Description of Artificial Sequence: Synthetic coding sequence
atgcccatccccgccagccccctgcacccccccctgcccagcctgctgctgtacctgctgctggagctggccggcgtgacccacgtgttccacgtgcagcagaccgagatgagccagaccgtgagcaccggcgagagcatcatcctgagctgcagcgtgcccaacaccctgcccaacggccccgtgctgtggttcaagggcaccggccccaacagaaagctgatctacaacttcaagcagggcaacttccccagagtgaaggagatcggcgacaccaccaagcccggcaacaccgacttcagcaccagaatcagagagatcagcctggccgacgccggcacctactactgcgtgaagttcatcaagggcagagccatcaaggagtaccagagcggcagaggcacccaggtgttcgtgaccgagcagaaccccagaccccccaagaacagacccgccggcagagccggcagcagagcccaccacgacgcccacacctgcctgagcgccctgcccgagagaaacagcaccaactacttcgtgcagccctgctgctgcctgagactgctgggcctgaccggcctgctgagcaagtag

SEQ ID NO: 4248 - DNA, 1563 bp, Artificial Sequence
  Description of Artificial Sequence: Synthetic coding sequence
atgaccaccgacgacaccgaggtgcccgccatgaccctggcccccggccacgccgccctggagacccagaccctgagcgccgagaccagcagcagagccagcacccccgccggccccatccccgaggccgagaccagaggcgccaagagaatcagccccgccagagagaccagaagcttcaccaagaccagccccaacttcatggtgctgatcgccaccagcgtggagaccagcgccgccagcggcagccccgagggcgccggcatgaccaccgtgcagaccatcaccggcagcgaccccagagaggccatcttcgacaccctgtgcaccgacgacatcagcgaggaggccaagaccctgaccatggacatcctgaccctggcccacaccagcaccgaggccaagggcctgagcagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagctggagccccggcagcgacgtgaccctgctggccgaggccctggtgaccgtgaccaacatcgaggtgatcaactgcagcatcaccgagatcgagaccaccaccagcagcatccccggcgccagcgacaccgacctgatccccaccgagggcgtgaaggccagcagcaccagcgacccccccgccctgcccgacagcaccaacaccaagccccacatcaccgaggtgaccgccagcgccgagaccctgagcaccgccggcaccaccgagagcgccgcccccgacgccaccatcggcacccccctgcccaccaacagcaccatcgagagagaggtgaccgcccccggcgccaccaccctgagcggcgccctggccaccggcaaccccctggaggagaccagcgccctgagcgtggagacccccagctacgtgaaggtgagcggcgccgcccccgtgagcatcgaggccggcagcgccgtgggcaagaccaccagcttcgccggcagcagcgccagcagctacagccccctggaggccgccctgaagaacttcacccccagcgagaccctgaccaccgacatcgccaccaagggccccttccccaccagcagagaccccctgcccagcgtgccccccaccaccaccaacagcagcagaggcaccaacagcaccctggccaagatcaccaccagcgccaagaccaccatgaagccccccaccgccacccccaccaccgccagaaccagacccaccaccgacgtgagcgccggcgagaacggcggcttcctgctgctgagactgagcgtggccagccccgaggacctgaccgaccccagagtggccgagagactgatgcagcagctgcacagagagctgcacgcccacgccccccacttccaggtgagcctgctgagagtgagaagaggctag

SEQ ID NO: 4249 - DNA, 600 bp, Artificial Sequence
  Description of Artificial Sequence: Synthetic coding sequence
atgctgtggagacagctgatctactggcagctgctggccctgttcttcctgcccttctgcctgtgccaggacgagtacatggagagcccccagaccggcggcctgccccccgactgcagcaagtgctgccaccacggcaacaacggcaacaacggcgccaccggccacaagggcgagaagggctaccccggcatcccccccgagctgcagatcgccttcatggccagcctggccacccacttcagcaaccagaacagcggcatcatcttcagcagcgtggagaccaacatcggcaacttcttcgacgtgatgaccggcagattcggcgcccccgtgagcggcgtgtacttcttcaccttcagcatgatgaagcacgaggacgtggaggaggtgtacgtgtacctgatgcacaacggcaacaccgtgttcagcatgtacagctacgagatgaagggcaagagcgacaccagcagcaaccacgccgtgctgaagctggccaagggcgacgaggtgtggctgagaatgggcaacggcgccctgcacggcgaccaccagagattcagcaccttcgccggcttcctgctgttcgagaccaagtag

SEQ ID NO: 4250 - DNA, 960 bp, Artificial Sequence
  Description of Artificial Sequence: Synthetic coding sequence
atgctgtggagacagctgatctactggcagctgctggccctgttcttcctgcccttctgcctgtgccaggacgagtacatggaggtgagcggcagaaccaacaaggtggtggccagaatcgtgcagagccaccagcagaccggcagaagcggcagcagaagagagaaggtgagagagagaagccaccccaagaccggcaccgtggacaacaacaccagcaccgacctgaagagcctgagacccgacgagctgccccaccccgaggtggacgacctggcccagatcaccaccttctggggccagagcccccagaccggcggcctgccccccgactgcagcaagtgctgccacggcgactacagcttcagaggctaccagggcccccccggcccccccggcccccccggcatccccggcaaccacggcaacaacggcaacaacggcgccaccggccacgagggcgccaagggcgagaagggcgacaagggcgacctgggccccagaggcgagagaggccagcacggccccaagggcgagaagggctaccccggcatcccccccgagctgcagatcgccttcatggccagcctggccacccacttcagcaaccagaacagcggcatcatcttcagcagcgtggagaccaacatcggcaacttcttcgacgtgatgaccggcagattcggcgcccccgtgagcggcgtgtacttcttcaccttcagcatgatgaagcacgaggacgtggaggaggtgtacgtgtacctgatgcacaacggcaacaccgtgttcagcatgtacagctacgagatgaagggcaagagcgacaccagcagcaaccacgccgtgctgaagctggccaagggcgacgaggtgtggctgagaatgggcaacggcgccctgcacggcgaccaccagagattcagcaccttcgccggcttcctgctgttcgagaccaagtag

SEQ ID NO: 4251 - DNA, 855 bp, Artificial Sequence
  Description of Artificial Sequence: Synthetic coding sequence
atgaccaagagcagcctgagacccctgcagaagcagagcccccagaccggcggcctgccccccgactgcagcaagtgctgccacggcgactacagcttcagaggctaccagggcccccccggcccccccggcccccccggcatccccggcaaccacggcaacaacggcaacaacggcgccaccggccacgagggcgccaagggcgagaagggcgacaagggcgacctgggccccagaggcgagagaggccagcacggccccaagggcgagaagggctaccccggcatcccccccgagctgcagatcgccttcatggccagcctggccacccacttcagcaaccagaacagcggcatcatcttcagcagcgtggagaccaacatcggcaacttcttcgacgtgatgaccggcagattcggcgcccccgtgagcggcgtgtacttcttcaccttcagcatgatgaagcacgaggacgtggaggaggtgtacgtgtacctgatgcacaacggcaacaccgtgttcagcatgtacagctacgagatgaagggcaagagcgacaccagcagcaaccacgccgtgctgaagctggccaagggcgacgaggtgtggctgagaatgggcaacggcgccctgcacggcgaccaccagagattcagcaccttcgccggcttcctgctgttcgagaccaagtgccacggcgagacccccgccggccccagagacagcgccgccggcaagagcaaggcctacctgtgccaggccgagtggatctggcccgtgagaaagctgctgcccgtgagctggcccagataccagctgttcggcttcgtgagatggaaggagcagcacatctag

SEQ ID NO: 4252 - DNA, 234 bp, Artificial Sequence
  Description of Artificial Sequence: Synthetic coding sequence
atggccaccagaagcgtgctgctggccctggtggtgctgaacctgctgttctacgtgccccccggcagaagcggccccaacgtgtacatccagaagatcttcgccagctgctggagactgcagggcacctgcagacccaagtgcctgaagaacgagcagtacagaatcctgtgcgacaccatccacctgtgctgcgtgaaccccaagtacctgcccatcctgaccggcaagtag

SEQ ID NO: 4253 - DNA, 237 bp, Artificial Sequence
  Description of Artificial Sequence: Synthetic coding sequence
atgaacctgtgcctgagcgccctgctgttcttcctggtgatcctgctgcccagcggcaagggcatgttcggcaacgacggcgtgaaggtgagaacctgcaccagccagaaggccgtgtgcttcttcggctgcccccccggctacagatggatcgccttctgccacaacatcctgagctgctgcaagaacatgaccagattccagcccccccaggccaaggacccctgggtgcactag

SEQ ID NO: 4254 - DNA, 627 bp, Artificial Sequence
  Description of Artificial Sequence: Synthetic coding sequence
atgggcgcccagggcgcccaggagagcatcaaggccatgtggagagtgcccggcaccaccagaagacccgtgaccggcgagagccccggcatgcacagacccgaggccatgctgctgctgctgaccctggccctgctgggcggccccacctgggccggcaagatgtacggccccggcggcggcaagtacttcagcaccaccgaggactacgaccacgagatcaccggcctgagagtgagcgtgggcctgctgctggtgaagagcgtgcaggtgaagctgggcgacagctgggacgtgaagctgggcgccctgggcggcaacacccaggaggtgaccctgcagcccggcgagtacatcaccaaggtgttcgtggccttccaggccttcctgagaggcatggtgatgtacaccagcaaggacagatacttctacttcggcaagctggacggccagatcagcagcgcctaccccagccaggagggccaggtgctggtgggcatctacggccagtaccagctgctgggcatcaagagcatcggcttcgagtggaactaccccctggaggagcccaccaccgagccccccgtgaacctgacctacagcgccaacagccccgtgggcagatag

SEQ ID NO: 4255 - DNA, 288 bp, Artificial Sequence
  Description of Artificial Sequence: Synthetic coding sequence
atgaagttcctgctgctggtgctggccgccctgggcttcctgacccaggtgatccccgccagcgccggcggcagcaagtgcgtgagcaacacccccggctactgcagaacctgctgccactggggcgagaccgccctgttcatgtgcaacgccagcagaaagtgctgcatcagctacagcttcctgcccaagcccgacctgccccagctgatcggcaaccactggcagagcagaagaagaaacacccagagaaaggacaagaagcagcagaccaccgtgaccagctag

SEQ ID NO: 4256 - DNA, 339 bp, Artificial Sequence
  Description of Artificial Sequence: Synthetic coding sequence
atgttcgtgctgctgtacgtgaccagcttcgccatctgcgccagcggccagcccagaggcaaccagctgaagggcgagaactacagccccagatacatctgcagcatccccggcctgcccggcccccccggcccccccggcgccaacggcagccccggcccccacggcagaatcggcctgcccggcagagacggcagagacggcagaaagggcgagaagggcgagaagggcaccgccggcctgagaggcaagaccggccccctgggcctggccggcgagaagggcgaccagggcgagaccggcaagaagggccccatcggccccgagggcgagaagtag

SEQ ID NO: 4257 - DNA, 300 bp, Artificial Sequence
  Description of Artificial Sequence: Synthetic coding sequence
atgggcctgttcatgatcatcgccatcctgctgttccagaagcccaccgtgaccgagcagctgaagaagtgctggaacaactacgtgcagggccactgcagaaagatctgcagagtgaacgaggtgcccgaggccctgtgcgagaacggcagatactgctgcctgaacatcaaggagctggaggcctgcaagaagatcaccaagccccccagacccaagcccgccaccctggccctgaccctgcaggactacgtgaccatcatcgagaacttccccagcctgaagacccagagcacctag

SEQ ID NO: 4258 - DNA, 336 bp, Artificial Sequence
  Description of Artificial Sequence: Synthetic coding sequence
atgaagagcctgctgttcaccctggccgtgttcatgctgctggcccagctggtgagcggcaactggtacgtgaagaagtgcctgaacgacgtgggcatctgcaagaagaagtgcaagcccgaggagatgcacgtgaagaacggctgggccatgtgcggcaagcagagagactgctgcgtgcccgccgacagaagagccaactaccccgtgttctgcgtgcagaccaagaccaccagaatcagcaccgtgaccgccaccaccgccaccaccaccctgatgatgaccaccgccagcatgagcagcatggcccccacccccgtgagccccaccggctag

SEQ ID NO: 4259 - DNA, 1698 bp, Artificial Sequence
  Description of Artificial Sequence: Synthetic coding sequence
atggaggacagcgacagcgccgccaagcagctgggcctggccgaggccgccgccgtggccgccgccgccgccgtggccgccgccgccgccgccgccgccggcggcgaggccgaggagcccgtgctgagcagagacgaggacagcgaggaggacgccgacagcgaggccgagagagagacccccagagtgaccgccgtggccgtgatggccgccgagcccggccacatggacatgggcgccgaggccctgcccggccccgacgaggccgccgccgccgccgccttcgccgaggtgaccaccgtgaccgtggccaacgtgggcgccgccgccgacaacgtgttcaccaccagcgtggccaacgccgccagcatcagcggccacgtgctgagcggcagaaccgccctgcagatcggcgacagcctgaacaccgagaaggccaccctgatcgtggtgcacaccgacggcagcatcgtggagaccaccggcctgaagggccccgccgcccccctgacccccggcccccagagcccccccacccccctggcccccggccaggagaagggcggcaccaagtacaactgggaccccagcgtgtacgacagcgagctgcccgtgagatgcagaaacatcagcggcaccctgtacaagaacagactgggcagcggcggcagaggcagatgcatcaagcagggcgagaactggtacagccccaccgagttcgaggccatggccggcagagccagcagcaaggactggaagagaagcatcagatacgccggcagacccctgcagtgcctgatccaggacggcatcctgaacccccacgccgccagctgcacctgcgccgcctgctgcgacgacatgaccctgagcggccccgtgagactgttcgtgccctacaagagaagaaagaaggagaacgagctgcccaccacccccgtgaagaaggacagccccaagaacatcaccctgctgcccgccaccgccgccaccaccttcaccgtgacccccagcggccagatcaccaccagcggcgccctgaccttcgacagagccagcaccgtggaggccaccgccgtgatcagcgagagccccgcccagggcgacgtgttcgccggcgccaccgtgcaggaggccagcgtgcagcccccctgcagagccagccaccccgagccccactaccccggctaccaggacagctgccagatcgcccccttccccgaggccgccctgcccaccagccaccccaagatcgtgctgaccagcctgcccgccctggccgtgcccccccccacccccaccaaggccgccccccccgccctggtgaacggcctggagctgagcgagcccagaagctggctgtacctggaggagatggtgaacagcctgctgaacaccgcccagcagctgaagaccctgttcgagcaggccaagcacgccagcacctacagagaggccgccaccaaccaggccaagatccacgccgacgccgagagaaaggagcagagctgcgtgaactgcggcagagaggccatgagcgagtgcaccggctgccacaaggtgaactactgcagcaccttctgccagagaaaggactggaaggaccaccagcacatctgcggccagagcgccgccgtgaccgtgcaggccgacgaggtgcacgtggccgagagcgtgatggagaaggtgaccgtgtag

SEQ ID NO: 4260 - DNA, 471 bp, Artificial Sequence
  Description of Artificial Sequence: Synthetic coding sequence
atgaacatcctgatgctgaccttcatcatctgcggcctgctgaccagagtgaccaagggcagcttcgagccccagaagtgctggaagaacaacgtgggccactgcagaagaagatgcctggacaccgagagatacatcctgctgtgcagaaacaagctgagctgctgcatcagcatcatcagccacgagtacaccagaagacccgccttccccgtgatccacctggaggacatcaccctggactacagcgacgtggacagcttcaccggcagccccgtgagcatgctgaacgacctgatcaccttcgacaccaccaagttcggcgagaccatgacccccgagaccaacacccccgagaccaccatgccccccagcgaggccaccacccccgagaccaccatgccccccagcgagaccgccaccagcgagaccatgcccccccccagccagaccgccctgacccacaactag

SEQ ID NO: 4261 - DNA, 837 bp, Artificial Sequence
  Description of Artificial Sequence: Synthetic coding sequence
atgggcggccccagagccctgctggccgccctgtgggccctggaggccgccggcaccgccgccctgagaatcggcgccttcaacatccagagcttcggcgacagcaaggtgagcgaccccgcctgcggcagcatcatcgccaagatcctggccggctacgacctggccctggtgcaggaggtgagagaccccgacctgagcgccgtgagcgccctgatggagcagatcaacagcgtgagcgagcacgagtacagcttcgtgagcagccagcccctgggcagagaccagtacaaggagatgtacctgttcgtgtacagaaaggacgccgtgagcgtggtggacacctacctgtaccccgaccccgaggacgtgttcagcagagagcccttcgtggtgaagttcagcgcccccggcaccgcccagaacctggtgctgatccccctgcacgccgccccccaccaggccgtggccgagatcgacgccctgtacgacgtgtacctggacgtgatcgacaagtggggcaccgacgacatgctgttcctgggcgacttcaacgccgactgcagctacgtgagagcccaggactgggccgccatcagactgagaagcagcgaggtgttcaagtggctgatccccgacagcgccgacaccaccgtgggcaacagcgactgcgcctacgacagaatcgtggcctgcggcgccagactgagaagaagcctgaagccccagagcgccaccgtgcacgacttccaggaggagttcggcctggaccagacccaggccctggccatcagcgaccacttccccgtggaggtgaccctgaagttccacagatag

SEQ ID NO: 4262 - DNA, 3039 bp, Artificial Sequence
  Description of Artificial Sequence: Synthetic coding sequence
atggccgaggccgccctggaggccgtgagaagcgagctgagagagttccccgccgccgccagagagctgtgcgtgcccctggccgtgccctacctggacaagccccccacccccctgcacttctacagagactgggtgtgccccaacagaccctgcatcatcagaaacgccctgcagcactggcccgccctgcagaagtggagcctgccctacttcagagccaccgtgggcagcaccgaggtgagcgtggccgtgacccccgacggctacgccgacgccgtgagaggcgacagattcatgatgcccgccgagagaagactgcccctgagcttcgtgctggacgtgctggagggcagagcccagcaccccggcgtgctgtacgtgcagaagcagtgcagcaacctgcccagcgagctgccccagctgctgcccgacctggagagccacgtgccctgggccagcgaggccctgggcaagatgcccgacgccgtgaacttctggctgggcgaggccgccgccgtgaccagcctgcacaaggaccactacgagaacctgtactgcgtggtgagcggcgagaagcacttcctgttccacccccccagcgacagacccttcatcccctacgagctgtacacccccgccacctaccagctgaccgaggagggcaccttcaaggtggtggacgaggaggccatggagaaggccgaggtgagcagaacctgcctgctgaccgtgagagtgctgcaggcccacagactgcccagcaaggacctggtgacccccagcgactgctacgtgaccctgtggctgcccaccgcctgcagccacagactgcagaccagaaccgtgaagaacagcagcagccccgtgtggaaccagagcttccacttcagaatccacagacagctgaagaacgtgatggagctgaaggtgttcgaccaggacctggtgaccggcgacgaccccgtgctgagcgtgctgttcgacgccggcaccctgagagccggcgagttcagaagagagagcttcagcctgagcccccagggcgagggcagactggaggtggagttcagactgcagagcctggccgacagaggcgagtggctggtgagcaacggcgtgctggtggccagagagctgagctgcctgcacgtgcagctggaggagaccggcgaccagaagagcagcgagcacagagtgcagctggtggtgcccggcagctgcgagggcccccaggaggccagcgtgggcaccggcaccttcagattccactgccccgcctgctgggagcaggagctgagcatcagactgcaggacgcccccgaggagcagctgaaggcccccctgagcgccctgcccagcggccaggtggtgagactggtgttccccaccagccaggagcccctgatgagagtggagctgaagaaggaggccggcctgagagagctggccgtgagactgggcttcggcccctgcgccgaggagcaggccttcctgagcagaagaaagcaggtggtggccgccgccctgagacaggccctgcagctggacggcgacctgcaggaggacgagatccccgtggtggccatcatggccaccggcggcggcatcagagccatgaccagcctgtacggccagctggccggcctgaaggagctgggcctgctggactgcgtgagctacatcaccggcgccagcggcagcacctgggccctggccaacctgtacgaggaccccgagtggagccagaaggacctggccggccccaccgagctgctgaagacccaggtgaccaagaacaagctgggcgtgctggcccccagccagctgcagagatacagacaggagctggccgagagagccagactgggctaccccagctgcttcaccaacctgtgggccctgatcaacgaggccctgctgcacgacgagccccacgaccacaagctgagcgaccagagagaggccctgagccacggccagaaccccctgcccatctactgcgccctgaacaccaagggccagagcctgaccaccttcgagttcggcgagtggtgcgagttcagcccctacgaggtgggcttccccaagtacggcgccttcatccccagcgagctgttcggcagcgagttcttcatgggccagctgatgaagagactgcccgagagcagaatctgcttcctggagggcatctggagcaacctgtacgccgccaacctgcaggacagcctgtactgggccagcgagcccagccagttctgggacagatgggtgagaaaccaggccaacctggacaaggagcaggtgcccctgctgaagatcgaggagccccccagcaccgccggcagaatcgccgagttcttcaccgacctgctgacctggagacccctggcccaggccacccacaacttcctgagaggcctgcacttccacaaggactacttccagcacccccacttcagcacctggaaggccaccaccctggacggcctgcccaaccagctgacccccagcgagccccacctgtgcctgctggacgtgggctacctgatcaacaccagctgcctgcccctgctgcagcccaccagagacgtggacctgatcctgagcctggactacaacctgcacggcgccttccagcagctgcagctgctgggcagattctgccaggagcagggcatccccttcccccccatcagccccagccccgaggagcagctgcagcccagagagtgccacaccttcagcgaccccacctgccccggcgcccccgccgtgctgcacttccccctggtgagcgacagcttcagagagtacagcgcccccggcgtgagaagaacccccgaggaggccgccgccggcgaggtgaacctgagcagcagcgacagcccctaccactacaccaaggtgacctacagccaggaggacgtggacaagctgctgcacctgacccactacaacgtgtgcaacaaccaggagcagctgctggaggccctgagacaggccgtgcagagaagaagacagagaagaccccactag

SEQ ID NO: 4263 - DNA, 1548 bp, Artificial Sequence
  Description of Artificial Sequence: Synthetic coding sequence
atggcctggccctacttcctggactgccacagatacttcaccagagaggacgagggctgctacgaccccctggagaagctgagaggcggcctggaggccgacgaggccctgcccagcggcctgccccccaccttcatcagattcagccaccacagctacgcccagatggtgagagtgctgagaagaaccgccagcagatgcgcccacgtggccagaacctacagcatcggcagaagcttcgacggcagagagctgctggtgatcgagttcagcagcagacccggccagcacgagctgatggagcccgaggtgaagctgatcggcaacatccacggcaacgaggtggccggcagagagatgctgatctacctggcccagtacctgtgcagcgagtacctgctgggcaaccccagaatccagagactgctgaacaccaccagaatccacctgctgcccagcatgaaccccgacggctacgaggtggccgccgccgagggcgccggctacaacggctggaccagcggcagacagaacgcccagaacctggacctgaacagaaacttccccgacctgaccagcgagtactacagactggccgagaccagaggcgccagaagcgaccacatccccatcccccagcactactggtggggcaaggtggcccccgagaccaaggccatcatgaagtggatgcagaccatccccttcgtgctgagcgccagcctgcacggcggcgacctggtggtgagctaccccttcgacttcagcaagcacccccaggaggagaagatgttcagccccacccccgacgagaagatgttcaagctgctgagcagagcctacgccgacgtgcaccccatgatgatggacagaagcgagaacagatgcggcggcaacttcctgaagagaggcagcatcatcaacggcgccgactggtacagcttcaccggcggcatgagcgacttcaactacctgcacaccaactgcttcgagatcaccgtggagctgggctgcgtgaagttcccccccgaggaggccctgtacatcctgtggcagcacaacaaggagagcctgctgaacttcgtggagaccgtgcacagaggcatcaagggcgtggtgaccgacaagttcggcaagcccgtgaagaacgccagaatcagcgtgaagggcatcagacacgacatcaccaccgcccccgacggcgactactggagactgctgccccccggcatccacatcgtgatcgcccaggcccccggctacgccaaggtgatcaagaaggtgatcatccccgccagaatgaagagagccggcagagtggacttcatcctgcagcccctgggcatgggccccaagaacttcatccacggcctgagaagaaccggcccccacgaccccctgggcggcgccagcagcctgggcgaggccaccgagcccgaccccctgagagccagaagacagcccagcgccgacggcagcaagccctggtggtggagctacttcaccagcctgagcacccacagacccagatggctgctgaagtactag

SEQ ID NO: 4264 - DNA, 285 bp, Artificial Sequence
  Description of Artificial Sequence: Synthetic coding sequence
atgagaaccctggccatcctggccgccatcctgctggtggccctgcaggcccaggccgagcccctgcaggccagagccgacgaggtggccgccgcccccgagcagatcgccgccgacatccccgaggtggtggtgagcctggcctgggacgagagcctggcccccaagcaccccggcagcagaaagaacatggcctgctactgcagaatccccgcctgcatcgccggcgagagaagatacggcacctgcatctaccagggcagactgtgggccttctgctgctag

SEQ ID NO: 4265 - DNA, 420 bp, Artificial Sequence
  Description of Artificial Sequence: Synthetic coding sequence
atgggcaaccccggcggcgtgggcagcgagagaatgagagtggccagaagaaccagaaacgtgtgcagatgccccagagccgccggccccggcgtgcccgagcccagagccgcccccctgcccctgctggccatggcccccccccccgcctgcagaagccccatgagccccccccccccccccctgctgctgctgctgctgagcctggccctgctgggcgccagagccagagccgagcccgccggcagcgccgtgcccgcccagagcagaccctgcgtggactgccacgccttcgagttcatgcagagagccctgcaggacctgagaaagaccgcctgcagcctggacgccagaaccgagaccctgctgctgcaggccgagagaagagccctgtgcgcctgctggcccgccggccactag

SEQ ID NO: 4266 - DNA, 471 bp, Artificial Sequence
  Description of Artificial Sequence: Synthetic coding sequence
atggcccccgccgtgaccagactgctgttcctgcagctggtgctgggccccaccctggtgatggacatcaagatgcagatcggcagcagaaacttctacaccctgagcatcgactaccccagagtgaactaccccaagggcttcagaggctactgcaacggcctgatgagctacatgagaggcaagatgcagaacagcgactgccccaagatccactacgtgatccacgccccctggaaggccatccagaagttctgcaagtacagcgacagcttctgcgagaactacaacgagtactgcaccctgacccaggacagcctgcccatcaccgtgtgcagcctgagccaccagcagccccccaccagctgctactacaacagcaccctgaccaaccagaagctgtacctgctgtgcagcagaaagtacgaggccgaccccatcggcatcgccggcctgtacagcggcatctag

SEQ ID NO: 4267 - DNA, 444 bp, Artificial Sequence
  Description of Artificial Sequence: Synthetic coding sequence
atgatcatcatggtgatcatcttcctggtgctgctgttctgggagaacgaggtgaacgacgaggccgtgatgagcaccctggagcacctgcacgtggactacccccagaacgacgtgcccgtgcccgccagatactgcaaccacatgatcatccagagagtgatcagagagcccgaccacacctgcaagaaggagcacgtgttcatccacgagagacccagaaagatcaacggcatctgcatcagccccaagaaggtggcctgccagaacctgagcgccatcttctgcttccagagcgagaccaagttcaagatgaccgtgtgccagctgatcgagggcaccagataccccgcctgcagataccactacagccccaccgagggcttcgtgctggtgacctgcgacgacctgagacccgacagcttcctgggctacgtgaagtag

SEQ ID NO: 4268 - DNA, 453 bp, Artificial Sequence; identical to SEQ ID NO: 3797
  Description of Artificial Sequence: Synthetic coding sequence

SEQ ID NO: 4269 - DNA, 2742 bp, Artificial Sequence; identical to SEQ ID NO: 3799
  Description of Artificial Sequence: Synthetic coding sequence

SEQ ID NO: 4270 - DNA, 453 bp, Artificial Sequence; identical to SEQ ID NO: 3797
  Description of Artificial Sequence: Synthetic coding sequence

SEQ ID NO: 4271 - DNA, 567 bp, Artificial Sequence; identical to SEQ ID NO: 4160
  Description of Artificial Sequence: Synthetic coding sequence

SEQ ID NO: 4272 - DNA, 2535 bp, Artificial Sequence; identical to SEQ ID NO: 3960
  Description of Artificial Sequence: Synthetic coding sequence

SEQ ID NO: 4273 - DNA, 237 bp, Artificial Sequence; identical to SEQ ID NO: 3991
  Description of Artificial Sequence: Synthetic coding sequence

SEQ ID NO: 4274 - DNA, 2700 bp, Artificial Sequence; identical to SEQ ID NO: 4183
  Description of Artificial Sequence: Synthetic coding sequence

SEQ ID NO: 4275 - DNA, 2886 bp, Artificial Sequence; identical to SEQ ID NO: 4184
  Description of Artificial Sequence: Synthetic coding sequence

SEQ ID NO: 4276 - DNA, 2535 bp, Artificial Sequence; identical to SEQ ID NO: 3960
  Description of Artificial Sequence: Synthetic coding sequence

SEQ ID NO: 4277 - DNA, 2535 bp, Artificial Sequence; identical to SEQ ID NO: 3960
  Description of Artificial Sequence: Synthetic coding sequence

SEQ ID NO: 4278 - DNA, 2700 bp, Artificial Sequence; identical to SEQ ID NO: 4183
  Description of Artificial Sequence: Synthetic coding sequence

SEQ ID NO: 4279 - DNA, 2886 bp, Artificial Sequence; identical to SEQ ID NO: 4184
  Description of Artificial Sequence: Synthetic coding sequence

SEQ ID NO: 4280 - DNA, 2535 bp, Artificial Sequence; identical to SEQ ID NO: 3960
  Description of Artificial Sequence: Synthetic coding sequence

SEQ ID NO: 4281 - DNA, 3090 bp, Artificial Sequence
  Description of Artificial Sequence: Synthetic coding sequence
atgccccccaccaagagcgtgagcgagcccgtgcccttcgagaccgaggcccccagcatgaccatcgtgcccaccaccgacatcgagcccgtgaccgtgagaaccgaggccaccgtgaccaccctggcccccaagaccagccagagaaccagaaccagaagacccagacccaagcacaagaccacccccagacccgagaccctgcagaccaagctggacttcggccccatcacccccggcaccagcagcgcccccaccaccaccaccaagagaaccagaagaccccaccccaagcccaagaccaccccccaccccgaggtgccccagaccaagctggtgcccgccaccatcctggagcccgtgctgagaaccgaggccagcggcaccaccgccgtgcccgccaccatcttcgagcccgtgagccccatcaaggaggcccccggcaccaccttcgtgcccgtgaccgacctggagcccgtgaccttcagaaccgagatccccgccaccaccctggccaccaagaccagcaagagaaccagaccccccagacccagacccaagaccacccccagcccccaggcccccgagaccaagcccgtgcccgccaccgtgctggagcccgtgaccctgagacccgaggccagcaccaccctggccagcaagaccagccagagaaccagaagacccagactgagaaccaagaccacccccagacccgaggcccccgagagcaagcccgtgcccaccgccgagctgaagcccgtgaccctgagaaccgagacctgggtgaccacccaggcccccaagaccagccagagaaccagaagacccagacccaagaccaagaccacccccagccccgaggtgccccagaccaagctggtgcccagcaccgacctggagcccggcaccctgagaaccgaggcccccaagaccatggtggtgaccaccgtgctggagcccgacaccttcagaaccaagttccccgagaccaccctggcccccaagacccagagaaccagaagacccagacccagacccaagaccaccagcagccccgaggtgccccagaacaagagcgtgagcgtgaccggcttcgagcccgtggtgcacagcaccgacgcccccggcaccaccttcgccctgaccgagctgcagaccctgatcctgaagcccgtgaccagccccagcctggagatgaccgagagccagcccgtgagcgacgtgctggagagcgtgaccctgagcaccgagagccccaaggagaccatcgcccccgccaagaccgactacgtgtaccccaccgccaaggcccccctgtggcccgaggagcccaagaccgaggtggtggagagcatcacctacgtgagcgagccccccgagaccaccctggagaccagccccctgcccagccagagcatcaccctgcccagccccgacgagccccagaccgagcccgcccccaagcagacccccagagccccccccaagcccaagaccagccccagacccagaatcccccagacccagcccgtgcccaaggtgccccagagagtgaccgccaagcccaagaccagccccagccccgaggtgagctacaccacccccgcccccaaggacgtgctgctgccccacaagccctaccccgaggtgagccagagcgagcccgcccccctggagaccagaggcatccccttcatccccatgatcagccccagccccagccaggaggagctgcagaccaccctggaggagaccgaccagagcacccaggagcccttcaccaccaagatccccagaaccaccgagctggccaagaccacccaggccccccacagattctacaccaccgtgagacccagaaccagcgacaagccccacatcagacccggcgtgaagcaggcccccagacccagcggcgccgacagaaacgtgagcgtggacagcacccaccccaccaagaagcccggcaccagaagaccccccctgccccccagacccacccaccccagaagaaagcccctgccccccaacaacgtgaccggcaagcccggcagcgccggcatcatcagcagcggccccatcaccaccccccccctgagaagcacccccagacccaccggcacccccctggagagaatcgagaccgacatcaagcagcccaccgtgcccgccagcggcgaggagctggagaacatcaccgacttcagcagcagccccaccagagagaccgaccccctgggcaagcccagattcaagggcccccacgtgagatacatccagaagcccgacaacagcccctgcagcatcaccgacagcgtgaagagattccccaaggaggaggccaccgagggcaacgccaccagccccccccagaacccccccaccaacctgaccgtggtgaccgtggagggctgccccagcttcgtgatcctggactgggagaagcccctgaacgacaccgtgaccgagtacgaggtgatcagcagagagaacggcagcttcagcggcaagaacaagagcatccagatgaccaaccagaccttcagcaccgtggagaacctgaagcccaacaccagctacgagttccaggtgaagcccaagaaccccctgggcgagggccccgtgagcaacaccgtggccttcagcaccgagagcgccgaccccagagtgagcgagcccgtgagcgccggcagagacgccatctggaccgagagacccttcaacagcgacagctacagcgagtgcaagggcaagcagtacgtgaagagaacctggtacaagaagttcgtgggcgtgcagctgtgcaacagcctgagatacaagatctacctgagcgacagcctgaccggcaagttctacaacatcggcgaccagagaggccacggcgaggaccactgccagttcgtggacagcttcctggacggcagaaccggccagcagctgaccagcgaccagctgcccatcaaggagggctacttcagagccgtgagacaggagcccgtgcagttcggcgagatcggcggccacacccagatcaactacgtgcagtggtacgagtgcggcaccaccatccccggcaagtggtag

SEQ ID NO: 4282 - DNA, 2355 bp, Artificial Sequence
  Description of Artificial Sequence: Synthetic coding sequence
atgaccatcgtgcccaccaccgacatcgagcccgtgaccgtgagaaccgaggccaccgtgaccaccctggcccccaagaccagccagagaaccagaaccagaagacccagacccaagcacaagaccacccccagacccgagaccctgcagaccaagctggacttcggccccatcacccccggcaccagcagcgcccccaccaccaccaccaagagaaccagaagaccccaccccaagcccaagaccaccccccaccccgaggtgccccagaccaagctggcccccaaggtgccccagagaacccacagaccccaccccaagcccaagaccaccctgagccccgaggagctgcagaccgagctggtgcccgtgaccgacctggagcccgtgaccttcagaaccgagatccccgccaccaccctggccaccaagaccagcaagagaaccagaccccccagacccagacccaagaccacccccagcccccaggcccccgagaccaagcccgtgcccgccaccgtgctggagcccgtgaccctgagacccgaggccagcaccaccctggccagcaagaccagccagagaaccagaagacccagactgagaaccaagaccacccccagacccgaggcccccgagagcaagcccgcccccaagcagacccccagagccccccccaagcccaagaccagccccagacccagaatcccccagacccagcccgtgcccaaggtgccccagagagtgaccgccaagcccaagaccagccccagccccgaggtgagctacaccacccccgcccccaaggacgtgctgctgccccacaagccctaccccgaggtgagccagagcgagcccgcccccctggagaccagaggcatccccttcatccccatgatcagccccagccccagccaggaggagctgcagaccaccctggaggagaccgaccagagcacccaggagcccttcaccaccaagatccccagaaccaccgagctggccaagaccacccaggccccccacagattctacaccaccgtgagacccagaaccagcgacaagccccacatcagacccgtgctgaacagaaccaccaccagacccaccagacccaagcccagcggcatgcccagcggcaacggcgtgggcaccggcgtgaagcaggcccccagacccagcggcgccgacagaaacgtgagcgtggacagcacccaccccaccaagaagcccggcaccagaagaccccccctgccccccagacccacccaccccagaagaaagcccctgccccccaacaacgtgaccggcaagcccggcagcgccggcatcatcagcagcggccccatcaccaccccccccctgagaagcacccccagacccaccggcacccccctggagagaatcgagaccgacatcaagcagcccaccgtgcccgccagcggcgaggagctggagaacatcaccgacttcagcagcagccccaccagagagaccgaccccctgggcaagcccagattcaagggcccccacgtgagatacatccagaagcccgacaacagcccctgcagcatcaccgacagcgtgaagagattccccaaggaggaggccaccgagggcaacgccaccagccccccccagaacccccccaccaacctgaccgtggtgaccgtggagggctgccccagcttcgtgatcctggactgggagaagcccctgaacgacaccgtgaccgagtacgaggtgatcagcagagagaacggcagcttcagcggcaagaacaagagcatccagatgaccaaccagaccttcagcaccgtggagaacctgaagcccaacaccagctacgagttccaggtgaagcccaagaaccccctgggcgagggccccgtgagcaacaccgtggccttcagcaccgagagcgccgaccccagagtgagcgagcccgtgagcgccggcagagacgccatctggaccgagagacccttcaacagcgacagctacagcgagtgcaagggcaagcagtacgtgaagagaacctggtacaagaagttcgtgggcgtgcagctgtgcaacagcctgagatacaagatctacctgagcgacagcctgaccggcaagttctacaacatcggcgaccagagaggccacggcgaggaccactgccagttcgtggacagcttcctggacggcagaaccggccagcagctgaccagcgaccagctgcccatcaaggagggctacttcagagccgtgagacaggagcccgtgcagttcggcgagatcggcggccacacccagatcaactacgtgcagtggtacgagtgcggcaccaccatccccggcaagtggtag

SEQ ID NO: 4283 - DNA, 1584 bp, Artificial Sequence
  Description of Artificial Sequence: Synthetic coding sequence
atgctgatgctgttcgtgttcggcgtgctgctgcacgaggtgagcctgagcggccagaacgaggccccccccaacacccacagcatccccggcgagcccctgtacaactacgccagcatcagactgcccgaggagcacatccccttcttcctgcacaacaacagacacatcgccaccgtgtgcagaaaggacagcctgtgcccctacaagaagcacctggagaagctgaagtactgctggggctacgagaagagctgcaagcccgagttcagattcggctaccccgtgtgcagctacgtggacatgggctggaccgacaccctggagagcgccgaggacatcttctggaagcaggccgacttcggctacgccagagagagactggaggagatgcacgtgctgtgccagcccaaggagaccagcgacagcagcctggtgtgcagcagatacctgcagtactgcagagccaccaacctgtacctggacctgagaaacatcaagagaaaccacgacagattcaaggaggacttcttccagagcggcgagatcggcggccactgcaagctggacatcagaaccctgaccagcgagggccagagaaagagccccctgcagagctggttcgccgagctgcagagctacacccagctgaacttcagacccatcgaggacgccaagtgcgacatcgtgatcgagaagcccacctacttcatgaagctggacgccggcgtgaacatgtaccaccacttctgcgacttcatcaacctgtacatcacccagcacgtgaacaacagcttcagcaccgacgtgtacatcgtgatgtgggacaccagcagctacggctacggcgacctgttcagcgacacctggaacgccttcaccgactacgacgtgatccacctgaagacctacgacagcaagagagtgtgcttcaaggaggccgtgttcagcctgctgcccagaatgagatacggcctgttctacaacacccccctgatcagcggctgccagaacaccggcctgttcagagccttcgcccagcacgtgctgcacagactgaacatcacccaggagggccccaaggacggcaagatcagagtgaccatcctggccagaagcaccgagtacagaaagatcctgaaccagaacgagctggtgaacgccctgaagaccgtgagcaccttcgaggtgcagatcgtggactacaagtacagagagctgggcttcctggaccagctgagaatcacccacaacaccgacatcttcatcggcatgcacggcgccggcctgacccacctgctgttcctgcccgactgggccgccgtgttcgagctgtacaactgcgaggacgagagatgctacctggacctggccagactgagaggcgtgcactacatcacctggagaagacagaacaaggtgttcccccaggacaagggccaccaccccaccctgggcgagcaccccaagttcaccaactacagcttcgacgtggaggagttcatgtacctggtgctgcaggccgccgaccacgtgctgcagcaccccaagtggcccttcaagaagaagcacgacgagctgtag

SEQ ID NO: 4284 - DNA, 2004 bp, Artificial Sequence; identical to SEQ ID NO: 3682
  Description of Artificial Sequence: Synthetic coding sequence

SEQ ID NO: 4285 - DNA, 1101 bp, Artificial Sequence
  Description of Artificial Sequence: Synthetic coding sequence
atgcccatgatcagcgtgctgggcaagatgttcctgtggcagagagagggccccggcggcagatggacctgccagaccagcagaagagtgagcagcgaccccgcctgggccgtggagtggatcgagctgcccagaggcctgagcctgagcagcctgggcagcgccagaaccctgagaggctggagcagaagcagcagacccagcagcgtggacagccaggacctgcccgaggtgaacgtgggcgacaccgtggccatgctgcccaagagcagaagagccctgaccatccaggagatcgccgccctggccagaagcagcctgcacggcatcagccaggtggtgaaggaccacgtgaccaagcccaccgccatggcccagggcagagtggcccacctgatcgagtggaagggctggagcaagcccagcgacagccccgccgccctggagagcgccttcagcagctacagcgacctgagcgagggcgagcaggaggccagattcgccgccggcgtggccgagcagttcgccatcgccgaggccaagctgagagcctggagcagcgtggacggcgaggacagcaccgacgacagctacgacgaggacttcgccggcggcatggacaccgacatggccggccagctgcccctgggcccccacctgcaggacctgttcaccggccacagattcagcagacccgtgagacagggcagcgtggagcccgagagcgactgcagccagaccgtgagccccgacaccctgtgcagcagcctgtgcagcctggaggacggcctgctgggcagccccgccagactggccagccagctgctgggcgacgagctgctgctggccaagctgccccccagcagagagagcgccttcagaagcctgggccccctggaggcccaggacagcctgtacaacagccccctgaccgagagctgcctgagccccgccgaggaggagcccgccccctgcaaggactgccagcccctgtgcccccccctgaccggcagctgggagagacagagacaggccagcgacctggccagcagcggcgtggtgagcctggacgaggacgaggccgagcccgaggagcagtag

SEQ ID NO: 4286 - DNA, 5172 bp, Artificial Sequence
  Description of Artificial Sequence: Synthetic coding sequence
atgcagttccagctgaccctgttcctgcacctgggctggctgagctacagcaaggcccaggacgactgcaacagaggcgcctgccaccccaccaccggcgacctgctggtgggcagaaacacccagctgatggccagcagcacctgcggcctgagcagagcccagaagtactgcatcctgagctacctggagggcgagcagaagtgcttcatctgcgacagcagattcccctacgacccctacgaccagcccaacagccacaccatcgagaacgtgatcgtgagcttcgagcccgacagagagaagaagtggtggcagagcgagaacggcctggaccacgtgagcatcagactggacctggaggccctgttcagattcagccacctgatcctgaccttcaagaccttcagacccgccgccatgctggtggagagaagcaccgactacggccacaactggaaggtgttcaagtacttcgccaaggactgcgccaccagcttccccaacatcaccagcggccaggcccagggcgtgggcgacatcgtgtgcgacagcaagtacagcgacatcgagcccagcaccggcggcgaggtggtgctgaaggtgctggaccccagcttcgagatcgagaacccctacagcccctacatccaggacctggtgaccctgaccaacctgagaatcaacttcaccaagctgcacaccctgggcgacgccctgctgggcagaagacagaacgacagcctggacaagtactactacgccctgtacgagatgatcgtgagaggcagctgcttctgcaacggccacgccagcgagtgcagacccatgcagaagatgagaggcgacgtgttcagcccccccggcatggtgcacggccagtgcgtgtgccagcacaacaccgacggccccaactgcgagagatgcaaggacttcttccaggacgccccctggagacccgccgccgacctgcaggacaacgcctgcagaagctgcagctgcaacagccacagcagcagatgccacttcgacatgaccacctacctggccagcggcggcctgagcggcggcgtgtgcgaggactgccagcacaacaccgagggccagcactgcgacagatgcagacccctgttctacagagaccccctgaagaccatcagcgacccctacgcctgcatcccctgcgagtgcgaccccgacggcaccatcagcggcggcatctgcgtgagccacagcgaccccgccctgggcagcgtggccggccagtgcctgtgcaaggagaacgtggagggcgccaagtgcgaccagtgcaagcccaaccactacggcctgagcgccaccgaccccctgggctgccagccctgcgactgcaaccccctgggcagcctgcccttcctgacctgcgacgtggacaccggccagtgcctgtgcctgagctacgtgaccggcgcccactgcgaggagtgcaccgtgggctactggggcctgggcaaccacctgcacggctgcagcccctgcgactgcgacatcggcggcgcctacagcaacgtgtgcagccccaagaacggccagtgcgagtgcagaccccacgtgaccggcagaagctgcagcgagcccgcccccggctacttcttcgcccccctgaacttctacctgtacgaggccgaggaggccaccaccctgcagggcctggcccccctgggcagcgagaccttcggccagagccccgccgtgcacgtggtgctgggcgagcccgtgcccggcaaccccgtgacctggaccggccccggcttcgccagagtgctgcccggcgccggcctgagattcgccgtgaacaacatccccttccccgtggacttcaccatcgccatccactacgagacccagagcgccgccgactggaccgtgcagatcgtggtgaacccccccggcggcagcgagcactgcatccccaagaccctgcagagcaagccccagagcttcgccctgcccgccgccaccagaatcatgctgctgcccacccccatctgcctggagcccgacgtgcagtacagcatcgacgtgtacttcagccagcccctgcagggcgagagccacgcccacagccacgtgctggtggacagcctgggcctgatcccccagatcaacagcctggagaacttctgcagcaagcaggacctggacgagtaccagctgcacaactgcgtggagatcgccagcgccatgggcccccaggtgctgcccggcgcctgcgagagactgatcatcagcatgagcgccaagctgcacgacggcgccgtggcctgcaagtgccacccccagggcagcgtgggcagcagctgcagcagactgggcggccagtgccagtgcaagcccctggtggtgggcagatgctgcgacagatgcagcaccggcagctacgacctgggccaccacggctgccacccctgccactgccacccccagggcagcaaggacaccgtgtgcgaccaggtgaccggccagtgcccctgccacggcgaggtgagcggcagaagatgcgacagatgcctggccggctacttcggcttccccagctgccacccctgcccctgcaacagattcgccgagctgtgcgaccccgagaccggcagctgcttcaactgcggcggcttcaccaccggcagaaactgcgagagatgcatcgacggctactacggcaaccccagcagcggccagccctgcagaccctgcctgtgccccgacgaccccagcagcaaccagtacttcgcccacagctgctaccagaacctgtggagcagcgacgtgatctgcaactgcctgcagggctacaccggcacccagtgcggcgagtgcagcaccggcttctacggcaaccccagaatcagcggcgccccctgccagccctgcgcctgcaacaacaacatcgacgtgaccgaccccgagagctgcagcagagtgaccggcgagtgcctgagatgcctgcacaacacccagggcgccaactgccagctgtgcaagcccggccactacggcagcgccctgaaccagacctgcagaagatgcagctgccacgccagcggcgtgagccccatggagtgcccccccggcggcggcgcctgcctgtgcgaccccgtgaccggcgcctgcccctgcctgcccaacgtgaccggcctggcctgcgacagatgcgccgacggctactggaacctggtgcccggcagaggctgccagagctgcgactgcgaccccagaaccagccagagcagccactgcgaccagctgaccggccagtgcccctgcaagctgggctacggcggcaagagatgcagcgagtgccaggagaactactacggcgacccccccggcagatgcatcccctgcgactgcaacagagccggcacccagaagcccatctgcgaccccgacaccggcatgtgcagatgcagagagggcgtgagcggccagagatgcgacagatgcgccagaggccacagccaggagttccccacctgcctgcagtgccacctgtgcttcgaccagtgggaccacaccatcagcagcctgagcaaggccgtgcagggcctgatgagactggccgccaacatggaggacaagagagagaccctgcccgtgtgcgaggccgacttcaaggacctgagaggcaacgtgagcgagatcgagagaatcctgaagcaccccgtgttccccagcggcaagttcctgaaggtgaaggactaccacgacagcgtgagaagacagatcatgcagctgaacgagcagctgaaggccgtgtacgagttccaggacctgaaggacaccatcgagagagccaagaacgaggccgacctgctgctggaggacctgcaggaggagatcgacctgcagagcagcgtgctgaacgccagcatcgccgacagcagcgagaacatcaagaagtactaccacatcagcagcagcgccgagaagaagatcaacgagaccagcagcaccatcaacaccagcgccaacaccagaaacgacctgctgaccatcctggacaccctgaccagcaagggcaacctgagcctggagagactgaagcagatcaagatccccgacatccagatcctgaacgagaaggtgtgcggcgaccccggcaacgtgccctgcgtgcccctgccctgcggcggcgccctgtgcaccggcagaaagggccacagaaagtgcagaggccccggctgccacggcagcctgaccctgagcaccaacgccctgcagaaggcccaggaggccaagagcatcatcagaaacctggacaagcaggtgagaggcctgaagaaccagatcgagagcatcagcgagcaggccgaggtgagcaagaacaacgccctgcagctgagagagaagctgggcaacatcagaaaccagagcgacagcgaggaggagaacatcaacctgttcatcaagaaggtgaagaacttcctgctggaggagaacgtgccccccgaggacatcgagaaggtggccaacggcgtgctggacatccacctgcccatccccagccagaacctgaccgacgagctggtgaagatccagaagcacatgcagctgtgcgaggactacagaaccgacgagaacagactgaacgaggaggccgacggcgcccagaagctgctggtgaaggccaaggccgccgagaaggccgccaacatcctgctgaacctggacaagaccctgaaccagctgcagcaggcccagatcacccagggcagagccaacagcaccatcacccagctgaccgccaacatcaccaagatcaagaagaacgtgctgcaggccgagaaccagaccagagagatgaagagcgagctggagctggccaagcagagaagcggcctggaggacggcctgagcctgctgcagaccaagctgcagagacaccaggaccacgccgtgaacgccaaggtgcaggccgagagcgcccagcaccaggccggcagcctggagaaggagttcgtggagctgaagaagcagtacgccatcctgcagagaaagaccagcaccaccggcctgaccaaggagaccctgggcaaggtgaagcagctgaaggacgccgccgagaagctggccggcgacaccgaggccaagatcagaagaatcaccggctgcttccagaacagcgccagatag

SEQ ID NO: 4287 - DNA, 5286 bp, Artificial Sequence
  Description of Artificial Sequence: Synthetic coding sequence
atgcagttccagctgaccctgttcctgcacctgggctggctgagctacagcaaggcccaggacgactgcaacagaggcgcctgccaccccaccaccggcgacctgctggtgggcagaaacacccagctgatggccagcagcacctgcggcctgagcagagcccagaagtactgcatcctgagctacctggagggcgagcagaagtgcttcatctgcgacagcagattcccctacgacccctacgaccagcccaacagccacaccatcgagaacgtgatcgtgagcttcgagcccgacagagagaagaagtggtggcagagcgagaacggcctggaccacgtgagcatcagactggacctggaggccctgttcagattcagccacctgatcctgaccttcaagaccttcagacccgccgccatgctggtggagagaagcaccgactacggccacaactggaaggtgttcaagtacttcgccaaggactgcgccaccagcttccccaacatcaccagcggccaggcccagggcgtgggcgacatcgtgtgcgacagcaagtacagcgacatcgagcccagcaccggcggcgaggtggtgctgaaggtgctggaccccagcttcgagatcgagaacccctacagcccctacatccaggacctggtgaccctgaccaacctgagaatcaacttcaccaagctgcacaccctgggcgacgccctgctgggcagaagacagaacgacagcctggacaagtactactacgccctgtacgagatgatcgtgagaggcagctgcttctgcaacggccacgccagcgagtgcagacccatgcagaagatgagaggcgacgtgttcagcccccccggcatggtgcacggccagtgcgtgtgccagcacaacaccgacggccccaactgcgagagatgcaaggacttcttccaggacgccccctggagacccgccgccgacctgcaggacaacgcctgcagaagctgcagctgcaacagccacagcagcagatgccacttcgacatgaccacctacctggccagcggcggcctgagcggcggcgtgtgcgaggactgccagcacaacaccgagggccagcactgcgacagatgcagacccctgttctacagagaccccctgaagaccatcagcgacccctacgcctgcatcccctgcgagtgcgaccccgacggcaccatcagcggcggcatctgcgtgagccacagcgaccccgccctgggcagcgtggccggccagtgcctgtgcaaggagaacgtggagggcgccaagtgcgaccagtgcaagcccaaccactacggcctgagcgccaccgaccccctgggctgccagccctgcgactgcaaccccctgggcagcctgcccttcctgacctgcgacgtggacaccggccagtgcctgtgcctgagctacgtgaccggcgcccactgcgaggagtgcaccgtgggctactggggcctgggcaaccacctgcacggctgcagcccctgcgactgcgacatcggcggcgcctacagcaacgtgtgcagccccaagaacggccagtgcgagtgcagaccccacgtgaccggcagaagctgcagcgagcccgcccccggctacttcttcgcccccctgaacttctacctgtacgaggccgaggaggccaccaccctgcagggcctggcccccctgggcagcgagaccttcggccagagccccgccgtgcacgtggtgctgggcgagcccgtgcccggcaaccccgtgacctggaccggccccggcttcgccagagtgctgcccggcgccggcctgagattcgccgtgaacaacatccccttccccgtggacttcaccatcgccatccactacgagacccagagcgccgccgactggaccgtgcagatcgtggtgaacccccccggcggcagcgagcactgcatccccaagaccctgcagagcaagccccagagcttcgccctgcccgccgccaccagaatcatgctgctgcccacccccatctgcctggagcccgacgtgcagtacagcatcgacgtgtacttcagccagcccctgcagggcgagagccacgcccacagccacgtgctggtggacagcctgggcctgatcccccagatcaacagcctggagaacttctgcagcaagcaggacctggacgagtaccagctgcacaactgcgtggagatcgccagcgccatgggcccccaggtgctgcccggcgcctgcgagagactgatcatcagcatgagcgccaagctgcacgacggcgccgtggcctgcaagtgccacccccagggcagcgtgggcagcagctgcagcagactgggcggccagtgccagtgcaagcccctggtggtgggcagatgctgcgacagatgcagcaccggcagctacgacctgggccaccacggctgccacccctgccactgccacccccagggcagcaaggacaccgtgtgcgaccaggtgaccggccagtgcccctgccacggcgaggtgagcggcagaagatgcgacagatgcctggccggctacttcggcttccccagctgccacccctgcccctgcaacagattcgccgagctgtgcgaccccgagaccggcagctgcttcaactgcggcggcttcaccaccggcagaaactgcgagagatgcatcgacggctactacggcaaccccagcagcggccagccctgcagaccctgcctgtgccccgacgaccccagcagcaaccagtacttcgcccacagctgctaccagaacctgtggagcagcgacgtgatctgcaactgcctgcagggctacaccggcacccagtgcggcgagtgcagcaccggcttctacggcaaccccagaatcagcggcgccccctgccagccctgcgcctgcaacaacaacatcgacgtgaccgaccccgagagctgcagcagagtgaccggcgagtgcctgagatgcctgcacaacacccagggcgccaactgccagctgtgcaagcccggccactacggcagcgccctgaaccagacctgcagaagatgcagctgccacgccagcggcgtgagccccatggagtgcccccccggcggcggcgcctgcctgtgcgaccccgtgaccggcgcctgcccctgcctgcccaacgtgaccggcctggcctgcgacagatgcgccgacggctactggaacctggtgcccggcagaggctgccagagctgcgactgcgaccccagaaccagccagagcagccactgcgaccagctgaccggccagtgcccctgcaagctgggctacggcggcaagagatgcagcgagtgccaggagaactactacggcgacccccccggcagatgcatcccctgcgactgcaacagagccggcacccagaagcccatctgcgaccccgacaccggcatgtgcagatgcagagagggcgtgagcggccagagatgcgacagatgcgccagaggccacagccaggagttccccacctgcctgcagtgccacctgtgcttcgaccagtgggaccacaccatcagcagcctgagcaaggccgtgcagggcctgatgagactggccgccaacatggaggacaagagagagaccctgcccgtgtgcgaggccgacttcaaggacctgagaggcaacgtgagcgagatcgagagaatcctgaagcaccccgtgttccccagcggcaagttcctgaaggtgaaggactaccacgacagcgtgagaagacagatcatgcagctgaacgagcagctgaaggccgtgtacgagttccaggacctgaaggacaccatcgagagagccaagaacgaggccgacctgctgctggaggacctgcaggaggagatcgacctgcagagcagcgtgctgaacgccagcatcgccgacagcagcgagaacatcaagaagtactaccacatcagcagcagcgccgagaagaagatcaacgagaccagcagcaccatcaacaccagcgccaacaccagaaacgacctgctgaccatcctggacaccctgaccagcaagggcaacctgagcctggagagactgaagcagatcaagatccccgacatccagatcctgaacgagaaggtgtgcggcgaccccggcaacgtgccctgcgtgcccctgccctgcggcggcgccctgtgcaccggcagaaagggccacagaaagtgcagaggccccggctgccacggcagcctgaccctgagcaccaacgccctgcagaaggcccaggaggccaagagcatcatcagaaacctggacaagcaggtgagaggcctgaagaaccagatcgagagcatcagcgagcaggccgaggtgagcaagaacaacgccctgcagctgagagagaagctgggcaacatcagaaaccagagcgacagcgaggaggagaacatcaacctgttcatcaagaaggtgaagaacttcctgctggaggagaacgtgccccccgaggacatcgagaaggtggccaacggcgtgctggacatccacctgcccatccccagccagaacctgaccgacgagctggtgaagatccagaagcacatgcagctgtgcgaggactacagaaccgacgagaacagactgaacgaggaggccgacggcgcccagaagctgctggtgaaggccaaggccgccgagaaggccgccaacatcctgctgaacctggacaagaccctgaaccagctgcagcaggcccagatcacccagggcagagccaacagcaccatcacccagctgaccgccaacatcaccaagatcaagaagaacgtgctgcaggccgagaaccagaccagagagatgaagagcgagctggagctggccaagcagagaagcggcctggaggacggcctgagcctgctgcagaccaagctgcagagacaccaggaccacgccgtgaacgccaaggtgcaggccgagagcgcccagcaccaggccggcagcctggagaaggagttcgtggagctgaagaagcagtacgccatcctgcagagaaagaccagcaccaccggcctgaccaaggagaccctgggcaaggtgaagcagctgaaggacgccgccgagaagctggccggcgacaccgaggccaagatcagaagaatcaccgacctggagagaaagatccaggacctgaacctgagcagacaggccaaggccgaccagctgagaatcctggaggaccaggtggtggccatcaagaacgagatcgtggagcaggagaagaagtacgccagatgctacagctag

SEQ ID NO: 4288 - DNA, 1455 bp, Artificial Sequence
  Description of Artificial Sequence: Synthetic coding sequence
atgggcgccgaggccctgcccggccccgacgaggccgccgccgccgccgccttcgccgaggtgaccaccgtgaccgtggccaacgtgggcgccgccgccgacaacgtgttcaccaccagcgtggccaacgccgccagcatcagcggccacgtgctgagcggcagaaccgccctgcagatcggcgacagcctgaacaccgagaaggccaccctgatcgtggtgcacaccgacggcagcatcgtggagaccaccggcctgaagggccccgccgcccccctgacccccggcccccagagcccccccacccccctggcccccggccaggagaagggcggcaccaagtacaactgggaccccagcgtgtacgacagcgagctgcccgtgagatgcagaaacatcagcggcaccctgtacaagaacagactgggcagcggcggcagaggcagatgcatcaagcagggcgagaactggtacagccccaccgagttcgaggccatggccggcagagccagcagcaaggactggaagagaagcatcagatacgccggcagacccctgcagtgcctgatccaggacggcatcctgaacccccacgccgccagctgcacctgcgccgcctgctgcgacgacatgaccctgagcggccccgtgagactgttcgtgccctacaagagaagaaagaaggagaacgagctgcccaccacccccgtgaagaaggacagccccaagaacatcaccctgctgcccgccaccgccgccaccaccttcaccgtgacccccagcggccagatcaccaccagcggcgccctgaccttcgacagagccagcaccgtggaggccaccgccgtgatcagcgagagccccgcccagggcgacgtgttcgccggcgccaccgtgcaggaggccagcgtgcagcccccctgcagagccagccaccccgagccccactaccccggctaccaggacagctgccagatcgcccccttccccgaggccgccctgcccaccagccaccccaagatcgtgctgaccagcctgcccgccctggccgtgcccccccccacccccaccaaggccgccccccccgccctggtgaacggcctggagctgagcgagcccagaagctggctgtacctggaggagatggtgaacagcctgctgaacaccgcccagcagctgaagaccctgttcgagcaggccaagcacgccagcacctacagagaggccgccaccaaccaggccaagatccacgccgacgccgagagaaaggagcagagctgcgtgaactgcggcagagaggccatgagcgagtgcaccggctgccacaaggtgaactactgcagcaccttctgccagagaaagagatggagcctgaccatgctgaccagcctggtgagcatcagctggctgagagccatcctgccctgccagccccccaaggtgctgggcctgtag

SEQ ID NO: 4289 - DNA, 1512 bp, Artificial Sequence
  Description of Artificial Sequence: Synthetic coding sequence
atgagcggcgccctgctgtggcccctgctgcccctgctgctgctgctgctgagcgccagagacggcgtgagagccgcccagccccaggcccccggctacctgatcgccgcccccagcgtgttcagagccggcgtggaggaggtgatcagcgtgaccatcttcaacagccccagagaggtgaccgtgcaggcccagctggtggcccagggcgagcccgtggtgcagagccagggcgccatcctggacaagggcaccatcaagctgaaggtgcccaccggcctgagaggccaggccctgctgaaggtgtggggcagaggctggcaggccgaggagggccccctgttccacaaccagaccagcgtgaccgtggacggcagaggcgccagcgtgttcatccagaccgacaagcccgtgtacagaccccagcacagagtgctgatcagcatcttcaccgtgagccccaacctgagacccgtgaacgagaagctggaggcctacatcctggaccccagaggcagcagaatgatcgagtggagacacctgaagcccttctgctgcggcatcaccaacatgagcttccccctgagcgaccagcccgtgctgggcgagtggttcatcttcgtggagatgcagggccacgcctacaacaagagcttcgaggtgcagaagtacgtgctgcccaagttcgagctgctgatcgacccccccagatacatccaggacctggacgcctgcgagaccggcaccgtgagagccagatacaccttcggcaagcccgtggccggcgccctgatgatcaacatgaccgtgaacggcgtgggctactacagccacgaggtgggcagacccgtgctgagaaccaccaagatcctgggcagcagagacttcgacatctgcgtgagagacatgatccccgccgacgtgcccgagcacttcagaggcagagtgagcatctgggccatggtgaccagcgtggacggcagccagcaggtggccttcgacgacagcacccccgtgcagagacagctggtggacatcagatacagcaaggacaccagaaagcagttcaagcccggcctggcctacgtgggcaaggtggagctgagctaccccgacggcagccccgccgagggcgtgaccgtgcagatcaaggccgagctgacccccaaggacaacatctacaccagcgaggtggtgagccagagaggcctggtgggcttcgagatccccagcatccccaccagcgcccagcacgtgtggctggaggtgttccaggagctggaggactacgacgtgagcgacagcttcggcgtgagcagagaggacggccccttctggtgggccggcctgaccgcccagagaagaagaagaagcagcgtgttcccctggccctggggcatcaccaaggacagcggcttcgccttcaccgtgagaagaggcaacggcaccggcggcgacgacagacccagcgagcccgagccccccgccggcagatggcccctgcacagatag

SEQ ID NO: 4290 - DNA, 144 bp, Artificial Sequence
  Description of Artificial Sequence: Synthetic coding sequence
atgaagctgtgcgtgaccgtgctgagcctgctggtgctggtggccgccttctgcagcctggccctgagcgcccccaaggccagcaagagcgccctgacccccgtgagccccggcagcagaagcacctgcatgacctggaactag

SEQ ID NO: 4291 - DNA, 861 bp, Artificial Sequence
  Description of Artificial Sequence: Synthetic coding sequence
atggaggtgtacatcagacacctggagaaggtgctgagaagatacgtgcagagactgcagtggctgctgagcggccccgtgctgtgcagcagaacctggtacagacagagcatggacagaggcgtgatgatgaccgccgccagcggcagcagaagactgttcggcaccgtgctggagagcaaggtgtgcatcctgctggacaccagcggcagcatgggcccctacctgcagcaggtgaagaccgagctggtgctgctgatctgggagcagctgagaaagtgctgcgacagcttcaacctgctgagcttcgccgagagcttccagagctggcaggacaccctggtggagaccaccgacgccgcctgccacgaggccatgcagtgggtgacccacctgcaggcccagggcagcaccagcatcctgcaggccctgctgaaggccttcagcttccacgacctggagggcctgtacctgctgaccgacggcaagcccgacaccagctgcagcctggtgctgaacgaggtgcagaagctgagagagaagagagacgtgaaggtgcacaccatcagcctgaactgcagcgacagagccgccgtggagttcctgagaaagctggccagcttcaccggcggcagataccactgccccgtgggcgaggacaccctgagcaagatccacagcctgctgaccaagggcttcatcaacgagaaggaccccaccctgccccccttcgagggcgacgacctgagaatcctggcccaggagatcaccaaggccagaagcttcctgtggcaggcccagagcttcagaagccagctgcagaagaagaacgacgccgagcccaaggtgaccctgagctag

SEQ ID NO: 4292 - DNA, 3555 bp, Artificial Sequence
  Description of Artificial Sequence: Synthetic coding sequence
atgaagaagtacagaaagatcagcatcggctgcttcgccatggccacccagaccagccacgtgttccacggccaggagaacatgttcctggagaaccactgcatcagaagaaacaccggcagagacagcaagaagcccctgaagcagaagaacatgaacggcctgggccagaacagcgacaacggcctgctggtgacccacgtgaaccagacccaggacctgctgagactgcagggcagcgagacccagagcagcgactgggaggacagcgaggactggctgagcgcccacagcctgaagtgccagaagctgaccctggccgacctgatcagccagggcaccgaggtgctggaggagggcaccaacgtggtgcagaagatctgcttcagcacccagatcatcagacacttcgagagcaagctgagcgacaccatcgaggtgtaccaggagagaatccagtggctgaccgagaacagcaagaaggccttcggcctgatcaagggcgccagagtgagcatcctgatcgacgtgagcgccatcagcagcggcccccagaaggaggagttccagaaggacctgatgagcctgatcgacgagcagctgagccacaaggagaagctgttcgtgctgagcttcggcaccaacgccggcagcctgtggcccgaccccatggaggtgagcgccagcaccctgcaggagctgaagctgtgggtgaagaccctgcagcccgacggcggcagcaacctgctgcaggccctgaagaagatcttcaccctgaagggcctggacagcctggtggccatcatgagaagctgccccgaccagcccagcgagatcctgagcgactacatccagcagagcaccatgggcagagacctgatcatccacttcatcacctacagatgcgacgaccagatgccccccgccgtgctgaagaacctggccgaggccgtgagaggctactaccactgctacagccccaagatggagcactacaccagcagagacatggacgagctgctggccgagatccagaaggcccagagcctgctgagccacgtgcaggccctgcagcacagcagcccctgcgaggccctgacctgcaccatggaggagatcagcaccgagatcaccaacggccccctgatcagcctgctgcccaagccccccaagcacgacgcccccctgaccatcgagttccccaacctggacaagaccagcgccgagtggctgaaggtgaacggcctgaaggccaagaagctgagcctgtaccaggtgctggcccccaacgccttcagccccgtggaggagttcgtgcccatcctgcagaagaccgtgagcagcaccatccacgagaaggccatgatccagttcgagtggcacgacggcaccgtgaagaacatccacgtggacccccccttcctgtacaagtaccagcagcagctgagcagagccatgagaatgtacgagagaagaatcgagtggctgagcctggccagcagaagaatctggggcaccgtgtgcgagaagagagtggtggtgctgctggacatcagcgccaccaacagcatgtacatcatccacatccagcacagcctgagactgctgctggaggagcagctgagcaacaaggactgcttcaacctgatcgccttcggcagcaccatcgagagctggagacccgagatggtgcccgtgagccacaacaacctgcagagcgcctggagatgggccctgaacctgagatgcagaggcagcagaaacgtgctgagcgccctgagaaaggccgtggaggtggacttcaaggacaaggacaagcaccagagccagggcatctacctgttcaccggcggcatccccgaccaggacatgcccaccctgagcgcctacatggccgaggcctgcggcggctgcgacctgcagctgaacgtgtgcctgttctacgtgggcgagcccaagatggacaccaccccccccgccagatacgccagccacaccgacaccgccgccgcctacaaggaggtgaccagagccgccggcggcagattccactggttcggcgacaccggcatctacgagagcgacgacatcaacagcatcatgagcgagatggagaaggccctgaactacagccagaagtgcgccttcctgatggccagcctgaagaaccacagcggcaaggtgctgggcagcagcgccctgcccaaggagaagcccaagaccctgcagctgagaagccagcccaagaagctgtgcccccccagacccaccgtgcccctgggcgccagaatgagcatcaaggacgaccccgacagagagaagagcccccccctgaagagcctgaagtggagacccctgagcagcagagtgggcatcagccccgccgccgcccagcccaccaaggagggcatgatggagctgagaagaaagaccaagagcagagaggccgagaccagcctgctgctgttctacaccgagaagggcaacgacgtgggcagcgtgtacaagaagtacccccagggcagaggcctgagaagaaccagcagcagcatcgacctgcccagaaaggacaccgtgtgcagcagccaggagtgggtggccaagtacggcctgaagaagctgaagctggagatcagcagatgcatgggccccaactgcacccaccagaagagcggccagagaagcgccagcgccaagcactgcagcatcttccccagcgtggagatccacggcgtggtgagacacatccagtggacccccagagagatggaggtgtacatcagacacctggagaaggtgctgagaagatacgtgcagagactgcagtggctgctgagcggcagcagaagactgttcggcaccgtgctggagagcaaggtgtgcatcctgctggacaccagcggcagcatgggcccctacctgcagcaggtgaagaccgagctggtgctgctgatctgggagcagctgagaaagtgctgcgacagcttcaacctgctgagcttcgccgagagcttccagagctggcaggacaccctggtggagaccaccgacgccgcctgccacgaggccatgcagtgggtgacccacctgcaggcccagggcagcaccagcatcctgcaggccctgctgaaggccttcagcttccacgacctggagggcctgtacctgctgaccgacggcaagcccgacaccagctgcagcctggtgctgaacgaggtgcagaagctgagagagaagagagacgtgaaggtgcacaccatcagcctgaactgcagcgacagagccgccgtggagttcctgagaaagctggccagcttcaccggcggcagataccactgccccgtgggcgaggacaccctgagcaagatccacagcctgctgaccaagggcttcatcaacgagaaggaccccaccctgccccccttcgagggcgacgacctgagaatcctggcccaggagatcaccaaggccagaagcttcctgtggcaggcccagagcttcagaagccagctgcagaagaagaacgacgccgagcccaaggtgaccctgagctag

SEQ ID NO: 4293 - DNA, 906 bp, Artificial Sequence; identical to SEQ ID NO: 3587
  Description of Artificial Sequence: Synthetic coding sequence

SEQ ID NO: 4294 - DNA, 4722 bp, Artificial Sequence
  Description of Artificial Sequence: Synthetic coding sequence
atgagagtgctggcctgcctgctggccgccctggtgggcatccaggccgtggagagactgagactggccgacggcccccacggctgcgccggcagactggaggtgtggcacggcggcagatggggcaccgtgtgcgacgacggctgggacctgagagacgccgccgtggcctgcagacagctgggctgcggcggcgccctggccgcccccggcggcgccttcttcggcgagggcgccggccccgtgtggctgagcgagctggcctgcagaggcaacgagggccagctgggcctgtgccaccacagaggctggaaggcccacatctgcagccacgaggaggacgccggcgtggtgtgcgccggccagagagtggccaacagcagagacgacagcaccagccccctggacggcgccccctggcccggcctgctgctggagctgagccccagcaccgaggagcccctggtgacccacgcccccagacccgccggcaacccccagaacgccagcagaaagaagagccccagacccaagcaggccaagagcaccagagcccccctgctgaccaccggcgcccccagacaggagagactgagactggtgagcggcccccacagatgcgccggcagactggaggtgtggcacggcggcagatggggcaccgtgtgcgacgacggctgggacctgagagacgccgccgtggcctgcagagagctgggctgcggcggcgccctggccgcccccggcggcgccagattcggccccggcgccggccccgtgtggatggacgacgtgggctgcggcggcggcgagcaggccctgagagactgccccagaagcccctggggcagaagcaactgcgaccacagcgaggacgccggcctggtgtgcaccggccccgcccccagactgagactggccgacggcccccacggctgcgccggcagactggaggtgtggcacggcggcagatggggcagcgtgtgcgacgacgcctgggacctgagagacgccgccgtggcctgcagagagctgggctgcggcggcgccctggccgcccccggcggcgccttcttcggcgagggcagcggccccatcatcctggacgacctgagatgcagaggcaacgagaccgccctgagattctgccccgccagaccctggggccagcacgactgccaccacagagaggacgccggcgccgtgtgcgacggcatgcccctgggctacgtgccccccaccgcccccaccgacagcaacaacagcacccccagagaggccgccagcagaccccccagcaccatgaccagccaggcccccggcaccgccggcgtgagccccccccccgccagccccaccgtgctgtgggagcccggccccgaggccggcagcccccagctgagactggtggccggccccagcaagtgcagcggcagactggaggtgtggcacgaccagagatggggcaccgtgtgcgacgacagctgggacatgagagacagcgccgtggtgtgcagagagctgggctgcggcggcccccagcagcccgaccccgccgccggcagattcggctggggcgccggccccatctggctggacgacgtgggctgcgtgggcaccgaggccagcctgagcgactgccccgccgccccctggggcaagcacaactgcgcccacaacgaggacgtgggcgtgacctgcaccggcccccccggcctggacagcatcagcgaccccttcagctggagctggatccccggcctgggcagagacagagacgcctggctgcccggcgagctggccaccaagcccagcgccagcgtgaccgccagcgtgctggagaagaccaccaccaaggcccccggcaagatgcccaagagcaccaagaagtgggtgaccaagaacgccaagagacccaccacccagccccccgtgatgcccaccaccaagcacagcagagcccagagcccccccgacctgaccagccagaccaccgccgccctgaccaccgaggccagcagaagacccaccagcgagttcaccagaagacccaccaccgaggccccccagagatggaccagccacaccaccgccaccctgaccccccaggcccccagagagagaaccaccaagaccatggccatgctgaccacccagggcccccaggagatgaccagcgagagcaccatcaagagcatcccccaggccagcctggagcccagcgccgagatccccgagggcagccccgagagccccaaggaccccgcccccagccccagcgtgagcaccaccggcgagagcggcctgttcagagtgagactggccgacggccccaacagatgcgccggcagactggaggtgtggcacgccggcagatggggcaccgtgtgcgacgacaactgggacctgagagacgccaccgtggcctgctgggagctgggctgcggcaaggtgagacccagagtgggcaagacccactacggccccggcaccggccccatctggctggacgacatgggctgcaagggcagcgaggccagcctgagcgactgccccagcggcgcctggggcaagcacaactgcgaccacgaggaggacgtgggcctgacctgcaccggctacaccgactacgacgactaccccccctggacctgggaccccaccagcagagaggacctggccaagggcaccaccaccgccggcgtgcccggccacaccctgccctggagaaccaccagaagacccggcagcagcagccccgccatcagaagactgcccgacaccggcagcaaggacggctacaagctgccctggacctgggacacccccagcggcagaggcctggccgagggcacccccaccgccggcaagctgggccccaccctgggcgccggcaccaccagaagccccggcagcccccccaccctgagagtgcacggcgacaccggcagccccagaaagccctggcccgagagaagaccccccagacccgccgccaccagaaccgccccccccacccccagccccggccccagcgccagccccggcccccccggccccgccctgaccagcgacagcagcagagagctgaccccccacagcgccctgaccagcgaggccaccagcgacgcccccgacaccagcccccccacccccgaccccgccagcagaaccaaccccgacctgatcctgaccagccccgacttcgccctgagcacccccgacagcagcgtggtgcccgccctgacccccgagcccagccccacccccctgcccaccctgcccaaggagctgaccagcgaccccagcacccccagcgaggtgaccagcctgagccccaccagcgagcaggtgcccgagagcgacaccacccccgacctggacaccaccccctacagcagcaccgtgagcgagtacagcagaagccccgaccccagccccagcccccaccccaccaccacccccgaccccaccatggcccccgaccccatcaccaccctgaaccccaccgtgaccccccacttccccaccaccccccaccccaccaccaccccccaccccaccaccatcacccacagcaccatgatccccgaccccaccaccaccccccagcccttcaccaccatcacccacagcaccatgatccccgaccccaccaccaccccccagcccttcaccaccatgcagcccaccaccaccccccacagcaccaccccccaccccaccaccaccccccaccccaccaccatcacccacagcaccatgatccccgaccccaccaccaccccccagcccttcaccaccatgcagcccaccaccatgccccaccccaccaccaccccccaccccaccaccaccccccaccccaccaccaccccccaccccaccaccaccccccaccccaccatgacccccgaccccaccaccaccccctaccccaccaccacccccgaccccaccaccaccccccaccccaccacccccgaccccagcagcacccccgtgatcaccaccgtgagcctgcccaccagcctgggcaccgagctgagcagccccaccctggcccccaccgtgaagcccagcctgcacccccagctgaccttcaccgcccccgccccccacaccagcaccagccagatccccaccctggagcccagccccgccctggagagcagccccagcagaagcagcaccgccaccagcatggaccccctgagcaccgaggacttcaagccccccagaagccagagccccaacctgacccccccccccacccacaccccccacagcgccagcgacctgaccgtgagccccgaccccctgctgagccccaccgcccaccccctggaccacccccccctggaccccctgaccctgggccccacccccggccagagccccggcccccacggcccctgcgtggcccccaccccccccgtgagagtgatggcctgcgagccccccgccctggtggagctggtggccgccgtgagagacgtgggcggccagctgcagagactgacccaggtggtggagcaggagagacaggagagacaggccctgctgctgggcctgacccagctggtggaggccgccagaggcctgggccagctgggcgaggccgtgaagagactggccgagatggcctggaccaccagcatgcccgcccccaccaccaccacccccgaggaggaggagagacccctgagaggcgacgtgtag

SEQ ID NO: 4295 - DNA, 1911 bp, Artificial Sequence; identical to SEQ ID NO: 3895
  Description of Artificial Sequence: Synthetic coding sequence

SEQ ID NO: 4296 - DNA, 2037 bp, Artificial Sequence
  Description of Artificial Sequence: Synthetic coding sequence
atgagaaccgtggtgctgaccatgaaggccagcgtgatcgagatgttcctggtgctgctggtgaccggcgtgcacagcaacaaggagaccgccaagaagatcaagagacccaagttcaccgtgccccagatcaactgcgacgtgaaggccggcaagatcatcgaccccgagttcatcgtgaagtgccccgccggctgccaggaccccaagtaccacgtgtacggcaccgacgtgtacgccagctacagcagcgtgtgcggcgccgccgtgcacagcggcgtgctggacaacagcggcggcaagatcctggtgagaaaggtggccggccagagcggctacaagggcagctacagcaacggcgtgcagagcctgagcctgcccagatggagagagagcttcatcgtgctggagagcaagcccaagaagggcgtgacctaccccagcgccctgacctacagcagcagcaagagccccgccgcccaggccggcgagaccaccaaggcctaccagagaccccccatccccggcaccaccgcccagcccgtgaccctgatgcagctgctggccgtgaccgtggccgtggccacccccaccaccctgcccagacccagccccagcgccgccagcaccaccagcatccccagaccccagagcgtgggccacagaagccaggagatggacctgtggagcaccgccacctacaccagcagccagaacagacccagagccgaccccggcatccagagacaggaccccagcggcgccgccttccagaagcccgtgggcgccgacgtgagcctgggcctggtgcccaaggaggagctgagcacccagagcctggagcccgtgagcctgggcgaccccaactgcaagatcgacctgagcttcctgatcgacggcagcaccagcatcggcaagagaagattcagaatccagaagcagctgctggccgacgtggcccaggccctggacatcggccccgccggccccctgatgggcgtggtgcagtacggcgacaaccccgccacccacttcaacctgaagacccacaccaacagcagagacctgaagaccgccatcgagaagatcacccagagaggcggcctgagcaacgtgggcagagccatcagcttcgtgaccaagaacttcttcagcaaggccaacggcaacagaagcggcgcccccaacgtggtggtggtgatggtggacggctggcccaccgacaaggtggaggaggccagcagactggccagagagagcggcatcaacatcttcttcatcaccatcgagggcgccgccgagaacgagaagcagtacgtggtggagcccaacttcgccaacaaggccgtgtgcagaaccaacggcttctacagcctgcacgtgcagagctggttcggcctgcacaagaccctgcagcccctggtgaagagagtgtgcgacaccgacagactggcctgcagcaagacctgcctgaacagcgccgacatcggcttcgtgatcgacggcagcagcagcgtgggcaccggcaacttcagaaccgtgctgcagttcgtgaccaacctgaccaaggagttcgagatcagcgacaccgacaccagaatcggcgccgtgcagtacacctacgagcagagactggagttcggcttcgacaagtacagcagcaagcccgacatcctgaacgccatcaagagagtgggctactggagcggcggcaccagcaccggcgccgccatcaacttcgccctggagcagctgttcaagaagagcaagcccaacaagagaaagctgatgatcctgatcaccgacggcagaagctacgacgacgtgagaatccccgccatggccgcccacctgaagggcgtgatcacctacgccatcggcgtggcctgggccgcccaggaggagctggaggtgatcgccacccaccccgccagagaccacagcttcttcgtggacgagttcgacaacctgcaccagtacgtgcccagaatcatccagaacatctgcaccgagttcaacagccagcccagaaactag

SEQ ID NO: 4297 - DNA, 324 bp, Artificial Sequence
  Description of Artificial Sequence: Synthetic coding sequence
tgaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgctag

SEQ ID NO: 4298 - DNA, 366 bp, Artificial Sequence
  Description of Artificial Sequence: Synthetic coding sequence
atggtgctgcagacccaggtgttcatcagcctgctgctgtggatcagcggcgcctacggcgacatcgtgatgacccagagccccgacagcctggccgtgagcctgggcgagagagccaccatcaactgcaagagcagccagagcgtgctgtacagcagcaacaacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagtactacagcaccccctag

SEQ ID NO: 4299 - DNA, 984 bp, Artificial Sequence
  Description of Artificial Sequence: Synthetic coding sequence
gccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaagtag

SEQ ID NO: 4300 - DNA, 981 bp, Artificial Sequence
  Description of Artificial Sequence: Synthetic coding sequence
gccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcagcgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaagtag

SEQ ID NO: 4301 - DNA, 993 bp, Artificial Sequence
  Description of Artificial Sequence: Synthetic coding sequence
gccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaagtag

SEQ ID NO: 4302 - DNA, 651 bp, Artificial Sequence; identical to SEQ ID NO: 3817
  Description of Artificial Sequence: Synthetic coding sequence

SEQ ID NO: 4303 - DNA, 762 bp, Artificial Sequence; identical to SEQ ID NO: 3721
  Description of Artificial Sequence: Synthetic coding sequence

SEQ ID NO: 4304 - DNA, 468 bp, Artificial Sequence
  Description of Artificial Sequence: Synthetic coding sequence
atgttccagagactgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggacagcagcagcagcaaggcccccccccccagcctgcccagccccagcagactgcccggcccctag

SEQ ID NO: 4305 - DNA, 1554 bp, Artificial Sequence
  Description of Artificial Sequence: Synthetic coding sequence
atggccgtgagcagaaaggactggagcgccctgagcagcctggccagacagagaaccctggaggacgaggaggagcaggagagagagagaagaagaagacacagaaacctgagcagcaccaccgacgacgaggcccccagactgagccagaacggcgacagacaggccagcgccagcgagagactgcccagcgtggaggaggccgaggtgcccaagcccctgccccccgccagcaaggacgaggacgaggacatccagagcatcctgagaaccagacaggagagaagacagagaagacaggtggtggaggccgcccaggcccccatccaggagagactggaggccgaggagggcagaaacagcctgagccccgtgcaggccacccagaagcccctggtgagcaagaaggagctggagatcccccccagaagaagactgagcagagagcagagaggcccctgggccctggaggaggagagcctggtgggcagagagcccgaggagagaaagaagggcgtgcccgagaagagccccgtgctggagaagagcagcatgcccaagaagaccgcccccgagaagagcctggtgagcgacaagaccagcatcagcgagaaggtgctggccagcgagaagaccagcctgagcgagaagatcgccgtgagcgagaagagaaacagcagcgagaagaagagcgtgctggagaagaccagcgtgagcgagaagagcctggcccccggcatggccctgggcagcggcagaagactggtgagcgagaaggccagcatcttcgagaaggccctggccagcgagaagagccccaccgccgacgccaagcccgcccccaagagagccaccgccagcgagcagcccctggcccaggagccccccgccagcggcggcagccccgccaccaccaaggagcagagaggcagagccctgcccggcaagaacctgcccagcctggccaagcagggcgccagcgacccccccaccgtggccagcagactgccccccgtgaccctgcaggtgaagatccccagcaaggaggaggaggccgacatgagcagccccacccagagaacctacagcagcagcctgaagagaagcagccccagaaccatcagcttcagaatgaagcccaagaaggagaacagcgagaccaccctgaccagaagcgccagcatgaagctgcccgacaacaccgtgaagctgggcgagaagctggagagataccacaccgccatcagaagaagcgagagcgtgaagagcagaggcctgccctgcaccgagctgttcgtggcccccgtgggcgtggccagcaagagacacctgttcgagaaggagctggccggccagagcagagccgagcccgccagcagcagaaaggagaacctgagactgagcggcgtggtgaccagcagactgaacctgtggatcagcagaacccaggagagcggcgaccaggacccccaggaggcccagaaggccagcagcgccaccgagagaacccagtggggccagaagagcgacagcagcctggacgccgaggtgtag

SEQ ID NO: 4306 - DNA, 270 bp, Artificial Sequence; identical to SEQ ID NO: 3781
  Description of Artificial Sequence: Synthetic coding sequence

SEQ ID NO: 4307 - DNA, 1302 bp, Artificial Sequence
  Description of Artificial Sequence: Synthetic coding sequence
atgggcaacgcctgctgggagctgtactgcctggagcacggcatccagcccgacggccagatgcccagcgacaagaccatcggcggcggcgacgacagcttcaccaccttcttctgcgagaccggcgccggcaagcacgtgcccagagccgtgttcgtggacctggagcccaccgtgatcgacgagatcagaaacggcccctacagacagctgttccaccccgagcagctgatcaccggcaaggaggacgccgccaacaactacgccagaggccactacaccatcggcaaggagatcatcgaccccgtgctggacagaatcagaaagctgagcgaccagtgcaccggcctgcagggcttcctggtgttccacagcttcggcggcggcaccggcagcggcttcaccagcctgctgatggagagactgagcgtggactacggcaagaagagcaagctggagttcagcatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcagccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgagcgtggccgagatcaccaacgcctgcttcgagcccgccaaccagatggtgaagtgcgaccccagacacggcaagtacatggcctgctgcctgctgtacagaggcgacgtggtgcccaaggacgtgaacgccgccatcgccgccatcaagaccaagagaagcatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacatggccgccctggagaaggactacgaggaggtgggcatcgacagctacgaggacgaggacgagggcgaggagtag

SEQ ID NO: 4308 - DNA, 1965 bp, Artificial Sequence; identical to SEQ ID NO: 3680
  Description of Artificial Sequence: Synthetic coding sequence

SEQ ID NO: 4309 - DNA, 1173 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcggcagcggcagccagagcggcagcagcggcagcggcagcaacggcgacaacaacaacggcagcagcagcggcggcagcagcagcggcagcagcagcggcggcagcagcggcggcagcagcggcggcagcagcggcaacagcggcggcagcagaggcgacagcggcagcgagagcagctggggcagcagcaccggcagcagcagcggcaaccacggcggcagcggcggcggcaacggccacaagcccggctgcgagaagcccggcaacgaggccagaggcagcggcgagagcggcatccagggcttcagaggccagggcgtgagcagcaacatgagaaacagcgagaccagccccggcatgttcaacttcgacaccttctggaagaacttcaagagcaagctgggcttcatcaactgggacgccatcaacaagtag

SEQ ID NO: 4310 - DNA, 846 bp, Artificial Sequence; identical to SEQ ID NO: 3888
  Description of Artificial Sequence: Synthetic coding sequence

SEQ ID NO: 4311 - DNA, 876 bp, Artificial Sequence
  Description of Artificial Sequence: Synthetic coding sequence
gtgctgagcgccagcggccccggcagaaagatgggcagcagaggccagggcctgctgctggcctactgcctgctgctggccttcgccagcggcctggtgctgagcagagtgccccacgtgcagggcgagcagcaggagtgggagggcaccgaggagctgcccagcccccccgaccacgccgagagagccgaggagcagcacgagaagtacagacccagccaggaccagggcctgcccgccagcagatgcctgagatgctgcgaccccggcaccagcatgtaccccgccaccgccgtgccccagatcaacatcaccatcctgaagggcgagaagggcgacagaggcgacagaggcctgcagggcaagtacggcaagaccggcagcgccggcgccagaggccacaccggccccaagggccagaagggcagcatgggcgcccccggcgagagatgcaagagccactacgccgccttcagcgtgggcagaaagaagcccatgcacagcaaccactactaccagaccgtgatcttcgacaccgagttcgtgaacctgtacgaccacttcaacatgttcaccggcaagttctactgctacgtgcccggcctgtacttcttcagcctgaacgtgcacacctggaaccagaaggagacctacctgcacatcatgaagaacgaggaggaggtggtgatcctgttcgcccaggtgggcgacagaagcatcatgcagagccagagcctgatgctggagctgagagagcaggaccaggtgtgggtgagactgtacaagggcgagagagagaacgccatcttcagcgaggagctggacacctacatcaccttcagcggctacctggtgaagcacgccaccgagccctag

SEQ ID NO: 4312 - DNA, 1002 bp, Artificial Sequence
  Description of Artificial Sequence: Synthetic coding sequence
atggtgagcaagagcagatggaagctgctggccatgctggccctggtgctggtggtgatggtgtggtacagcatcagcagagaggacagatacatcgagctgttctacttccccatccccgagaagaaggagccctgcctgcagggcgaggccgagagcaaggccagcaagctgttcggcaactacagcagagaccagcccatcttcctgagactggaggactacttctgggtgaagacccccagcgcctacgagctgccctacggcaccaagggcagcgaggacctgctgctgagagtgctggccatcaccagcagcagcatccccaagaacatccagagcctgagatgcagaagatgcgtggtggtgggcaacggccacagactgagaaacagcagcctgggcgacgccatcaacaagtacgacgtggtgatcagactgaacaacgcccccgtggccggctacgagggcgacgtgggcagcaagaccaccatgagactgttctaccccgagagcgcccacttcgaccccaaggtggagaacaaccccgacaccctgctggtgctggtggccttcaaggccatggacttccactggatcgagaccatcctgagcgacaagaagagagtgagaaagggcttctggaagcagccccccctgatctgggacgtgaaccccaagcagatcagaatcctgaaccccttcttcatggagatcgccgccgacaagctgctgagcctgcccatgcagcagcccagaaagatcaagcagaagcccaccaccggcctgctggccatcaccctggccctgcacctgtgcgacctggtgcacatcgccggcttcggctaccccgacgcctacaacaagaagcagaccatccactactacgagcagatcaccctgaagagcatggccggcagcggccacaacgtgagccaggaggccctggccatcaagagaatgctggagatgggcgccatcaagaacctgaccagcttctag

SEQ ID NO: 4313 - DNA, 312 bp, Artificial Sequence; identical to SEQ ID NO: 3978
  Description of Artificial Sequence: Synthetic coding sequence

SEQ ID NO: 4314 - DNA, 312 bp, Artificial Sequence; identical to SEQ ID NO: 3978
  Description of Artificial Sequence: Synthetic coding sequence

SEQ ID NO: 4315 - DNA, 312 bp, Artificial Sequence; identical to SEQ ID NO: 3978
  Description of Artificial Sequence: Synthetic coding sequence

SEQ ID NO: 4316 - DNA, 312 bp, Artificial Sequence; identical to SEQ ID NO: 3978
  Description of Artificial Sequence: Synthetic coding sequence

SEQ ID NO: 4317 - DNA, 2268 bp, Artificial Sequence
  Description of Artificial Sequence: Synthetic coding sequence
atgccccccttcctgctgctggaggccgtgtgcgtgttcctgttcagcagagtgccccccagcctgcccctgcaggaggtgcacgtgagcaaggagaccatcggcaagatcagcgccgccagcaagatgatgtggtgcagcgccgccgtggacatcatgttcctgctggacggcagcaacagcgtgggcaagggcagcttcgagagaagcaagcacttcgccatcaccgtgtgcgacggcctggacatcagccccgagagagtgagagtgggcgccttccagttcagcagcaccccccacctggagttccccctggacagcttcagcacccagcaggaggtgaaggccagaatcaagagaatggtgttcaagggcggcagaaccgagaccgagctggccctgaagtacctgctgcacagaggcctgcccggcggcagaaacgccagcgtgccccagatcctgatcatcgtgaccgacggcaagagccagggcgacgtggccctgcccagcaagcagctgaaggagagaggcgtgaccgtgttcgccgtgggcgtgagattccccagatgggaggagctgcacgccctggccagcgagcccagaggccagcacgtgctgctggccgagcaggtggaggacgccaccaacggcctgttcagcaccctgagcagcagcgccatctgcagcagcgccacccccgactgcagagtggaggcccacccctgcgagcacagaaccctggagatggtgagagagttcgccggcaacgccccctgctggagaggcagcagaagaaccctggccgtgctggccgcccactgccccttctacagctggaagagagtgttcctgacccaccccgccacctgctacagaaccacctgccccggcccctgcgacagccagccctgccagaacggcggcacctgcgtgcccgagggcctggacggctaccagtgcctgtgccccctggccttcggcggcgaggccaactgcgccctgaagctgagcctggagtgcagagtggacctgctgttcctgctggacagcagcgccggcaccaccctggacggcttcctgagagccaaggtgttcgtgaagagattcgtgagagccgtgctgagcgaggacagcagagccagagtgggcgtggccacctacagcagagagctgctggtggccgtgcccgtgggcgagtaccaggacgtgcccgacctggtgtggagcctggacggcatccccttcagaggcggccccaccctgaccggcagcgccctgagacaggccgccgagagaggcttcggcagcgccaccagaaccggccaggacagacccagaagagtggtggtgctgctgaccgagagccacagcgaggacgaggtggccggccccgccagacacgccagagccagagagctgctgctgctgggcgtgggcagcgaggccgtgagagccgagctggaggagatcaccggcagccccaagcacgtgatggtgtacagcgacccccaggacctgttcaaccagatccccgagctgcagggcaagctgtgcagcagacagagacccggctgcagaacccaggccctggacctggtgttcatgctggacaccagcgccagcgtgggccccgagaacttcgcccagatgcagagcttcgtgagaagctgcgccctgcagttcgaggtgaaccccgacgtgacccaggtgggcctggtggtgtacggcagccaggtgcagaccgccttcggcctggacaccaagcccaccagagccgccatgctgagagccatcagccaggccccctacctgggcggcgtgggcagcgccggcaccgccctgctgcacatctacgacaaggtgatgaccgtgcagagaggcgccagacccggcgtgcccaaggccgtggtggtgctgaccggcggcagaggcgccgaggacgccgccgtgcccgcccagaagctgagaaacaacggcatcagcgtgctggtggtgggcgtgggccccgtgctgagcgagggcctgagaagactggccggccccagagacagcctgatccacgtggccgcctacgccgacctgagataccaccaggacgtgctgatcgagtggctgtgcggcgaggccaagcagcccgtgaacctgtgcaagcccagcccctgcatgaacgagggcagctgcgtgctgcagaacggcagctacagatgcaagtgcagagacggctgggagggcccccactgcgagaacagattcctgagaagaccctag

SEQ ID NO: 4318 - DNA, 816 bp, Artificial Sequence
  Description of Artificial Sequence: Synthetic coding sequence
atgatcaccggcgtgttcagcatgagactgtggacccccgtgggcgtgctgaccagcctggcctactgcctgcaccagagaagagtggccctggccgagctgcaggaggccgacggccagtgccccgtggacagaagcctgctgaagctgaagatggtgcaggtggtgttcagacacggcgccagaagccccctgaagcccctgcccctggaggagcaggtggagtggaacccccagctgctggaggtgcccccccagacccagttcgactacaccgtgaccaacctggccggcggccccaagccctacagcccctacgacagccagtaccacgagaccaccctgaagggcggcatgttcgccggccagctgaccaaggtgggcatgcagcagatgttcgccctgggcgagagactgagaaagaactacgtggaggacatccccttcctgagccccaccttcaacccccaggaggtgttcatcagaagcaccaacatcttcagaaacctggagagcaccagatgcctgctggccggcctgttccagtgccagaaggagggccccatcatcatccacaccgacgaggccgacagcgaggtgctgtaccccaactaccagagctgctggagcctgagacagagaaccagaggcagaagacagaccgccagcctgcagcccggcatcagcgaggacctgaagaaggtgaaggacagaatgggcatcgacagcagcgacaaggtggacttcttcatcctgctggacaacgtggccgccgagcaggagaagatgggcagctgcagattccacggcagctag

SEQ ID NO: 4319 - DNA, 1395 bp, Artificial Sequence
  Description of Artificial Sequence: Synthetic coding sequence
atggagcacagcgtgtgccccagcagcgccgtgcacctgatccccgtgagcacccccaagaacggcatgagcagcaagagcagaaagagaatcatgcccgaccccgtgaccgagccccccgtgaccgaccccgtgtacgaggccctgctgtactgcaacatccccagcgtggccgagagaagcatggagggccacgccccccaccacttcaagctggtgagcgtgcacgtgttcatcagacacggcgacagataccccctgtacgtgatccccaagaccaagagacccgagatcgactgcaccctggtggccaacagaaagccctaccaccccaagctggaggccttcatcagccacatgagcaagggcagcggcgccagcttcgagagccccctgaacagcctgcccctgtaccccaaccaccccctgtgcgagatgggcgagctgacccagaccggcgtggtgcagcacctgcagaacggccagctgctgagagacatctacctgaagaagcacaagctgctgcccaacgactggagcgccgaccagctgtacctggagaccaccggcaagagcagaaccctgcagagcggcctggccctgctgtacggcttcctgcccgacttcgactggaagaagatctacttcagacaccagcccagcgccctgttctgcagcggcagctgctactgccccgtgagaaaccagtacctggagaaggagcagagaagacagtacctgctgagactgaagaacagccagctggagaagacctacggcgagatggccaagatcgtggacgtgcccaccaagcagctgagagccgccaaccccatcgacagcatgctgtgccacttctgccacaacgtgagcttcccctgcaccagaaacggctgcgtggacatggagcacttcaaggtgatcaagacccaccagatcgaggacgagagagagagaagagagaagaagctgtacttcggctacagcctgctgggcgcccaccccatcctgaaccagaccatcggcagaatgcagagagccaccgagggcagaaaggaggagctgttcgccctgtacagcgcccacgacgtgaccctgagccccgtgctgagcgccctgggcctgagcgaggccagattccccagattcgccgccagactgatcttcgagctgtggcaggacagagagaagcccagcgagcacagcgtgagaatcctgtacaacggcgtggacgtgaccttccacaccagcttctgccaggaccaccacaagagaagccccaagcccatgtgccccctggagaacctggtgagattcgtgaagagagacatgttcgtggccctgggcggcagcggcaccaactactacgacgcctgccacagagagggcttctag

SEQ ID NO: 4320 - DNA, 1443 bp, Artificial Sequence; identical to SEQ ID NO: 3652
  Description of Artificial Sequence: Synthetic coding sequence

SEQ ID NO: 4321 - DNA, 1311 bp, Artificial Sequence; identical to SEQ ID NO: 3956
  Description of Artificial Sequence: Synthetic coding sequence

SEQ ID NO: 4322 - DNA, 1161 bp, Artificial Sequence; identical to SEQ ID NO: 4065
  Description of Artificial Sequence: Synthetic coding sequence

SEQ ID NO: 4323 - DNA, 990 bp, Artificial Sequence
  Description of Artificial Sequence: Synthetic coding sequence
atgagacccccccccgccctggccctggccggcctgtgcctgctggccctgcccgccgccgccgccagctacttcggcctgaccggcagagaggtgctgacccccttccccggcctgggcaccgccgccgcccccgcccagggcggcgcccacctgaagcagtgcgacctgctgaagctgagcagaagacagaagcagctgtgcagaagagagcccggcctggccgagaccctgagagacgccgcccacctgggcctgctggagtgccagttccagttcagacacgagagatggaactgcagcctggagggcagaatgggcctgctgaagagaggcttcaaggagaccgccttcctgtacgccgtgagcagcgccgccctgacccacaccctggccagagcctgcagcgccggcagaatggagagatgcacctgcgacgacagccccggcctggagagcagacaggcctggcagtggggcgtgtgcggcgacaacctgaagtacagcaccaagttcctgagcaacttcctgggcagcaagagaggcaacaaggacctgagagccagagccgacgcccacaacacccacgtgggcatcaaggccgtgaagagcggcctgagaaccacctgcaagtgccacggcgtgagcggcagctgcgccgtgagaacctgctggaagcagctgagccccttcagagagaccggccaggtgctgaagctgagatacgacagcgccgtgaaggtgagcagcgccaccaacgaggccctgggcagactggagctgtgggcccccgccagacagggcagcctgaccaagggcctggcccccagaagcggcgacctggtgtacatggaggacagccccagcttctgcagacccagcaagtacagccccggcaccgccggctggagcgccgtggccagaagccagctgatcaccaccagcaccagcagaatccaggccatcctgcccagccagctgcccgagtag

SEQ ID NO: 4324 - DNA, 579 bp, Artificial Sequence
  Description of Artificial Sequence: Synthetic coding sequence
atgagactggccggccccgagagcagcgtgaccgccgcccccagagccagaaagtacaagtgcggcctgccccagccctgccccgaggagcacctggccttcagagtggtgagcggcgccgccaacgtgatcggccccaagatctgcctggaggacaagatgctgatgagcagcgtgaaggacaacgtgggcagaggcctgaacatcgccctggtgaacggcgtgagcggcgagctgatcgaggccagagccttcgacatgtgggccggcgacgtgaacgacctgctgaagttcatcagacccctgcacgagggcaccctggtgttcgtggccagctacgacgaccccgccaccaagatgaacgaggagaccagaaagctgttcagcgagctgggcagcagaaacgccaaggagctggccttcagagacagctgggtgttcgtgggcgccaagggcgtgcagaacaagagccccttcgagcagcacgtgaagaacagcaagcacagcaacaagtacgagggctggcccgaggccctggagatggagggctgcatccccagaagaagcaccgccagctag

SEQ ID NO: 4325 - DNA, 1053 bp, Artificial Sequence; identical to SEQ ID NO: 3914
  Description of Artificial Sequence: Synthetic coding sequence

SEQ ID NO: 4326 - DNA, 189 bp, Artificial Sequence
  Description of Artificial Sequence: Synthetic coding sequence
atgaagatccagctgttcttcttcatcctgcacttctgggtgaccatcctgcccgccagaagcaacttcgagcccaagtacagattcgagagatgcgagaaggtgagaggcatctgcaagaccttctgcgacgacgtggagtacgactacggctactgcatcaagtggagaagccagtgctgcgtgtag

SEQ ID NO: 4327 - DNA, 738 bp, Artificial Sequence
  Description of Artificial Sequence: Synthetic coding sequence
atgaccctgttccccgtgctgctgttcctggtggccggcctgctgcccagcttccccgccaacgaggacaaggaccccgccttcaccgccctgctgaccacccagacccaggtgcagagagagatcgtgaacaagcacaacgagctgagaagagccgtgagcccccccgccagaaacatgctgaagatggagtggaacaaggaggccgccgccaacgcccagaagtgggccaaccagtgcaactacagacacagcaaccccaaggacagaatgaccagcctgaagtgcggcgagaacctgtacatgagcagcgccagcagcagctggagccaggccatccagagctggttcgacgagtacaacgacttcgacttcggcgtgggccccaagacccccaacgccgtggtgggccactacacccaggtggtgtggtacagcagctacctggtgggctgcggcaacgcctactgccccaaccagaaggtgctgaagtactactacgtgtgccagtactgccccgccggcaactgggccaacagactgtacgtgccctacgagcagggcgccccctgcgccagctgccccgacaactgcgacgacggcctgtgcaccaacggctgcaagtacgaggacctgtacagcaactgcaagagcctgaagctgaccctgacctgcaagcaccagctggtgagagacagctgcaaggccagctgcaactgcagcaacagcatctactag

SEQ ID NO: 4328 - DNA, 1341 bp, Artificial Sequence; identical to SEQ ID NO: 3653
  Description of Artificial Sequence: Synthetic coding sequence

SEQ ID NO: 4329 - DNA, 585 bp, Artificial Sequence; identical to SEQ ID NO: 3585
  Description of Artificial Sequence: Synthetic coding sequence

SEQ ID NO: 4330 - DNA, 585 bp, Artificial Sequence; identical to SEQ ID NO: 3585
  Description of Artificial Sequence: Synthetic coding sequence

SEQ ID NO: 4331 - DNA, 348 bp, Artificial Sequence
  Description of Artificial Sequence: Synthetic coding sequence
atgaccatgagacacaactggacccccgacctgagccccctgtgggtgctgctgctgtgcgcccacgtggtgaccctgctggtgagagccacccccgtgagccagaccaccaccgccgccaccgccagcgtgagaagcaccaaggacccctgccccagccagccccccgtgttccccgccgccaagcagtgccccgccctggaggtgacctggcccgaggtggaggtgcccctgagctgggccgagggcaacctggccccccaccccagaagccccgccctgcagccccagcagagcaccgccgccggcctgagactgagcaccggccccgccgccgcccagccctag

SEQ ID NO: 4332 - DNA, 528 bp, Artificial Sequence; identical to SEQ ID NO: 3724
  Description of Artificial Sequence: Synthetic coding sequence

SEQ ID NO: 4333 - DNA, 993 bp, Artificial Sequence
  Description of Artificial Sequence: Synthetic coding sequence
atgggcaagctgtgcctgggccccaccctgtgccccgccgccgccgccgaggagagcagagacgccgagcccagaagagagctgctgtgcagcggcagaccctggacctggagagccgccgccagagtgaccaccatgatcccctgggtgctgctggcctgcgccctgccctgcgccgccgaccccctgctgggcgccttcgccagaagagacttcagaaagggcagcccccagctggtgtgcagcctgcccggcccccagggcccccccggcccccccggcgcccccggccccagcggcatgatgggcagaatgggcttccccggcaaggacggccaggacggccacgacggcgacagaggcgacagcggcgaggagggcccccccggcagaaccggcaacagaggcaagcccggccccaagggcaaggccggcgccatcggcagagccggccccagaggccccaagggcgtgaacggcacccccggcaagcacggcacccccggcaagaagggccccaagggcaagaagggcgagcccggcctgcccggcccctgcagctgcggcagcggccacaccaagagcgccttcagcgtggccgtgaccaagagctaccccagagagagactgcccatcaagttcgacaagatcctgatgaacgagggcggccactacaacgccagcagcggcaagttcgtgtgcggcgtgcccggcatctactacttcacctacgacatcaccctggccaacaagcacctggccatcggcctggtgcacaacggccagtacagaatcagaaccttcgacgccaacaccggcaaccacgacgtggccagcggcagcaccatcctggccctgaagcagggcgacgaggtgtggctgcagatcttctacagcgagcagaacggcctgttctacgacccctactggaccgacagcctgttcaccggcttcctgatctacgccgaccaggacgaccccaacgaggtgtag

SEQ ID NO: 4334 - DNA, 390 bp, Artificial Sequence
  Description of Artificial Sequence: Synthetic coding sequence
atgagactgctgctgctggtgcccctgctgctggcccccgcccccggcagcagcgcccccaaggtgagaagacagagcgacacctggggcccctggagccagtggagcccctgcagcagaacctgcggcggcggcgtgagcttcagagagagaccctgctacagccagagaagagacggcggcagcagctgcgtgggccccgccagaagccacagaagctgcagaaccgagagctgccccgacggcgccagagacttcagagccgagcagtgcgccgagttcgacggcgccgagttccagggcagaagatacagatggctgccctactacagcgcccccaacaagtgcgagctgaactgcatccccaagggcctgggcctgcagggctag

SEQ ID NO: 4335 - DNA, 1227 bp, Artificial Sequence
  Description of Artificial Sequence: Synthetic coding sequence
atgttcagcaacgccaacagcagaagcaagatgtggctgctgctgaccatggccagcctgatcagcgtgctgggcaccacccacggcctgttcggcaagctgcaccccggcagccccgaggtgaccatgaacatcagccagatgatcacctactggggctaccccaacgaggagtacgaggtggtgaccgaggacggctacatcctggaggtgaacagaatcccctacggcaagaagaacagcggcaacaccggccagagacccgtggtgttcctgcagcacggcctgctggccagcgccaccaactggatcagcaacctgcccaacaacagcctggccttcatcctggccgacgccggctacgacgtgtggctgggcaacagcagaggcaacacctgggccagaagaaacctgtactacagccccgacagcgtggagttctgggccttcagcttcgacgagatggccaagtacgacctgcccgccaccatcgacttcatcgtgaagaagaccggccagaagcagctgcactacgtgggccacagccagggcaccaccatcggcttcatcgccttcagcaccaaccccagcctggccaagagaatcaagaccttctacgccctggcccccgtggccaccgtgaagtacaccaagagcctgatcaacaagctgagattcgtgccccagagcctgttcaagttcatcttcggcgacaagatcttctacccccacaacttcttcgaccagttcctggccaccgaggtgtgcagcagagagatgctgaacctgctgtgcagcaacgccctgttcatcatctgcggcttcgacagcaagaacttcaacaccagcagactggacgtgtacctgagccacaaccccgccggcaccagcgtgcagaacatgttccactggacccaggccgtgaagagcggcaagttccaggcctacgactggggcagccccgtgcagaacagaatgcactacgaccagagccagcccccctactacaacgtgaccgccatgaacgtgcccatcgccgtgtggaacggcggcaaggacctgctggccgacccccaggacgtgggcctgctgctgcccaagctgcccaacctgatctaccacaaggagatccccttctacaaccacctggacttcatctgggccatggacgccccccaggaggtgtacaacgacatcgtgagcatgatcagcgaggacaagaagtag

SEQ ID NO: 4336 - DNA, 393 bp, Artificial Sequence; identical to SEQ ID NO: 3874
  Description of Artificial Sequence: Synthetic coding sequence

SEQ ID NO: 4337 - DNA, 393 bp, Artificial Sequence; identical to SEQ ID NO: 3874
  Description of Artificial Sequence: Synthetic coding sequence

SEQ ID NO: 4338 - DNA, 1731 bp, Artificial Sequence
  Description of Artificial Sequence: Synthetic coding sequence
atgatcgtgttcggctgggccgtgttcctggccagcagaagcctgggccagggcctgctgctgaccctggaggagcacatcgcccacttcctgggcaccggcggcgccgccaccaccatgggcaacagctgcatctgcagagacgacagcggcaccgacgacagcgtggacacccagcagcagcaggccgagaacagcgccgtgcccaccgccgacaccagaagccagcccagagaccccgtgagaccccccagaagaggcagaggcccccacgagcccagaagaaagaagcagaacgtggacggcctggtgctggacaccctggccgtgatcagaaccctggtggacaacgaccaggagcccccctacagcatgatcaccctgcacgagatggccgagaccgacgagggctggctggacgtggtgcagagcctgatcagagtgatccccctggaggaccccctgggccccgccgtgatcaccctgctgctggacgagtgccccctgcccaccaaggacgccctgcagaagctgaccgagatcctgaacctgaacggcgaggtggcctgccaggacagcagccaccccgccaagcacagaaacaccagcgccgtgctgggctgcctggccgagaagctggccggccccgccagcatcggcctgctgagccccggcatcctggagtacctgctgcagtgcctgaagctgcagagccaccccaccgtgatgctgttcgccctgatcgccctggagaagttcgcccagaccagcgagaacaagctgaccatcagcgagagcagcatcagcgacagactggtgaccctggagagctgggccaacgaccccgactacctgaagagacaggtgggcttctgcgcccagtggagcctggacaacctgttcctgaaggagggcagacagctgacctacgagaaggtgaacctgagcagcatcagagccatgctgaacagcaacgacgtgagcgagtacctgaagatcagcccccacggcctggaggccagatgcgacgccagcagcttcgagagcgtgagatgcaccttctgcgtggacgccggcgtgtggtactacgaggtgaccgtggtgaccagcggcgtgatgcagatcggctgggccaccagagacagcaagttcctgaaccacgagggctacggcatcggcgacgacgagtacagctgcgcctacgacggctgcagacagctgatctggtacaacgccagaagcaagccccacatccacccctgctggaaggagggcgacaccgtgggcttcctgctggacctgaacgagaagcagatgatcttcttcctgaacggcaaccagctgccccccgagaagcaggtgttcagcagcaccgtgagcggcttcttcgccgccgccagcttcatgagctaccagcagtgcgagttcaacttcggcgccaagcccttcaagtacccccccagcatgaagttcagcaccttcaacgactacgccttcctgaccgccgaggagaagatcatcctgcccagacacagaagactggccctgctgaagcaggtgagcatcagagagaactgctgcagcctgtgctgcgacgaggtggccgacacccagctgaagccctgcggccacagcgacctgtgcatggactgcgccctgcagctggagacctgccccctgtgcagaaaggagatcgtgagcagaatcagacagatcagccacatcagctag

SEQ ID NO: 4339 - DNA, 360 bp, Artificial Sequence
  Description of Artificial Sequence: Synthetic coding sequence
atggccagacccggcatggagagatggagagacagactggccctggtgaccggcgccagcggcggcatcggcgccgccgtggccagagccctggtgcagcagggcctgaaggtggtgggctgcgccagaaccgtgggcaacatcgaggagctggccgccgagtgcaagagcgccggctaccccggcaccctgatcccctacagatgcgacctgagcaacgaggaggacatcctgagcatgttcagcgccatcagaagccagcacagcggcgtggacatctgcatcaacaacgccggcctggccagacccgacaccctgctgagcggcagcaccagcggctggaaggacatgttcaactag

SEQ ID NO: 4340 - DNA, 144 bp, Artificial Sequence
  Description of Artificial Sequence: Synthetic coding sequence
atgcaggtgagcaccgccgccctggccgtgctgctgtgcaccatggccctgtgcaaccaggtgctgagcgccccccaggccggcagaagcgtgctgacccccgtgagaagcggcagcagaaacaccagcgtgacctggagctag

SEQ ID NO: 4341 - DNA, 159 bp, Artificial Sequence
  Description of Artificial Sequence: Synthetic coding sequence
atgcaggtgagcaccgccgccctggccgtgctgctgtgcaccatggccctgtgcaaccaggtgctgagcgcccccctgagcagacccagagaggccggcagaagcgtgctgacccccgtgagaagcggcagcagaaacaccagcgtgacctggagctag

SEQ ID NO: 4342 - DNA, 1272 bp, Artificial Sequence
  Description of Artificial Sequence: Synthetic coding sequence
atggagctggagctgatgcccttcaacgtgctgctgagaaccaccctggacctgctgcaggagaaggaccccgcccacatcttcgccgagcccgtgaacctgagcgaggtgcccgactacctggagttcatcagcaagcccatggacttcagcaccatgagaagaaagctggagagccacctgtacagaaccctggaggagttcgaggaggacttcaacctgatcgtgaccaactgcatgaagtacaacgccaaggacaccatcttccacagagccgccgtgagactgagagacctgggcggcgccatcctgagacacgccagaagacaggccgagaacatcggctacgaccccgagagaggcacccacctgcccgagagccccaagctggaggacttctacagattcagctgggaggacgtggacaacatcctgatccccgagaacagagcccacctgagccccgaggtgcagctgaaggagctgctggagaagctggacctggtgagcgccatgagaagcagcggcgccagaaccagaagagtgagactgctgagaagagagatcaacgccctgagacagaagctggcccagcccccccccccccagccccccagcctgaacaagaccgtgagcaacggcgagctgcccgccggcccccagggcgacgccgccgtgctggagcaggccctgcaggaggagcccgaggacgacggcgacagagacgacagcaagctgccccccccccccaccctggagcccaccggccccgcccccagcctgagcgagcaggagagcccccccgagccccccaccctgaagcccatcaacgacagcaagccccccagcagattcctgaagcccagaaaggtggaggaggacgagctgctggagaagagccccctgcagctgggcaacgagcccctgcagagactgctgagcgacaacggcatcaacagactgagcctgatggcccccgacacccccgccggcacccccctgagcggcgtgggcagaagaaccagcgtgctgttcaagaaggccaagaacggcgtgaagctgcagagaagccccgacagagtgctggagaacggcgaggaccacggcgtggccggcagccccgccagccccgccagcatcgaggaggagagacacagcagaaagagacccagaagcagaagctgcagcgagagcgagggcgagagaagcccccagcaggaggaggagaccggcatgaccaacggcttcggcaagcacagaaagagagtgtag

SEQ ID NO: 4343 - DNA, 3030 bp, Artificial Sequence
  Description of Artificial Sequence: Synthetic coding sequence
atgggcagcggcagagtgcccggcctgtgcctgctggtgctgctggtgcacgccagagccgcccagtacagcaaggccgcccaggacgtggacgagtgcgtggagggcaccgacaactgccacatcgacgccatctgccagaacacccccagaagctacaagtgcatctgcaagagcggctacaccggcgacggcaagcactgcaaggacgtggacgagtgcgagagagaggacaacgccggctgcgtgcacgactgcgtgaacatccccggcaactacagatgcacctgctacgacggcttccacctggcccacgacggccacaactgcctggacgtggacgagtgcgccgagggcaacggcggctgccagcagagctgcgtgaacatgatgggcagctacgagtgccactgcagagagggcttcttcctgagcgacaaccagcacacctgcatccagagacccgaggagggcatgaactgcatgaacaagaaccacggctgcgcccacatctgcagagagacccccaagggcggcatcgcctgcgagtgcagacccggcttcgagctgaccaagaaccagagagactgcaagctgacctgcaactacggcaacggcggctgccagcacacctgcgacgacaccgagcagggccccagatgcggctgccacatcaagttcgtgctgcacaccgacggcaagacctgcatcggcgagagaagactggagcagcacatccccacccaggccgtgagcaacgagacctgcgccgtgaacaacggcggctgcgacagcaagtgccacgacgccgccaccggcgtgcactgcacctgccccgtgggcttcatgctgcagcccgacagaaagacctgcaaggacatcgacgagtgcagactgaacaacggcggctgcgaccacatctgcagaaacaccgtgggcagcttcgagtgcagctgcaagaagggctacaagctgctgatcaacgagagaaactgccaggacatcgacgagtgcagcttcgacagaacctgcgaccacatctgcgtgaacacccccggcagcttccagtgcctgtgccacagaggctacctgctgtacggcatcacccactgcggcgacgtggacgagtgcagcatcaacagaggcggctgcagattcggctgcatcaacacccccggcagctaccagtgcacctgccccgccggccagggcagactgcactggaacggcaaggactgcaccgagcccctgaagtgccagggcagccccggcgccagcaaggccatgctgagctgcaacagaagcggcaagaaggacacctgcgccctgacctgccccagcagagccagattcctgcccgagagcgagaacggcttcaccgtgagctgcggcacccccagccccagagccgcccccgccagagccggccacaacggcaacagcaccaacagcaaccactgccacgaggccgccgtgctgagcatcaagcagagagccagcttcaagatcaaggacgccaagtgcagactgcacctgagaaacaagggcaagaccgaggaggccggcagaatcaccggccccggcggcgccccctgcagcgagtgccaggtgaccttcatccacctgaagtgcgacagcagcagaaagggcaagggcagaagagccagaaccccccccggcaaggaggtgaccagactgaccctggagctggaggccgaggtgagagccgaggagaccaccgccagctgcggcctgccctgcctgagacagagaatggagagaagactgaagggcagcctgaagatgctgagaaagagcatcaaccaggacagattcctgctgagactggccggcctggactacgagctggcccacaagcccggcctggtggccggcgagagagccgagcccatggagagctgcagacccggccagcacagagccggcaccaagtgcgtgagctgcccccagggcacctactaccacggccagaccgagcagtgcgtgccctgccccgccggcaccttccaggagagagagggccagctgagctgcgacctgtgccccggcagcgacgcccacggccccctgggcgccaccaacgtgaccacctgcgccggccagtgcccccccggccagcacagcgtggacggcttcaagccctgccagccctgccccagaggcacctaccagcccgaggccggcagaaccctgtgcttcccctgcggcggcggcctgaccaccaagcacgagggcgccatcagcttccaggactgcgacaccaaggtgcagtgcagccccggccactactacaacaccagcatccacagatgcatcagatgcgccatgggcagctaccagcccgacttcagacagaacttctgcagcagatgccccggcaacaccagcaccgacttcgacggcagcaccagcgtggcccagtgcaagaacagacagtgcggcggcgagctgggcgagttcaccggctacatcgagagccccaactaccccggcaactaccccgccggcgtggagtgcatctggaacatcaaccccccccccaagagaaagatcctgatcgtggtgcccgagatcttcctgcccagcgaggacgagtgcggcgacgtgctggtgatgagaaagaacagcagccccagcagcatcaccacctacgagacctgccagacctacgagagacccatcgccttcaccgccagaagcagaaagctgtggatcaacttcaagaccagcgaggccaacagcgccagaggcttccagatcccctacgtgacctacgacgaggactacgagcagctggtggaggacatcgtgagagacggcagactgtacgccagcgagaaccaccaggagatcctgaaggacaagaagctgatcaaggccttcttcgaggtgctggcccacccccagaactacttcaagtacaccgagaagcacaaggagatgctgcccaagagcttcatcaagctgctgagaagcaaggtgagcagcttcctgagaccctacaagtag

SEQ ID NO: 4344 - DNA, 984 bp, Artificial Sequence
  Description of Artificial Sequence: Synthetic coding sequence
atgaccgccctggagctggccagaagaggcgccagagtggtgctggcctgcagaagccaggagagaggcgaggccgccgccttcgacctgagacaggagagcggcaacaacgaggtgatcttcatggccctggacctggccagcctggccagcgtgagagccttcgccaccgccttcctgagcagcgagcccagactggacatcctgatccacaacgccggcatcagcagctgcggcagaaccagagaggccttcaacctgctgctgagagtgaaccacatcggccccttcctgctgacccacctgctgctgccctgcctgaaggcctgcgcccccagcagagtggtggtggtggccagcgccgcccactgcagaggcagactggacttcaagagactggacagacccgtggtgggctggagacaggagctgagagcctacgccgacaccaagctggccaacgtgctgttcgccagagagctggccaaccagctggaggccaccggcgtgacctgctacgccgcccaccccggccccgtgaacagcgagctgttcctgagacacgtgcccggctggctgagacccctgctgagacccctggcctggctggtgctgagagcccccagaggcggcgcccagacccccctgtactgcgccctgcaggagggcatcgagcccctgagcggcagatacttcgccaactgccacgtggaggaggtgccccccgccgccagagacgacagagccgcccacagactgtgggaggccagcaagagactggccggcctgggccccggcgaggacgccgagcccgacgaggacccccagagcgaggacagcgaggcccccagcagcctgagcaccccccaccccgaggagcccaccgtgagccagccctaccccagcccccagagcagccccgacctgagcaagatgacccacagaatccaggccaaggtggagcccgagatccagctgagctag

SEQ ID NO: 4345 - DNA, 1320 bp, Artificial Sequence; identical to SEQ ID NO: 3641
  Description of Artificial Sequence: Synthetic coding sequence

SEQ ID NO: 4346 - DNA, 3687 bp, Artificial Sequence; identical to SEQ ID NO: 3602
  Description of Artificial Sequence: Synthetic coding sequence

SEQ ID NO: 4347 - DNA, 1596 bp, Artificial Sequence
  Description of Artificial Sequence: Synthetic coding sequence
atgaagggcgccagactgttcgtgctgctgagcagcctgtggagcggcggcatcggcctgaacaacagcaagcacagctggaccatccccgaggacggcaacagccagaagaccatgcccagcgccagcgtgccccccaacaagatccagagcctgcagatcctgcccaccaccagagtgatgagcgccgagatcgccaccacccccgagaaggccgagggcgtggtgaagctgcagaacctgaccctgcccaccaacgccagcatcaagttcaaccccggcgccgagagcgtggtgctgagcaacagcaccctgaagttcctgcagagcttcgccagaaagagcaacgagcaggccaccagcctgaacaccgtgggcggcaccggcggcatcggcggcgtgggcggcaccggcggcgtgggcaacagagcccccagagagacctacctgagcagaggcgacagcagcagcagccagagaaccgactaccagaagagcaacttcgagaccaccagaggcaagaactggtgcgcctacgtgcacaccagactgagccccaccgtgatcctggacaaccaggtgacctacgtgcccggcggcaagggcccctgcggctggaccggcggcagctgcccccagagaagccagaagatcagcaaccccgtgtacagaatgcagcacaagatcgtgaccagcctggactggagatgctgccccggctacagcggccccaagtgccagctgagagcccaggagcagcagagcctgatccacaccaaccaggccgagagccacaccgccgtgggcagaggcgtggccgagcagcagcagcagcagggctgcggcgaccccgaggtgatgcagaagatgaccgaccaggtgaactaccaggccatgaagctgaccctgctgcagaagaagatcgacaacatcagcctgaccgtgaacgacgtgagaaacacctacagcagcctggagggcaaggtgagcgaggacaagagcagagagttccagagcctgctgaaggaggagtacagcagctgcagcagacacccctgccagaacggcggcacctgcatcaacggcagaaccagcttcacctgcgcctgcagacaccccttcaccggcgacaactgcaccatcaagctggtggaggagaacgccctggcccccgacttcagcaagggcagctacagatacgcccccatggtggccttcttcgccagccacacctacggcatgaccatccccggccccatcctgttcaacaacctggacgtgaactacggcgccagctacacccccagaaccggcaagttcagaatcccctacctgggcgtgtacgtgttcaagtacaccatcgagagcttcagcgcccacatcagcggcttcctggtggtggacggcatcgacaagctggccttcgagagcgagaacatcaacagcgagatccactgcgacagagtgctgaccggcgacgccctgctggagctgaactacggccaggaggtgtggctgagactggccaagggcaccatccccgccaagttcccccccgtgaccaccttcagcggctacctgctgtacagaacctag

SEQ ID NO: 4348 - DNA, 942 bp, Artificial Sequence; identical to SEQ ID NO: 3906
  Description of Artificial Sequence: Synthetic coding sequence

SEQ ID NO: 4349 - DNA, 834 bp, Artificial Sequence
  Description of Artificial Sequence: Synthetic coding sequence
atgtgcaccgtggtggaccccagaatcgtgagaagatacctgctgagaagacagctgggccagggcgcctacggcatcgtgtggaaggccgtggacagaagaaccggcgaggtggtggccatcaagaagatcttcgacgccttcagagacaagaccgacgcccagagaaccttcagagagatcaccctgctgcaggagttcggcgaccaccccaacatcatcagcctgctggacgtgatcagagccgagaacgacagagacatctacctggtgttcgagttcatgggctgcccccccagcccccccccccccaccgccgtgagaaccctgagcgccgacaccgacctgaacgccgtgatcagaaagggcggcctgctgcaggacgtgcacgtgagaagcatcttctaccagctgctgagagccaccagattcctgcacagcggccacgtggtgcacagagaccagaagcccagcaacgtgctgctggacgccaactgcaccgtgaagctgtgcgacttcggcctggccagaagcctgggcgacctgcccgagggccccgaggaccaggccgtgaccgagtacgtggccaccagatggtacagagcccccgaggtgctgctgagcagccacagatacaccctgggcgtggacatgtggagcctgggctgcatcctgggcgagatgctgagaggcagacccctgttccccggcaccagcaccctgcaccagctggagctgatcctggagaccatccccccccccagcgaggaggacctgctggccctgggcagcggctgcagagccagcgtgctgcaccagctgggcagcagatag

SEQ ID NO: 4350 - DNA, 765 bp, Artificial Sequence
  Description of Artificial Sequence: Synthetic coding sequence
atgtgcaccgtggtggaccccagaatcgtgagaagatacctgctgagaagacagctgggccagggcgcctacggcatcgtgtggaaggccgtggacagaagaaccggcgaggtggtggccatcaagaagatcttcgacgccttcagagacaagaccgacgcccagagaaccttcagagagatcaccctgctgcaggagttcggcgaccaccccaacatcatcagcctgctggacgtgatcagagccgagaacgacagagacatctacctggtgttcgagttcatggacaccgacctgaacgccgtgatcagaaagggcggcctgctgcaggacgtgcacgtgagaagcatcttctaccagctgctgagagccaccagattcctgcacagcggccacgtggtgcacagagaccagaagcccagcaacgtgctgctggacgccaactgcaccgtgaagctgtgcgacttcggcctggccagaagcctgggcgacctgcccgagggccccgaggaccaggccgtgaccgagtacgtggccaccagatggtacagagcccccgaggtgctgctgagcagccacagatacaccctgggcgtggacatgtggagcctgggctgcatcctgggcgagatgctgagaggcagacccctgttccccggcaccagcaccctgcaccagctggagctgatcctggagaccatccccccccccagcgaggagggcgcccagaccgcctgcagaagcggcaccggcgccagcacctag

SEQ ID NO: 4351 - DNA, 474 bp, Artificial Sequence
  Description of Artificial Sequence: Synthetic coding sequence
atggccctgctgctgtgcctggtgtgcctgaccgccgccctggcccacggctgcctgcactgccacagcaacttcagcaagaagttcagcttctacagacaccacgtgaacttcaagagctggtgggtgggcgacatccccgtgagcggcgccctgctgaccgactggagcgacgacaccatgaaggagctgcacctggccatccccgccaagatcaccagagagaagctggaccaggtggccaccgccgtgtaccagatgatggaccagctgtaccagggcaagatgtacttccccggctacttccccaacgagctgagaaacatcttcagagagcaggtgcacctgatccagaacgccatcatcgagagacacctggcccccggcagctggggcggcggccagctgagcagagagggccccagcctggcccccgagggcagcatgcccagccccagaggcgacctgccctag

SEQ ID NO: 4352 - DNA, 699 bp, Artificial Sequence
  Description of Artificial Sequence: Synthetic coding sequence
atggccctgctgctgtgcctggtgtgcctgaccgccgccctggcccacggctgcctgcactgccacagcaacttcagcaagaagttcagcttctacagacaccacgtgaacttcaagagctggtgggtgggcgacatccccgtgagcggcgccctgctgaccgactggagcgacgacaccatgaaggagctgcacctggccatccccgccaagatcaccagagagaagctggaccaggtggccaccgccgtgtaccagatgatggaccagctgtaccagggcaagatgtacttccccggctacttccccaacgagctgagaaacatcttcagagagcaggtgcacctgatccagaacgccatcatcgagagcagaatcgactgccagcacagatgcggcatcttccagtacgagaccatcagctgcaacaactgcaccgacagccacgtggcctgcttcggctacaactgcgagagcagcgcccagtggaagagcgccgtgcagggcctgctgaactacatcaacaactggcacaagcaggacaccagcatgagacccagaagcagcgccttcagctggcccggcacccacagagccacccccgccttcctggtgagccccgccctgagatgcctggagcccccccacctggccaacctgaccctggaggacgccgccgagtgcctgaagcagcactag

SEQ ID NO: 4353 - DNA, 396 bp, Artificial Sequence
  Description of Artificial Sequence: Synthetic coding sequence
atgggcggcgacggcagatacgtgctgaacggccactgggtggtgagcccccccggcacctacgaggccgccggcacccacgtggtgtacaccagagacaccggcccccaggagaccctgcaggccgccggccccaccagccacgacctgctgctgcaggtgctgctgcaggagcccaaccccggcatcgagttcgagttctggctgcccagagagagatacagccccttccaggccagagtgcaggccctgggctggcccctgagacagccccagcccagaggcgtggagccccagccccccgccgcccccgccgtgacccccgcccagacccccaccctggcccccggccccagcgccggcccccccccccccggccccggcgaccccctgtag

SEQ ID NO: 4354 - DNA, 447 bp, Artificial Sequence
  Description of Artificial Sequence: Synthetic coding sequence
atggccagaatccccaccgccgccctgggctgcatcagcctgctgtgcctgcagctgcccggcagcctgagcagaagcctgggcggcgaccccagacccgtgaagcccagagagccccccgccagaagccccagcagcagcctgcagcccagacaccccgcccccagacccgtggtgtggaagctgcacagagccctgcaggcccagagaggcgccggcctggcccccgtgatgggccagcccctgagagacggcggcagacagcacagcggccccagaagacacagcggccccagaagaacccaggcccagctgctgagagtgggctgcgtgctgggcacctgccaggtgcagaacctgagccacagactgtggcagctgatgggccccgccggcagacaggacagcgcccccgtggaccccagcagcccccacagctacggctag

SEQ ID NO: 4355 - DNA, 447 bp, Artificial Sequence; identical to SEQ ID NO: 4354
  Description of Artificial Sequence: Synthetic coding sequence

SEQ ID NO: 4356 - DNA, 537 bp, Artificial Sequence
  Description of Artificial Sequence: Synthetic coding sequence
atggacagagccgccagatgcagcggcgccagcagcctgcccctgctgctggccctggccctgggcctggtgatcctgcactgcgtggtggccgacggcaacagcaccagaagccccgagaccaacggcctgctgtgcggcgaccccgaggagaactgcgccgccaccaccacccagagcaagagaaagggccacttcagcagatgccccaagcagtacaagcactactgcatcaagggcagatgcagattcgtggtggccgagcagacccccagctgcgtgtgcgacgagggctacatcggcgccagatgcgagagagtggacctgttctacctgagaggcgacagaggccagatcctggtgatctgcctgatcgccgtgatggtggtgttcatcatcctggtgatcggcgtgtgcacctgctgccaccccctgagaaagagaagaaagagaaagaagaaggaggaggagatggagaccctgggcaaggacatcacccccatcaacgaggacatcgaggagaccaacatcgcctag

SEQ ID NO: 4357 - DNA, 1251 bp, Artificial Sequence
  Description of Artificial Sequence: Synthetic coding sequence
atgagcatcagcctgagcagcctgatcctgctgcccatctggatcaacatggcccagatccagcagggcggccccgacgagaaggagaagaccaccgccctgaaggacctgctgagcagaatcgacctggacgagctgatgaagaaggacgagccccccctggacttccccgacaccctggagggcttcgagtacgccttcaacgagaagggccagctgagacacatcaagaccggcgagcccttcgtgttcaactacagagaggacctgcacagatggaaccagaagagatacgaggccctgggcgagatcatcaccaagtacgtgtacgagctgctggagaaggactgcaacctgaagaaggtgagcatccccgtggacgccaccgagagcgagcccaagagcttcatcttcatgagcgaggacgccctgaccaacccccagaagctgatggtgctgatccacggcagcggcgtggtgagagccggccagtgggccagaagactgatcatcaacgaggacctggacagcggcacccagatccccttcatcaagagagccgtggccgagggctacggcgtgatcgtgctgaaccccaacgagaactacatcgaggtggagaagcccaagatccacgtgcagagcagcagcgacagcagcgacgagcccgccgagaagagagagagaaaggacaaggtgagcaaggagaccaagaagagaagagacttctacgagaagtacagaaacccccagagagagaaggagatgatgcagctgtacatcagagagaacggcagccccgaggagcacgccatctacgtgtgggaccacttcatcgcccaggccgccgccgagaacgtgttcttcgtggcccacagctacggcggcctggccttcgtggagctgatgatccagagagaggccgacgtgaagaacaaggtgaccgccgtggccctgaccgacagcgtgcacaacgtgtggcaccaggaggccggcaagaccatcagagagtggatgagagagaactgctgcaactgggtgagcagcagcgagcccctggacaccagcgtggagagcatgctgcccgactgccccagagtgagcgccggcaccgacagacacgagctgaccagctggaagagcttccccagcatcttcaagttcttcaccgaggccagcgaggccaagaccagcagcctgaagcccgccgtgaccagaagaagccacagaatcaagcacgaggagctgtag

SEQ ID NO: 4358 - DNA, 840 bp, Artificial Sequence
  Description of Artificial Sequence: Synthetic coding sequence
atgaagatcatcatcctgctgggcttcctgggcgccaccctgagcgcccccctgatcccccagagactgatgagcgccagcaacagcaacgagctgctgctgaacctgaacaacggccagctgctgcccctgcagctgcagggccccctgaacagctggatcccccccttcagcggcatcctgcagcagcagcagcaggcccagatccccggcctgagccagttcagcctgagcgccctggaccagttcgccggcctgctgcccaaccagatccccctgaccggcgaggccagcttcgcccagggcgcccaggccggccaggtggaccccctgcagctgcagacccccccccagacccagcccggccccagccacgtgatgccctacgtgttcagcttcaagatgccccaggagcagggccagatgttccagtactaccccgtgtacatggtgctgccctgggagcagccccagcagaccgtgcccagaagcccccagcagaccagacagcagcagtacgaggagcagatccccttctacgcccagttcggctacatcccccagctggccgagcccgccatcagcggcggccagcagcagctggccttcgacccccagctgggcaccgcccccgagatcgccgtgatgagcaccggcgaggagatcccctacctgcagaaggaggccatcaacttcagacacgacagcgccggcgtgttcatgcccagcaccagccccaagcccagcaccaccaacgtgttcaccagcgccgtggaccagaccatcacccccgagctgcccgaggagaaggacaagaccgacagcctgagagagccctag

SEQ ID NO: 4359 - DNA, 444 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggacccctag

SEQ ID NO: 4360 - DNA, 618 bp, Artificial Sequence
  Description of Artificial Sequence: Synthetic coding sequence
atgggcggccccgtgagagagcccgccctgagcgtggccctgtggctgagctggggcgccgccctgggcgccgtggcctgcgccatggccctgctgacccagcagaccgagctgcagagcctgagaagagaggtgagcagactgcagggcaccggcggccccagccagaacggcgagggctacccctggcagagcctgcccgagcagcacagcgtgctgcacctggtgcccatcaacgccaccagcaaggacgacagcgacgtgaccgaggtgatgtggcagcccgccctgagaagaggcagaggcctgcaggcccagggctacggcgtgagaatccaggacgccggcgtgtacctgctgtacagccaggtgctgttccaggacgtgaccttcaccatgggccaggtggtgagcagagagggccagggcagacaggagaccctgttcagatgcatcagaagcatgcccagccaccccgacagagcctacaacagctgctacagcgccggcgtgttccacctgcaccagggcgacatcctgagcgtgatcatccccagagccagagccaagctgaacctgagcccccacggcaccttcctgggcttcgtgaagctgtag

SEQ ID NO: 4361 - DNA, 744 bp, Artificial Sequence
  Description of Artificial Sequence: Synthetic coding sequence
atgcccgccagcagccccttcctgctggcccccaagggcccccccggcaacatgggcggccccgtgagagagcccgccctgagcgtggccctgtggctgagctggggcgccgccctgggcgccgtggcctgcgccatggccctgctgacccagcagaccgagctgcagagcctgagaagagaggtgagcagactgcagggcaccggcggccccagccagaacggcgagggctacccctggcagagcctgcccgagcagagcagcgacgccctggaggcctgggagaacggcgagagaagcagaaagagaagagccgtgctgacccagaagcagaagaagcagcacagcgtgctgcacctggtgcccatcaacgccaccagcaaggacgacagcgacgtgaccgaggtgatgtggcagcccgccctgagaagaggcagaggcctgcaggcccagggctacggcgtgagaatccaggacgccggcgtgtacctgctgtacagccaggtgctgttccaggacgtgaccttcaccatgggccaggtggtgagcagagagggccagggcagacaggagaccctgttcagatgcatcagaagcatgcccagccaccccgacagagcctacaacagctgctacagcgccggcgtgttccacctgcaccagggcgacatcctgagcgtgatcatccccagagccagagccaagctgaacctgagcccccacggcaccttcctgggcctgtag

SEQ ID NO: 4362 - DNA, 39 bp, Artificial Sequence
  Description of Artificial Sequence: Synthetic coding sequence
atgggcaagagcgagagcctgcagagcctgcagagatag

SEQ ID NO: 4363 - DNA, 4266 bp, Artificial Sequence
  Description of Artificial Sequence: Synthetic coding sequence
atgatgctgccccagaacagctggcacatcgacttcggcagatgctgctgccaccagaacctgttcagcgccgtggtgacctgcatcctgctgctgaacagctgcttcctgatcagcagcttcaacggcaccgacctggagctgagactggtgaacggcgacggcccctgcagcggcaccgtggaggtgaagttccagggccagtggggcaccgtgtgcgacgacggctggaacaccaccgccagcaccgtggtgtgcaagcagctgggctgccccttcagcttcgccatgttcagattcggccaggccgtgaccagacacggcaagatctggctggacgacgtgagctgctacggcaacgagagcgccctgtgggagtgccagcacagagagtggggcagccacaactgctaccacggcgaggacgtgggcgtgaactgctacggcgaggccaacctgggcctgagactggtggacggcaacaacagctgcagcggcagagtggaggtgaagttccaggagagatggggcaccatctgcgacgacggctggaacctgaacaccgccgccgtggtgtgcagacagctgggctgccccagcagcttcatcagcagcggcgtggtgaacagccccgccgtgctgagacccatctggctggacgacatcctgtgccagggcaacgagctggccctgtggaactgcagacacagaggctggggcaaccacgactgcagccacaacgaggacgtgaccctgacctgctacgacagcagcgacctggagctgagactggtgggcggcaccaacagatgcatgggcagagtggagctgaagatccagggcagatggggcaccgtgtgccaccacaagtggaacaacgccgccgccgacgtggtgtgcaagcagctgggctgcggcaccgccctgcacttcgccggcctgccccacctgcagagcggcagcgacgtggtgtggctggacggcgtgagctgcagcggcaacgagagcttcctgtgggactgcagacacagcggcaccgtgaacttcgactgcctgcaccagaacgacgtgagcgtgatctgcagcgacggcgccgacctggagctgagactggccgacggcagcaacaactgcagcggcagagtggaggtgagaatccacgagcagtggtggaccatctgcgaccagaactggaagaacgagcaggccctggtggtgtgcaagcagctgggctgccccttcagcgtgttcggcagcagaagagccaagcccagcaacgaggccagagacatctggatcaacagcatcagctgcaccggcaacgagagcgccctgtgggactgcacctacgacggcaaggccaagagaacctgcttcagaagaagcgacgccggcgtgatctgcagcgacaaggccgacctggacctgagactggtgggcgcccacagcccctgctacggcagactggaggtgaagtaccagggcgagtggggcaccgtgtgccacgacagatggagcaccagaaacgccgccgtggtgtgcaagcagctgggctgcggcaagcccctgcacgtgttcggcatgacctacttcaaggaggccagcggccccatctggctggacgacgtgagctgcatcggcaacgagagcaacatctgggactgcgagcacagcggctggggcaagcacaactgcgtgcacagagaggacgtgatcgtgacctgcagcggcgacgccacctggggcctgagactggtgggcggcagcaacagatgcagcggcagactggaggtgtacttccagggcagatggggcaccgtgtgcgacgacggctggaacagcaaggccgccgccgtggtgtgcagccagctggactgccccagcagcatcatcggcatgggcctgggcaacgccagcaccggctacggcaagatctggctggacgacgtgagctgcgacggcgacgagagcgacctgtggagctgcagaaacagcggctggggcaacaacgactgcagccacagcgaggacgtgggcgtgatctgcagcgacgccagcgacatggagctgagactggtgggcggcagcagcagatgcgccggcaaggtggaggtgaacgtgcagggcgccgtgggcatcctgtgcgccaacggctggggcatgaacatcgccgaggtggtgtgcagacagctggagtgcggcagcgccatcagagtgagcagagagccccacttcaccgagagaaccctgcacatcctgatgagcaacagcggctgcaccggcggcgaggccagcctgtgggactgcatcagatgggagtggaagcagaccgcctgccacctgaacatggaggccagcctgatctgcagcgcccacagacagcccagactggtgggcgccgacatgccctgcagcggcagagtggaggtgaagcacgccgacacctggagaagcgtgtgcgacagcgacttcagcctgcacgccgccaacgtgctgtgcagagagctgaactgcggcgacgccatcagcctgagcgtgggcgaccacttcggcaagggcaacggcctgacctgggccgagaagttccagtgcgagggcagcgagacccacctggccctgtgccccatcgtgcagcaccccgaggacacctgcatccacagcagagaggtgggcgtggtgtgcagcagatacaccgacgtgagactggtgaacggcaagagccagtgcgacggccaggtggagatcaacgtgctgggccactggggcagcctgtgcgacacccactgggaccccgaggacgccagagtgctgtgcagacagctgagctgcggcaccgccctgagcaccaccggcggcaagtacatcggcgagagaagcgtgagagtgtggggccacagattccactgcctgggcaacgagagcctgctggacaactgccagatgaccgtgctgggcgcccccccctgcatccacggcaacaccgtgagcgtgatctgcaccggcagcctgacccagcccctgttcccctgcctggccaacgtgagcgacccctacctgagcgccgtgcccgagggcagcgccctgatctgcctggaggacaagagactgagactggtggacggcgacagcagatgcgccggcagagtggagatctaccacgacggcttctggggcaccatctgcgacgacggctgggacctgagcgacgcccacgtggtgtgccagaagctgggctgcggcgtggccttcaacgccaccgtgagcgcccacttcggcgagggcagcggccccatctggctggacgacctgaactgcaccggcatggagagccacctgtggcagtgccccagcagaggctggggccagcacgactgcagacacaaggaggacgccggcgtgatctgcagcgagttcaccgccctgagactgtacagcgagaccgagaccgagagctgcgccggcagactggaggtgttctacaacggcacctggggcagcgtgggcagaagaaacatcaccaccgccatcgccggcatcgtgtgcagacagctgggctgcggcgagaacggcgtggtgagcctggcccccctgagcaagaccggcagcggcttcatgtgggtggacgacatccagtgccccaagacccacatcagcatctggcagtgcctgagcgccccctgggagagaagaatcagcagccccgccgaggagacctggatcacctgcgaggacagaatcagagtgagaggcggcgacaccgagtgcagcggcagagtggagatctggcacgccggcagctggggcaccgtgtgcgacgacagctgggacctggccgaggccgaggtggtgtgccagcagctgggctgcggcagcgccctggccgccctgagagacgccagcttcggccagggcaccggcaccatctggctggacgacatgagatgcaagggcaacgagagcttcctgtgggactgccacgccaagccctggggccagagcgactgcggccacaaggaggacgccggcgtgagatgcagcggccagagcctgaagagcctgaacgccagcagcggccacctggccctgatcctgagcagcatcttcggcctgctgctgctggtgctgttcatcctgttcctgacctggtgcagagtgcagaagcagaagcacctgcccctgagagacgacacccccaaccacggctgcgaggacgccagcgacaccagcctgctgggcgtgctgcccgccagcgaggccaccaagtag

SEQ ID NO: 4364 - DNA, 1410 bp, Artificial Sequence; identical to SEQ ID NO: 3555
  Description of Artificial Sequence: Synthetic coding sequence

SEQ ID NO: 4365 - DNA, 837 bp, Artificial Sequence; identical to SEQ ID NO: 3875
  Description of Artificial Sequence: Synthetic coding sequence

SEQ ID NO: 4366 - DNA, 1128 bp, Artificial Sequence
  Description of Artificial Sequence: Synthetic coding sequence
atggagttcgagatcaccttcagacccgacagcggcgacggcgtgctgctgtacagctacgacaccggcagcaaggacttcctgagcatcaacctggccggcggccacgtggagttcagattcgactgcggcagcggcaccggcgtgctgagaagcgaggaccccctgaccctgggcaactggcacgagctgagagtgagcagaaccgccaagaacggcatcctgcaggtggacaagcagaagatcgtggagggcatggccgagggcggcttcacccagatcaagtgcaacaccgacatcttcatcggcggcgtgcccaactacgacgacgtgaagaagaacagcggcgtgctgaagcccttcagcggcagcatccagaagatcatcctgaacgacagaaccatccacgtgaagcacgacttcaccagcggcgtgaacgtggagaacgccgcccacccctgcgtgagagccccctgcgcccacggcggcagctgcagacccagaaaggagggctacgactgcgactgccccctgggcttcgagggcctgcactgccagaaggccatcatcgaggccatcgagatcccccagttcatcggcagaagctacctgacctacgacaaccccgacatcctgaagagagtgagcggcagcagaagcaacgtgttcatgagattcaagaccaccgccaaggacggcctgctgctgtggagaggcgacagccccatgagacccaacagcgacttcatcagcctgggcctgagagacggcgccctggtgttcagctacaacctgggcagcggcgtggccagcatcatggtgaacggcagcttcaacgacggcagatggcacagagtgaaggccgtgagagacggccagagcggcaagatcaccgtggacgactacggcgccagaaccggcaagagccccggcatgatgagacagctgaacatcaacggcgccctgtacgtgggcggcatgaaggagatcgccctgcacaccaacagacagtacatgagaggcctggtgggctgcatcagccacttcaccctgagcaccgactaccacatcagcctggtggaggacgccgtggacggcaagaacatcaacacctgcggcgccaagtag

SEQ ID NO: 4367 - DNA, 459 bp, Artificial Sequence
  Description of Artificial Sequence: Synthetic coding sequence
atgagattcaagaccaccgccaaggacggcctgctgctgtggagaggcgacagccccatgagacccaacagcgacttcatcagcctgggcctgagagacggcgccctggtgttcagctacaacctgggcagcggcgtggccagcatcatggtgaacggcagcttcaacgacggcagatggcacagagtgaaggccgtgagagacggccagagcggcaagatcaccgtggacgactacggcgccagaaccggcaagagccccggcatgatgagacagctgaacatcaacggcgccctgtacgtgggcggcatgaaggagatcgccctgcacaccaacagacagtacatgagaggcctggtgggctgcatcagccacttcaccctgagcaccgactaccacatcagcctggtggaggacgccgtggacggcaagaacatcaacacctgcggcgccaagtag

SEQ ID NO: 4368 - DNA, 1050 bp, Artificial Sequence
  Description of Artificial Sequence: Synthetic coding sequence
atgaccgccctgcccggccccctgtggctgctgggcctggccctgtgcgccctgggcggcggcggccccggcctgagacccccccccggctgcccccagagaagactgggcgccagagagagaagagacgtgcagagagagatcctggccgtgctgggcctgcccggcagacccagacccagagccccccccgccgccagcagactgcccgccagcgcccccctgttcatgctggacctgtaccacgccatggccggcgacgacgacgaggacggcgcccccgccgagagaagactgggcagagccgacctggtgatgagcttcgtgaacatggtggagagagacagagccctgggccaccaggagccccactggaaggagttcagattcgacctgacccagatccccgccggcgaggccgtgaccgccgccgagttcagaatctacaaggtgcccagcatccacctgctgaacagaaccctgcacgtgagcatgttccaggtggtgcaggagcagagcaacagagagagcgacctgttcttcctggacctgcagaccctgagagccggcgacgagggctggctggtgctggacgtgaccgccgccagcgactgctggctgctgaagagacacaaggacctgggcctgagactgtacgtggagaccgaggacggcgagacctggaccggctggggctggaccaaggacagcagactgcagatgtggaagctgagactgagcagaaccccctgggtgctgagcctgcacgcccccggccccgcccaggcccccgccgagagacccctgctgtgcctgctgcagggccactgccccgccagccccagccccatcagaacccccagagccgtgagacccctgagaagaagacagcccaagaagagcaacgagctgccccaggccaacagactgcccggcatcttcgacgacgtgcacggcagccacggcagacaggtgtgcagaagacacgagctgtacgtgagcttccaggacctgggctggctggtgatcgccgacagcagctgcttctag

SEQ ID NO: 4369 - DNA, 1617 bp, Artificial Sequence; identical to SEQ ID NO: 3701
  Description of Artificial Sequence: Synthetic coding sequence

SEQ ID NO: 4370 - DNA, 630 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgccctgggcctggccagagccaacaacgagctgctgaagagactgcaggaggaggtgggcgacctgagacagggcaaggtgagcatccccgacgaggacggcgagagcagagcccacagcagcccccccgaggagcccggccccctgaaggagagccccggcgaggccttcaaggccctgagcgccgtggaggaggagtgcgacagcgtgggcagcggcgtgcaggtggtgatcgaggagctgagacagctgggcgccgccagcgtgggccccggccccctgggcttccccgccacccagagagacatgagactgcccggctgcaccctggccgccagcgaggccgcccccctgctgaaccccctggtggacgactacgtggccagcgagggctag

SEQ ID NO: 4371 - DNA, 1617 bp, Artificial Sequence; identical to SEQ ID NO: 3701
  Description of Artificial Sequence: Synthetic coding sequence

SEQ ID NO: 4372 - DNA, 1524 bp, Artificial Sequence; identical to SEQ ID NO: 3707
  Description of Artificial Sequence: Synthetic coding sequence

SEQ ID NO: 4373 - DNA, 753 bp, Artificial Sequence
  Description of Artificial Sequence: Synthetic coding sequence
atggccagcgagagactgcccaacagacccgcctgcctgctggtggccagcggcgccgccgagggcgtgagcgcccagagcttcctgcactgcttcaccatggccagcaccgccttcaacctgcaggtggccacccccggcggcaaggccatggagttcgtggacgtgaccgagagcaacgccagatgggtgcaggacttcagactgaaggcctacgccagccccgccaagctggagagcatcgacggcgccagataccacgccctgctgatccccagctgccccggcgccctgaccgacctggccagcagcggcagcctggccagaatcctgcagcacttccacagcgagagcaagcccatctgcgccgtgggccacggcgtggccgccctgtgctgcgccaccaacgaggacagaagctgggtgttcgacagctacagcctgaccggccccagcgtgtgcgagctggtgagagcccccggcttcgccagactgcccctggtggtggaggacttcgtgaaggacagcggcgcctgcttcagcggcgccgccgccagctgccccaaggccgacagacactggcagcacttccccgtggaggagatcttcctggcctgcggcttcaaggtggccggcctgggcgccgcccccggctggggcagaggcggcaagcaggaggacagaccccccgaggagcagagaagagccggcgaggacttccccatctaccagtgcgtgttcatctacccctag

SEQ ID NO: 4374 - DNA, 1386 bp, Artificial Sequence; identical to SEQ ID NO: 3950
  Description of Artificial Sequence: Synthetic coding sequence

SEQ ID NO: 4375 - DNA, 1386 bp, Artificial Sequence; identical to SEQ ID NO: 3950
  Description of Artificial Sequence: Synthetic coding sequence

SEQ ID NO: 4376 - DNA, 1386 bp, Artificial Sequence; identical to SEQ ID NO: 3950
  Description of Artificial Sequence: Synthetic coding sequence

SEQ ID NO: 4377 - DNA, 1452 bp, Artificial Sequence
  Description of Artificial Sequence: Synthetic coding sequence
atgatcaccgcccactgcagcctggacctgctgggcagcgtggccgtgctgtgcgtgtgcgacctgagccccgcccagtgcgacatcaactgctgctgcgaccccgactgcagcagcgtggacttcagcgtgttcagcgcctgcagcgtgcccgtggtgaccggcgacagccagttctgcagccagaaggccgtgatctacagcctgaacttcaccgccaaccccccccagagagtgttcgagctggtggaccagatcaaccccagcatcttctgcatccacatcaccaactacaagcccgccctgagcttcatcaaccccgaggtgcccgacgagaacaacttcgacaccctgatgaagaccagcgacggcttcaccctgaacgccgagagctacgtgagcttcaccaccaagctggacatccccaccgccgccaagtacgagtacggcgtgcccctgcagaccagcgacagcttcctgagattccccagcagcctgaccagcagcctgtgcaccgacaacaaccccgccgccttcctggtgaaccaggccgtgaagtgcaccagaaagatcaacctggagcagtgcgaggagatcgaggccctgagcatggccttctacagcagccccgagatcctgagagtgcccgacagcagaaagaaggtgcccatcaccgtgcagagcatcgtgatccagagcctgaacaagaccctgaccagaagagaggacaccgacgtgctgcagcccaccctggtgaacgccggccacttcagcctgtgcgtgaacgtggtgctggaggtgaagtacagcctgacctacaccgacgccggcgaggtgaccaaggccgacctgagcttcgtgctgggcaccgtgagcagcgtggtggtgcccctgcagcagaagttcgagatccacttcctgcaggagaacacccagcccgtgcccctgagcggcaaccccggctacgtggtgggcctgcccctggccgccggcttccagccccacaagaccggcgccctgccctgccagctggtggcccagaaggtgaagagcctgctgtggggccagggcttccccgactacgtggcccccttcggcaacagccaggcccaggacatgctggactgggtgcccatccacttcatcacccagagcttcaacagaaagcacttcgtgctgcaggacagctgccagctgcccggcgccctggtgatcgaggtgaagtggaccaagtacggcagcctgctgaacccccaggccaagatcgtgaacgtgaccgccaacctgatcagcagcagcttccccgaggccaacagcggcaacgagagaaccatcctgatcagcaccgccgtgaccttcgtggacgtgagcgcccccgccgaggccggcttcagagccccccccgccatcaacgccagactgcccttcaacttcttcttccccttcgtgtag

SEQ ID NO: 4378 - DNA, 1596 bp, Artificial Sequence
  Description of Artificial Sequence: Synthetic coding sequence
atgtgccagctgctggagagcaccgtgatccagccccagggcgacagccccgtggccgtgctgtgcgtgtgcgacctgagccccgcccagtgcgacatcaactgctgctgcgaccccgactgcagcagcgtggacttcagcgtgttcagcgcctgcagcgtgcccgtggtgaccggcgacagccagttctgcagccagaaggccgtgatctacagcctgaacttcaccgccaaccccccccagagagtgttcgagctggtggaccagatcaaccccagcatcttctgcatccacatcaccaactacaagcccgccctgagcttcatcaaccccgaggtgcccgacgagaacaacttcgacaccctgatgaagaccagcgacggcttcaccctgaacgccgagagctacgtgagcttcaccaccaagctggacatccccaccgccgccaagtacgagtacggcgtgcccctgcagaccagcgacagcttcctgagattccccagcagcctgaccagcagcctgtgcaccgacaacaaccccgccgccttcctggtgaaccaggccgtgaagtgcaccagaaagatcaacctggagcagtgcgaggagatcgaggccctgagcatggccttctacagcagccccgagatcctgagagtgcccgacagcagaaagaaggtgcccatcaccgtgcagagcatcgtgatccagagcctgaacaagaccctgaccagaagagaggacaccgacgtgctgcagcccaccctggtgaacgccggccacttcagcctgtgcgtgaacgtggtgctggaggtgaagtacagcctgacctacaccgacgccggcgaggtgaccaaggccgacctgagcttcgtgctgggcaccgtgagcagcgtggtggtgcccctgcagcagaagttcgagatccacttcctgcaggagaacacccagcccgtgcccctgagcggcaaccccggctacgtggtgggcctgcccctggccgccggcttccagccccacaagatgagcggcatcatccagaccaccaacagatacggccagctgaccatcctgcacagcaccaccgagcaggactgcctggccctggagggcgtgagaacccccgtgctgttcggctacaccatgcagagcggctgcaagctgagactgaccggcgccctgccctgccagctggtggcccagaaggtgaagagcctgctgtggggccagggcttccccgactacgtggcccccttcggcaacagccaggcccaggacatgctggactgggtgcccatccacttcatcacccagagcttcaacagaaaggacagctgccagctgcccggcgccctggtgatcgaggtgaagtggaccaagtacggcagcctgctgaacccccaggccaagatcgtgaacgtgaccgccaacctgatcagcagcagcttccccgaggccaacagcggcaacgagagaaccatcctgatcagcaccgccgtgaccttcgtggacgtgagcgcccccgccgaggccggcttcagagccccccccgccatcaacgccagactgcccttcaacttcttcttccccttcgtgtag

SEQ ID NO: 4379 - DNA, 1722 bp, Artificial Sequence
  Description of Artificial Sequence: Synthetic coding sequence
atgagacccagaggcctgccccccctgctggtggtgctgctgggctgctgggccagcgtgagcgcccagaccgacgccacccccgccgtgaccaccgagggcctgaacagcaccgaggccgccctggccaccttcggcaccttccccagcaccagaccccccggcacccccagagcccccggccccagcagcggccccagacccacccccgtgaccgacgtggccgtgctgtgcgtgtgcgacctgagccccgcccagtgcgacatcaactgctgctgcgaccccgactgcagcagcgtggacttcagcgtgttcagcgcctgcagcgtgcccgtggtgaccggcgacagccagttctgcagccagaaggccgtgatctacagcctgaacttcaccgccaaccccccccagagagtgttcgagctggtggaccagatcaaccccagcatcttctgcatccacatcaccaactacaagcccgccctgagcttcatcaaccccgaggtgcccgacgagaacaacttcgacaccctgatgaagaccagcgacggcttcaccctgaacgccgagagctacgtgagcttcaccaccaagctggacatccccaccgccgccaagtacgagtacggcgtgcccctgcagaccagcgacagcttcctgagattccccagcagcctgaccagcagcctgtgcaccgacaacaaccccgccggccaggcctactggttcacccccgtgatccccgccctgtgggaggccgaggccagaggcagcctggaggtgcccgacagcagaaagaaggtgcccatcaccgtgcagagcatcgtgatccagagcctgaacaagaccctgaccagaagagaggacaccgacgtgctgcagcccaccctggtgaacgccggccacttcagcctgtgcgtgaacgtggtgctggaggtgaagtacagcctgacctacaccgacgccggcgaggtgaccaaggccgacctgagcttcgtgctgggcaccgtgagcagcgtggtggtgcccctgcagcagaagttcgagatccacttcctgcaggagaacacccagcccgtgcccctgagcggcaaccccggctacgtggtgggcctgcccctggccgccggcttccagccccacaagggcagcggcatcatccagaccaccaacagatacggccagctgaccatcctgcacagcaccaccgagcaggactgcctggccctggagggcgtgagaacccccgtgctgttcggctacaccatgcagagcggctgcaagctgagactgaccggcgccctgccctgccagctggtggcccagaaggtgaagagcctgctgtggggccagggcttccccgactacgtggcccccttcggcaacagccaggcccaggacatgctggactgggtgcccatccacttcatcacccagagcttcaacagaaaggacagctgccagctgcccggcgccctggtgatcgaggtgaagtggaccaagtacggcagcctgctgaacccccaggccaagatcgtgaacgtgaccgccaacctgatcagcagcagcttccccgaggccaacagcggcaacgagagaaccatcctgatcagcaccgccgtgaccttcgtggacgtgagcgcccccgccgaggccggcttcagagccccccccgccatcaacgccagactgcccttcaacttcttcttccccttcgtgtag

SEQ ID NO: 4380 - DNA, 1230 bp, Artificial Sequence
  Description of Artificial Sequence: Synthetic coding sequence
atgaagaccagcgacggcttcaccctgaacgccgagagctacgtgagcttcaccaccaagctggacatccccaccgccgccaagtacgagtacggcgtgcccctgcagaccagcgacagcttcctgagattccccagcagcctgaccagcagcctgtgcaccgacaacaaccccgccgccttcctggtgaaccaggccgtgaagtgcaccagaaagatcaacctggagcagtgcgaggagatcgaggccctgagcatggccttctacagcagccccgagatcctgagagtgcccgacagcagaaagaaggtgcccatcaccgtgcagagcatcgtgatccagagcctgaacaagaccctgaccagaagagaggacaccgacgtgctgcagcccaccctggtgaacgccggccacttcagcctgtgcgtgaacgtggtgctggaggtgaagtacagcctgacctacaccgacgccggcgaggtgaccaaggccgacctgagcttcgtgctgggcaccgtgagcagcgtggtggtgcccctgcagcagaagttcgagatccacttcctgcaggagaacacccagcccgtgcccctgagcggcaaccccggctacgtggtgggcctgcccctggccgccggcttccagccccacaagggcagcggcatcatccagaccaccaacagatacggccagctgaccatcctgcacagcaccaccgagcaggactgcctggccctggagggcgtgagaacccccgtgctgttcggctacaccatgcagagcggctgcaagctgagactgaccggcgccctgccctgccagctggtggcccagaaggtgaagagcctgctgtggggccagggcttccccgactacgtggcccccttcggcaacagccaggcccaggacatgctggactgggtgcccatccacttcatcacccagagcttcaacagaaaggacagctgccagctgcccggcgccctggtgatcgaggtgaagtggaccaagtacggcagcctgctgaacccccaggccaagatcgtgaacgtgaccgccaacctgatcagcagcagcttccccgaggccaacagcggcaacgagagaaccatcctgatcagcaccgccgtgaccttcgtggacgtgagcgcccccgccgaggccggcttcagagccccccccgccatcaacgccagactgcccttcaacttcttcttccccttcgtgtag

SEQ ID NO: 4381 - DNA, 1779 bp, Artificial Sequence
  Description of Artificial Sequence: Synthetic coding sequence
atgagacccagaggcctgccccccctgctggtggtgctgctgggctgctgggccagcgtgagcgcccagaccgacgccacccccgccgtgaccaccgagggcctgaacagcaccgaggccgccctggccaccttcggcaccttccccagcaccagaccccccggcacccccagagcccccggccccagcagcggccccagacccacccccgtgaccgacgtggccgtgctgtgcgtgtgcgacctgagccccgcccagtgcgacatcaactgctgctgcgaccccgactgcagcagcgtggacttcagcgtgttcagcgcctgcagcgtgcccgtggtgaccggcgacagccagttctgcagccagaaggccgtgatctacagcctgaacttcaccgccaaccccccccagagagtgttcgagctggtggaccagatcaaccccagcatcttctgcatccacatcaccaactacaagcccgccctgagcttcatcaaccccgaggtgcccgacgagaacaacttcgacaccctgatgaagaccagcgacggcttcaccctgaacgccgagagctacgtgagcttcaccaccaagctggacatccccaccgccgccaagtacgagtacggcgtgcccctgcagaccagcgacagcttcctgagattccccagcagcctgaccagcagcctgtgcaccgacaacaaccccgccgccttcctggtgaaccaggccgtgaagtgcaccagaaagatcaacctggagcagtgcgaggagatcgaggccctgagcatggccttctacagcagccccgagatcctgagagtgcccgacagcagaaagaaggtgcccatcaccgtgcagagcatcgtgatccagagcctgaacaagaccctgaccagaagagaggacaccgacgtgctgcagcccaccctggtgaacgccggccacttcagcctgtgcgtgaacgtggtgctggaggtgaagtacagcctgacctacaccgacgccggcgaggtgaccaaggccgacctgagcttcgtgctgggcaccgtgagcagcgtggtggtgcccctgcagcagaagttcgagatccacttcctgcaggagaacacccagcccgtgcccctgagcggcaaccccggctacgtggtgggcctgcccctggccgccggcttccagccccacaagggcagcggcatcatccagaccaccaacagatacggccagctgaccatcctgcacagcaccaccgagcaggactgcctggccctggagggcgtgagaacccccgtgctgttcggctacaccatgcagagcggctgcaagctgagactgaccggcgccctgccctgccagctggtggcccagaaggtgaagagcctgctgtggggccagggcttccccgactacgtggcccccttcggcaacagccaggcccaggacatgctggactgggtgcccatccacttcatcacccagagcttcaacagaaagcacttcgtgctgcaggacagctgccagctgcccggcgccctggtgatcgaggtgaagtggaccaagtacggcagcctgctgaacccccaggccaagatcgtgaacgtgaccgccaacctgatcagcagcagcttccccgaggccaacagcggcaacgagagaaccatcctgatcagcaccgccgtgaccttcgtggacgtgagcgcccccgccgaggccggcttcagagccccccccgccatcaacgccagactgcccttcaacttcttcttccccttcgtgtag

SEQ ID NO: 4382 - DNA, 552 bp, Artificial Sequence
  Description of Artificial Sequence: Synthetic coding sequence
atgatcttcctgctgctgatgctgagcctggagctgcagctgcaccagatcgccgccctgttcaccgtgaccgtgcccaaggagctgtacatcatcgagcacggcagcaacgtgaccctggagtgcaacttcgacaccggcagccacgtgaacctgggcgccatcaccgccagcctgcagaaggtggagaacgacaccagcccccacagagagagagccaccctgctggaggagcagctgcccctgggcaaggccagcttccacatcccccaggtgcaggtgagagacgagggccagtaccagtgcatcatcatctacggcgtggcctgggactacaagtacctgaccctgaaggtgaagggccagatggagcccagaacccaccccacctggctgctgcacatcttcatccccttctgcatcatcgccttcatcttcatcgccaccgtgatcgccctgagaaagcagctgtgccagaagctgtacagcagcaaggacaccaccaagagacccgtgaccaccaccaagagagaggtgaacagcgccatctag

SEQ ID NO: 4383 - DNA, 822 bp, Artificial Sequence
  Description of Artificial Sequence: Synthetic coding sequence
atgatcttcctgctgctgatgctgagcctggagctgcagctgcaccagatcgccgccctgttcaccgtgaccgtgcccaaggagctgtacatcatcgagcacggcagcaacgtgaccctggagtgcaacttcgacaccggcagccacgtgaacctgggcgccatcaccgccagcctgcagaaggtggagaacgacaccagcccccacagagagagagccaccctgctggaggagcagctgcccctgggcaaggccagcttccacatcccccaggtgcaggtgagagacgagggccagtaccagtgcatcatcatctacggcgtggcctgggactacaagtacctgaccctgaaggtgaaggccagctacagaaagatcaacacccacatcctgaaggtgcccgagaccgacgaggtggagctgacctgccaggccaccggctaccccctggccgaggtgagctggcccaacgtgagcgtgcccgccaacaccagccacagcagaacccccgagggcctgtaccaggtgaccagcgtgctgagactgaagcccccccccggcagaaacttcagctgcgtgttctggaacacccacgtgagagagctgaccctggccagcatcgacctgcagagccagatggagcccagaacccaccccacctggctgctgcacatcttcatccccttctgcatcatcgccttcatcttcatcgccaccgtgatcgccctgagaaagcagctgtgccagaagctgtacagcagcaaggacaccaccaagagacccgtgaccaccaccaagagagaggtgaacagcgccatctag

SEQ ID NO: 4384 - DNA, 372 bp, Artificial Sequence
  Description of Artificial Sequence: Synthetic coding sequence
ctgggcgacagaagaggcagaagcagcggcgccagagccgccgccgtgggcagcaccggcgagagactggagatggaggaggacatcctgcagctgcaggccgaggccaccgccgaggtgctgggcgaggtggcccaggcccagaaggtgctgagagacagcgtgcagagactggaggtgcagctgagaagcgcctggctgggccccgcctacagagagttcgaggtgctgaaggcccacgccgacaagcagagccacatcctgtgggccctgaccggccacgtgcagagacagagaagagagatggtggcccagcagcacagactgagacagatccaggagagactgcacaccgccgccctgcccgcctag

SEQ ID NO: 4385 - DNA, 345 bp, Artificial Sequence
  Description of Artificial Sequence: Synthetic coding sequence
atggccagcttcaagctggccgacagcgtgtgggaggacagcctgagcaagagacagagaaaccagggcagaatgaagaccctgcccgtgctggtgctgagcctgaccctgctgaccgtgttcagcgagaccagccccatcctgaccgagaagcaggccaagcagctgctgagaagcagaagacaggacagacccagcaagcccggcttccccgacgagcccatgagagagtacatgcaccacctgctggccctggagcacagagccgaggagcagttcctggagcactggctgaacccccactgcaagccccactgcgacagaaacagaatccaccccgtgtag

SEQ ID NO: 4386 - DNA, 345 bp, Artificial Sequence; identical to SEQ ID NO: 4385
  Description of Artificial Sequence: Synthetic coding sequence

SEQ ID NO: 4387 - DNA, 444 bp, Artificial Sequence
  Description of Artificial Sequence: Synthetic coding sequence
atggccctgcagagaacccacagcctgctgctgctgctgctgctgaccctgctgggcctgggcctggtgcagcccagctacggccaggacggcatgtaccagagattcctgagacagcacgtgcaccccgaggagaccggcggcagcgacagatactgcaacctgatgatgcagagaagaaagatgaccctgtaccactgcaagagattcaacaccttcatccacgaggacatctggaacatcagaagcatctgcagcaccaccaacatccagtgcaagaacggcaagatgaactgccacgagggcgtggtgaaggtgaccgactgcagagacaccggcagcagcagagcccccaactgcagatacagagccatcgccagcaccagaagagtggtgatcgcctgcgagggcaacccccaggtgcccgtgcacttcgacggctag

SEQ ID NO: 4388 - DNA, 1302 bp, Artificial Sequence
  Description of Artificial Sequence: Synthetic coding sequence
atggagccccagctgggccccgaggccgccgccctgagacccggctggctggccctgctgctgtgggtgagcgccctgagctgcagcttcagcctgcccgccagcagcctgagcagcctggtgccccaggtgagaaccagctacaacttcggcagaaccttcctgggcctggacaagtgcaacgcctgcatcggcaccagcatctgcaagaagttcttcaaggaggagatcagaagcgacaactggctggccagccacctgggcctgccccccgacagcctgctgagctaccccgccaactacagcgacgacagcaagatctggagacccgtggagatcttcagactggtgagcaagtaccagaacgagatcagcgacagaagaatctgcgccagcgccagcgcccccaagacctgcagcatcgagagagtgctgagaaagaccgagagattccagaagtggctgcaggccaagagactgacccccgacctggtgcagggcctggccagccccctgctgagatgccccagccagagactgctggacagagtggtgagaagatacgccgaggtggccgacgccggcagcatcttcatggaccacttcaccgacagagacaagctgagactgctgtacaccctggccgtgaacagccaccccatcctgctgcagatcttccccggcgccgagggctggcccctgcccaagtacctgggcagctgcggcagattcctggtgagcaccagcaccagacccctgcaggagttctacgacgccccccccgaccaggccgccgacctggcctaccagctgctgggcgtgctggagagcctgagaagcaacgacctgaactacttcttctacttcacccacatcgacgccggcatgttcggcgtgttcaacaacggccacctgttcatcagagacgccagcgccgtgggcgtgatcgacaagcaggagggcagccaggaggccaacagagccggcgagaacaaggacatcttcagctgcctggtgagcggctgccaggcccagctgcccagctgcgagagcatcagcgagaagcagagcctggtgctggtgtgccagaagctgctgcccagactgctgcagggcagattccccagccccgtgcaggacgacatcgacagcatcctggtgcagtgcggcgacagcatcagacccgaccccgaggtgctgggcgccgccagccagctgaaggacatcctgagacccctgagaacctgcgacagcagattcgcctacagataccccgactgcaagtacaacgacaagttctag

SEQ ID NO: 4389 - DNA, 600 bp, Artificial Sequence; identical to SEQ ID NO: 3864
  Description of Artificial Sequence: Synthetic coding sequence

SEQ ID NO: 4390 - DNA, 600 bp, Artificial Sequence; identical to SEQ ID NO: 3864
  Description of Artificial Sequence: Synthetic coding sequence

SEQ ID NO: 4391 - DNA, 291 bp, Artificial Sequence
  Description of Artificial Sequence: Synthetic coding sequence
atgctgccctgcctggccctgctgctgctgatggagctgagcgtgtgcaccgtggccggcgacggcggcgaggagcagaccctgagcaccgaggccgagacctgggagggcgccggccccagcatccagctgcagctgcaggaggtgaagaccggcaaggccagccagttcttcggcctgatgggcaagagagtgggcgcctaccagctggagcacaccttccagggcctgctgggcaagagaagcctgttcaccgagggcagagaggacgaggcccagggcagcgagtag

SEQ ID NO: 4392 - DNA, 981 bp, Artificial Sequence
  Description of Artificial Sequence: Synthetic coding sequence
atgaccggcctgtgcggctacagcgcccccgacatgagaggcctgagactgatcatgatccccgtggagctgctgctgtgctacctgctgctgcaccccgtggacgccaccagctacggcaagcagaccaacgtgctgatgcacttccccctgagcctggagagccagacccccagcagcgaccccctgagctgccagttcctgcaccccaagagcctgcccggcttcagccacatggcccccctgcccaagttcctggtgagcctggccctgagaaacgccctggaggaggccggctgccaggccgacgtgtgggccctgcagctgcagctgtacagacagggcggcgtgaacgccacccaggtgctgatccagcacctgagaggcctgcagaagggcagaagcaccgagagaaacgtgagcgtggaggccctggccagcgccctgcagctgctggccagagagcagcagagcaccggcagagtgggcagaagcctgcccaccgaggactgcgagaacgagaaggagcaggccgtgcacaacgtggtgcagctgctgcccggcgtgggcaccttctacaacctgggcaccgccctgtactacgccacccagaactgcctgggcaaggccagagagagaggcagagacggcgccatcgacctgggctacgacctgctgatgaccatggccggcatgagcggcggccccatgggcctggccatcagcgccgccctgaagcccgccctgagaagcggcgtgcagcagctgatccagtactaccaggaccagaaggacgccaacatcagccagcccgagaccaccaaggagggcctgagagccatcagcgacgtgagcgacctggaggagaccaccaccctggccagcttcatcagcgaggtggtgagcagcgccccctactggggctgggccatcatcaagagctacgacctggaccccggcgccggcagcctggagatctag

SEQ ID NO: 4393 - DNA, 1476 bp, Artificial Sequence
  Description of Artificial Sequence: Synthetic coding sequence
atgagatggatcctgtgctggagcctgaccctgtgcctgatggcccagaccgccctgggcgccctgcacaccaagagaccccaggtggtgaccaagtacggcaccctgcagggcaagcagatgcacgtgggcaagacccccatccaggtgttcctgggcgtgcccttcagcagaccccccctgggcatcctgagattcgccccccccgagccccccgagccctggaagggcatcagagacgccaccacctacccccccggctgcctgcaggagagctggggccagctggccagcatgtacgtgagcaccagagagagatacaagtggctgagattcagcgaggactgcctgtacctgaacgtgtacgcccccgccagagcccccggcgacccccagctgcccgtgatggtgtggttccccggcggcgccttcatcgtgggcgccgccagcagctacgagggcagcgacctggccgccagagagaaggtggtgctggtgttcctgcagcacagactgggcatcttcggcttcctgagcaccgacgacagccacgccagaggcaactggggcctgctggaccagatggccgccctgagatgggtgcaggagaacatcgccgccttcggcggcgaccccggcaacgtgaccctgttcggccagagcgccggcgccatgagcatcagcggcctgatgatgagccccctggccagcggcctgttccacagagccatcagccagagcggcaccgccctgttcagactgttcatcaccagcaaccccctgaaggtggccaagaaggtggcccacctggccggctgcaaccacaacagcacccagatcctggtgaactgcctgagagccctgagcggcaccaaggtgatgagagtgagcaacaagatgagattcctgcagctgaacttccagagagaccccgaggagatcatctggagcatgagccccgtggtggacggcgtggtgatccccgacgaccccctggtgctgctgacccagggcaaggtgagcagcgtgccctacctgctgggcgtgaacaacctggagttcaactggctgctgccctacaacatcaccaaggagcaggtgcccctggtggtggaggagtacctggacaacgtgaacgagcacgactggaagatgctgagaaacagaatgatggacatcgtgcaggacgccaccttcgtgtacgccaccctgcagaccgcccactaccacagaggcctgagcatgggcaaggagaaggccctgagcctgcagatgatgaagtactgggccaacttcgccagaaccggcaaccccaacgacggcaacctgccctgctggcccagatacaacaaggacgagaagtacctgcagctggacttcaccaccagagtgggcatgaagctgaaggagaagaagatggccttctggatgagcctgtaccagagccagagacccgagaagcagagacagttctag

SEQ ID NO: 4394 - DNA, 285 bp, Artificial Sequence
  Description of Artificial Sequence: Synthetic coding sequence
atggccgccttcccccacaagatcatcttcttcctggtgtgcagcaccctgacccacgtggccttcagcggcatcttcaacaagagagacttcaccagatggcccaagcccagatgcaagatgtacatccccctggaccccgactacaacgccgactgccccaacgtgaccgcccccgtgtgcgccagcaacggccacaccttccagaacgagtgcttcttctgcgtggagcagagagagttccactacagaatcaagttcgagaagtacggcaagtgcgactag

SEQ ID NO: 4395 - DNA, 402 bp, Artificial Sequence
  Description of Artificial Sequence: Synthetic coding sequence
atgagacagagactgctgcccagcgtgaccagcctgctgctggtggccctgctgttccccggcagcagccaggccagacacgtgaaccacagcgccaccgaggccctgggcgagctgagagagagagcccccggccagggcaccaacggcttccagctgctgagacacgccgtgaagagagacctgctgccccccagaacccccccctaccagggcgacgtgccccccggcatcagaaacaccatctgccacatgcagcagggcatctgcagactgttcttctgccacagcggcgagaagaagagagacatctgcagcgacccctggaacagatgctgcgtgagcaacaccgacgaggagggcaaggagaagcccgagatggacggcagaagcggcatctag

SEQ ID NO: 4396 - DNA, 564 bp, Artificial Sequence
  Description of Artificial Sequence: Synthetic coding sequence
atgggctgctgcggctgcagcggcggctgcggcagcggctgcggcggctgcggcagcggctgcggcggctgcggcagcagctgctgcgtgcccatctgctgctgcaagcccgtgtgctgctgcgtgcccgcctgcagctgcagcagctgcggcagctgcggcggcagcaagggcggcagaggcagctgcggcggcagcaagggcgactgcggcagctgcggcggcagcaagggcggctgcggcagctgcggctgcagccagtgcagctgctacaagccctgctgctgcagcagcggctgcggcagcagctgctgccagagcagctgctgcaagccctgctgcagccagagcagctgctgcaagccctgcagctgcagcagcggctgcggcagcagctgctgccagagcagctgctgcaagccctgctgcagccagagcagctgctgcaagccctgctgctgcagcagcggctgcggcagcagctgctgccagagcagctgctgcaagccctgctgcagccagagcagctgctgcgtgcccatctgctgccagtgcaagatctag

SEQ ID NO: 4397 - DNA, 564 bp, Artificial Sequence
  Description of Artificial Sequence: Synthetic coding sequence
atgagacccctggccggcgcccccgtgcccaagagacagaagtgcgaccactggaccccctgccccagcgacacctacgcctacagactgctgagcggcggcggcagaagcaagtacgccaagatctgcttcgaggacaacctgctgatgggcgagcagctgggcaacgtggccagaggcatcaacatcgccatcgtgaactacgtgaccggcaacgtgaccgccaccagatgcttcgacatgtacgagggcgacaacagcggccccatgaccaagttcatccagagcgccgcccccaagagcctgctgttcatggtgacctacgacgacggcagcaccagactgaacaacgacgccaagaacgccatcgaggccctgggcagcaaggagatcagaaacatgaagttcagaagcagctgggtgttcatcgccgccaagggcctggagctgcccagcgagatccagagagagaagatcaaccacagcgacgccaagaacaacagatacagcggctggcccgccgagatccagatcgagggctgcatccccaaggagagaagctag

SEQ ID NO: 4398 - DNA, 249 bp, Artificial Sequence
  Description of Artificial Sequence: Synthetic coding sequence
atgaagatcctgtgcatcttcctgaccttcgtgttcaccgtgagctgcggccccagcgtgccccagaagaagaccagagaggtggccgagagaaagagagagtgccagctggtgagaggcgcctgcaagcccgagtgcaacagctgggagtacgtgtactactactgcaacgtgaacccctgctgcgccgtgtgggagtaccagaagcccatcatcaacaagatcaccagcaagctgcaccagaagtag

SEQ ID NO: 4399 - DNA, 186 bp, Artificial Sequence
  Description of Artificial Sequence: Synthetic coding sequence
atgaagatccacgtgttcctgttcgtgctgttcttcttcctggtgcccatcgccaccagagtgaagtgcgccgtgaaggacacctacagctgcttcatcatgagaggcaagtgcagacacgagtgccacgacttcgagaagcccatcggcttctgcaccaagctgaacgccaactgctacatgtag

SEQ ID NO: 4400 - DNA, 1056 bp, Artificial Sequence
  Description of Artificial Sequence: Synthetic coding sequence
atgggcaacctgttcatgctgtgggccgccctgggcatctgctgcgccgccttcagcgccagcgcctggagcgtgaacaacttcctgatcaccggccccaaggcctacctgacctacaccaccagcgtggccctgggcgcccagagcggcatcgaggagtgcaagttccagttcgcctgggagagatggaactgccccgagaacgccctgcagctgagcacccacaacagactgagaagcgccaccagagagaccagcttcatccacgccatcagcagcgccggcgtgatgtacatcatcaccaagaactgcagcatgggcgacttcgagaactgcggctgcgacggcagcaacaacggcaagaccggcggccacggctggatctggggcggctgcagcgacaacgtggagttcggcgagagaatcagcaagctgttcgtggacagcctggagaagggcaaggacgccagagccctgatgaacctgcacaacaacagagccggcagactggccgtgagagccaccatgaagagaacctgcaagtgccacggcatcagcggcagctgcagcatccagacctgctggctgcagctggccgagttcagagagatgggcgactacctgaaggccaagtacgaccaggccctgaagatcgagatggacaagagacagctgagagccggcaacagcgccgagggccactgggtgcccgccgaggccttcctgcccagcgccgaggccgagctgatcttcctggaggagagccccgactactgcacctgcaacagcagcctgggcatctacggcaccgagggcagagagtgcctgcagaacagccacaacaccagcagatgggagagaagaagctgcggcagactgtgcaccgagtgcggcctgcaggtggaggagagaaagaccgaggtgatcagcagctgcaactgcaagttccagtggtgctgcaccgtgaagtgcgaccagtgcagacacgtggtgagcaagtactactgcgccagaagccccggcagcgcccagagcctgggcaagggcagcgcctag

SEQ ID NO: 4401 - DNA, 1446 bp, Artificial Sequence
  Description of Artificial Sequence: Synthetic coding sequence
atgcagagcagactgctgctgctgggcgcccccggcggccacggcggccccgccagcagaagaatgagactgctgctgagacaggtggtgcagagaagacccggcggcgacagacagagacccgaggtgagactgctgcacgccggcagcggcgccgacaccggcgacaccgtgaacatcggcgacgtgagctacaagctgaagatccccaagaaccccgagctggtgccccagaactacatcagcgacagcctggcccagagcgtggtgcagcacctgagatggatcatgcagaaggacctgctgggccaggacgtgttcctgatcggcccccccggccccctgagaagaagcatcgccatgcagtacctggagctgaccaagagagaggtggagtacatcgccctgagcagagacaccaccgagaccgacctgaagcagagaagagagatcagagccggcaccgccttctacatcgaccagtgcgccgtgagagccgccaccgagggcagaaccctgatcctggagggcctggagaaggccgagagaaacgtgctgcccgtgctgaacaacctgctggagaacagagagatgcagctggaggacggcagattcctgatgagcgccgagagatacgacaagctgctgagagaccacaccaagaaggagctggacagctggaagatcgtgagagtgagcgagaacttcagagtgatcgccctgggcctgcccgtgcccagatacagcggcaaccccctggacccccccctgagaagcagattccaggccagagacatctactacctgcccttcaaggaccagctgaagctgctgtacagcatcggcgccaacgtgagcgccgagaaggtgagccagctgctgagcttcgccaccaccctgtgcagccaggagagcagcaccctgggcctgcccgacttccccctggacagcctggccgccgccgtgcagatcctggacagcttccccatgatgcccatcaagcacgccatccagtggctgtacccctacagcatcctgctgggccacgagggcaagatggccgtggagggcgtgctgaagagattcgagctgcaggacagcggcagcagcctgctgcccaaggagatcgtgaaggtggagaagatgatggagaaccacgtgagccaggccagcgtgaccatcagaatcgccgacaaggaggtgaccatcaaggtgcccgccggcaccagactgctgagccagccctgcgccagcgacagattcatccagaccctgagccacaagcagctgcaggccgagatgatgcagagccacatggtgaaggacatctgcctgatcggcggcaagggctgcggcaagaccgtgatcgccaagaacttcgccgacaccctgggctacaacatcgagcccatcatgctgtaccagcacaaggtgccccacatctag

SEQ ID NO: 4402 - DNA, 786 bp, Artificial Sequence
  Description of Artificial Sequence: Synthetic coding sequence
atggccagcctggccgtgagcaactggcccaagcccatgcccctgatcccctgcctgagctggagcaccgccagcggcgtgttcaccaccggcgtgctgagcaagagcatcaactggagagagctggagaagcagtactacacccagaccgtgtacgaggaggagatcatccacatgctggagtactgcggcaccgacagcttcaagatgggccaggagttcgtgaagcacttcaccagcagcgccgacaagctgaccaacctgaacctggtgagcagaaccctgaacctggacatcagcaaccaggtggtgagccagaagcccgccgactgccacaacagcagcaagaccagcgtgagcgccaccagcgagggcctgctgctgcaggacaccagcaagatgaagagattcaaccagaccctgagcaccaacaagagcggctacaccagcagaaacccccagagctaccacctgctgagcaaggagcagagcagaaacagcctgagaaaggagagcctgatcttcatgaagggcgtgatggacgagtgcacccacgtggccaacttcagcgtgcccgtggaccccagcctgatcatcgtggtgcaggccaaggaggacgcctacatccccagaaccggcgtgagaagcctgcaggagatctggcccggctgcgagatcagatacctggagggcggccacatcagcgcctacctgttcaagcagggcctgttcagacaggccatctacgacgccttcgacagattcctgcacaagtacgccaactag

SEQ ID NO: 4403 - DNA, 1245 bp, Artificial Sequence
  Description of Artificial Sequence: Synthetic coding sequence
atgggcgtgagcaagctggacatcctgtacagaagactgctgctgaccaagctgttcatcagaggctggggcagacccgaggacctgaagagactgttcgagttcagaaagatgatcggcaacagagagagatgccagaacctggtgagcagcgactaccccgtgcacatcgacaagatcgaggagcagagcgactgcaagatcctggacggccacttcgtgagccccatggcccactacgtgcccgacatcatgcccatcgagagcgtgatcgccagattccagttcatcgtgcccaaggagtggaacagcaagtacagacccgtgtgcatccacctggccggcaccggcgaccaccactactggagaagaagaaccctgatggccagacccatgatcaaggaggccagaatggccagcctgctgctggagaacccctactacggctgcagaaagcccaaggaccaggtgagaagcagcctgaagaacgtgagcgacctgttcgtgatgggcggcgccctggtgctggagagcgccgccctgctgcactggctggagagagagggctacggccccctgggcatgaccggcatcagcatgggcggccacatggccagcctggccgtgagcaactggcccaagcccatgcccctgatcccctgcctgagctggagcaccgccagcggcgtgttcaccaccaccgacagcttcaagatgggccaggagttcgtgaagcacttcaccagcagcgccgacaagctgaccaacctgaacctggtgagcagaaccctgaacctggacatcagcaaccaggtggtgagccagaagcccgccgactgccacaacagcagcaagaccagcgtgagcgccaccagcgagggcctgctgctgcaggacaccagcaagatgaagagattcaaccagaccctgagcaccaacaagagcggctacaccagcagaaacccccagagctaccacctgctgagcaaggagcagagcagaaacagcctgagaaaggagagcctgatcttcatgaagggcgtgatggacgagtgcacccacgtggccaacttcagcgtgcccgtggaccccagcctgatcatcgtggtgcaggccaaggaggacgcctacatccccagaaccggcgtgagaagcctgcaggagatctggcccggctgcgagatcagatacctggagggcggccacatcagcgcctacctgttcaagcagggcctgttcagatag

SEQ ID NO: 4404 - DNA, 747 bp, Artificial Sequence
  Description of Artificial Sequence: Synthetic coding sequence
atgaagctgaccttcttcctgggcctgctggccctgatcagctgcttcacccccagcgagagccagagattcagcagaagaccctacctgcccggccagctgccccccccccccctgtacagacccagatgggtgccccccagccccccccccccctacgacagcagactgaacagccccctgagcctgcccttcgtgcccggcagagtgccccccagcagcttcagcagattcagccaggccgtgatcctgagccagctgttccccctggagagcatcagacagcccagactgttccccggctaccccaacctgcacttccccctgagaccctactacgtgggccccatcagaatcctgaagccccccttcccccccatccccttcttcctggccatctacctgcccatcagcaaccccgagccccagatcaacatcaccaccgccgacaccaccatcaccaccaacccccccaccaccgccaccgccaccaccagcaccagcaccaagcccaccatgaccatcagcagcagcaccgtgcccatcagcagcacccccgagcccgccaccagcatcagcgccgccacccccgccgccagcaccgagaacaccacccagatcctggccaacagaccccacaccgtgctgctgaacgccaccgtgcaggtgaccaccagcaaccagaccatcctgagcagccccgccttcaagagcttctggcagaagctgttcgccatcttcggctag

SEQ ID NO: 4405 - DNA, 231 bp, Artificial Sequence
  Description of Artificial Sequence: Synthetic coding sequence
atgggcgccgccatcagccagggcgccctgatcgccatcgtgtgcaacggcctggtgggcttcctgctgctgctgctgtgggtgatcctgtgctgggcctgccacagcagaagcgccgacgtggacagcctgagcgagagcagccccaacagcagccccggcccctgccccgagaaggccccccccccccagaagcccagccacgagggcagctacctgctgcagccctag

SEQ ID NO: 4406 - DNA, 1536 bp, Artificial Sequence; identical to SEQ ID NO: 3595
  Description of Artificial Sequence: Synthetic coding sequence

SEQ ID NO: 4407 - DNA, 1536 bp, Artificial Sequence; identical to SEQ ID NO: 3595
  Description of Artificial Sequence: Synthetic coding sequence

SEQ ID NO: 4408 - DNA, 240 bp, Artificial Sequence
  Description of Artificial Sequence: Synthetic coding sequence
atgaagctgcacagcctgatcagcgtgctgctgctgttcgtgaccctgatccccaagggcaagaccggcgtgatccccggccagaagcagtgcatcgccctgaagggcgtgtgcagagacaagctgtgcagcaccctggacgacaccatcggcatctgcaacgagggcaagaagtgctgcagaagatggtggatcctggagccctaccccacccccgtgcccaagggcaagagcccctag

SEQ ID NO: 4409 - DNA, 351 bp, Artificial Sequence; identical to SEQ ID NO: 4162
  Description of Artificial Sequence: Synthetic coding sequence

SEQ ID NO: 4410 - DNA, 543 bp, Artificial Sequence
  Description of Artificial Sequence: Synthetic coding sequence
caggtgatccccatcaacagcggcgacctgttcgtgcaccccctgtggaacagaagctgcgtggcctgcggcaacgacatcgccctgatcaagctgagcagaagcgcccagctgggcgacgccgtgcagctggccagcctgccccccgccggcgacatcctgcccaacgagaccccctgctacatcaccggctggggcagactgtacaccaacggccccctgcccgacaagctgcaggaggccctgctgcccgtggtggactacgagcactgcagcagatggaactggtggggcagcagcgtgaagaagaccatggtgtgcgccggcggcgacatcagaagcggctgcaacggcgacagcggcggccccctgaactgccccaccgaggacggcggctggcaggtgcacggcgtgaccagcttcgtgagcgccttcggctgcaacaccagaagaaagcccaccgtgttcaccagagtgagcgccttcatcgactggatcgaggagaagctgcagggcaacaaggcccccgagagcagaacctag

SEQ ID NO: 4411 - DNA, 1215 bp, Artificial Sequence
  Description of Artificial Sequence: Synthetic coding sequence
atgccccccttcctgatcaccctgttcctgttccacagctgctgcctgagagccaacggccacctgagagagggcatgaccctgctgaagaccgagttcgccctgcacctgtaccagagcgtggccgcctgcagaaacgagaccaacttcgtgatcagccccgccggcgtgagcctgcccctggagatcctgcagttcggcgccgagggcagcaccggccagcagctggccgacgccctgggctacaccgtgcacgacaagagagtgaaggacttcctgcacgccgtgtacgccaccctgcccaccagcagccagggcaccgagatggagctggcctgcagcctgttcgtgcaggtgggcacccccctgagcccctgcttcgtggagcacgtgagctggtgggccaacagcagcctggagcccgccgacctgagcgagcccaacagcaccgccatccagaccagcgagggcgccagcagagagaccgccggcggcggccccagcgagggccccggcggctggccctgggagcaggtgagcgccgccttcgcccagctggtgctggtgagcaccatgagcttccagggcacctggagaaagagattcagcagcaccgacacccagatcctgcccttcacctgcgcctacggcctggtgctgcaggtgcccatgatgcaccagaccaccgaggtgaactacggccagttccaggacaccgccggccaccaggtgggcgtgctggagctgccctacctgggcagcgccgtgagcctgttcctggtgctgcccagagacaaggacacccccctgagccacatcgagccccacctgaccgccagcaccatccacctgtggaccaccagcctgagaagagccagaatggacgtgttcctgcccagattcagaatccagaaccagttcaacctgaagagcatcctgaacagctggggcgtgaccgacctgttcgaccccctgaaggccaacctgaagggcatcagcggccaggacggcttctacgtgagcgaggccatccacaaggccaagatcgaggtgctggaggagggcaccaaggccagcggcgccaccgccctgctgctgctgaagagaagcagaatccccatcttcaaggccgacagacccttcatctacttcctgagagagcccaacaccggcttcgtgttcagcatcggcagagtgagcaaccccctggactag

SEQ ID NO: 4412 - DNA, 444 bp, Artificial Sequence; identical to SEQ ID NO: 4359
  Description of Artificial Sequence: Synthetic coding sequence

SEQ ID NO: 4413 - DNA, 2631 bp, Artificial Sequence; identical to SEQ ID NO: 3583
  Description of Artificial Sequence: Synthetic coding sequence

SEQ ID NO: 4414 - DNA, 2631 bp, Artificial Sequence; identical to SEQ ID NO: 3583
  Description of Artificial Sequence: Synthetic coding sequence

SEQ ID NO: 4415 - DNA, 2742 bp, Artificial Sequence; identical to SEQ ID NO: 3799
  Description of Artificial Sequence: Synthetic coding sequence

SEQ ID NO: 4416 - DNA, 444 bp, Artificial Sequence; identical to SEQ ID NO: 4359
  Description of Artificial Sequence: Synthetic coding sequence

SEQ ID NO: 4417 - DNA, 2631 bp, Artificial Sequence; identical to SEQ ID NO: 3583
  Description of Artificial Sequence: Synthetic coding sequence

SEQ ID NO: 4418 - DNA, 2631 bp, Artificial Sequence; identical to SEQ ID NO: 3583
  Description of Artificial Sequence: Synthetic coding sequence

SEQ ID NO: 4419 - DNA, 2631 bp, Artificial Sequence; identical to SEQ ID NO: 3583
  Description of Artificial Sequence: Synthetic coding sequence

SEQ ID NO: 4420 - DNA, 2742 bp, Artificial Sequence; identical to SEQ ID NO: 3799
  Description of Artificial Sequence: Synthetic coding sequence

SEQ ID NO: 4421 - DNA, 2742 bp, Artificial Sequence; identical to SEQ ID NO: 3799
  Description of Artificial Sequence: Synthetic coding sequence

SEQ ID NO: 4422 - DNA, 309 bp, Artificial Sequence
  Description of Artificial Sequence: Synthetic coding sequence
atgagcgtgatgaagccctgcctgatgaccatcgccatcctgatgatcctggcccagaagacccccggcggcctgttcagaagccacaacggcaagagcagagagccctggaacccctgcgagctgtaccagggcatgtgcagaaacgcctgcagagagtacgagatccagtacctgacctgccccaacgaccagaagtgctgcctgaagctgagcgtgaagatcaccagcagcaagaacgtgaaggaggactacgacagcaacagcaacctgagcgtgaccaacagcagcagctacagccacatctag

SEQ ID NO: 4423 - DNA, 267 bp, Artificial Sequence
  Description of Artificial Sequence: Synthetic coding sequence
atgctgcccgaccacttcagccccctgagcggcgacatcaagctgagcgtgctggccctggtggtgctggtggtgctggcccagaccgcccccgacggctggatcagaagatgctactacggcaccggcagatgcagaaagagctgcaaggagatcgagagaaagaaggagaagtgcggcgagaagcacatctgctgcgtgcccaaggagaaggacaagctgagccacatccacgaccagaaggagaccagcgagctgtacatctag

SEQ ID NO: 4424 - DNA, 1401 bp, Artificial Sequence; identical to SEQ ID NO: 3878
  Description of Artificial Sequence: Synthetic coding sequence

SEQ ID NO: 4425 - DNA, 207 bp, Artificial Sequence
  Description of Artificial Sequence: Synthetic coding sequence
atgaagctgtgcgtgaccgtgctgagcctgctggtgctggtggccgccttctgcagcctggccctgagcgcccccaccaagagcagcgagtggaagctgcagggcgtgtgcttccagtgctgcagcggcaaggaccccatccaccagagctgccccacctggaccatggtgagacagagaaagatgcccaccaccggcaagggctag

SEQ ID NO: 4426 - DNA, 420 bp, Artificial Sequence
  Description of Artificial Sequence: Synthetic coding sequence
atgtacaagctggccagctgctgcctgctgttcatcggcttcctgaaccccctgctgagcctgcccctgctggacagcagagagatcagcttccagctgagcgccccccacgaggacgccagactgacccccgaggagctggagagagccagcctgctgcagatcctgcccgagatgctgggcgccgagagaggcgacatcctgagaaaggccgacagcagcaccaacatcttcaaccccagaggcaacctgagaaagttccaggacttcagcggccaggaccccaacatcctgctgagccacctgctggccagaatctggaagccctacaagaagcagagaagaaagctgagacaggacctgagactgtggaagaaggagcccggcctgagaatcttcaagaactacgtgtacatctag

SEQ ID NO: 4427 - DNA, 1974 bp, Artificial Sequence
  Description of Artificial Sequence: Synthetic coding sequence
atgagaaccgtggtgctgaccatgaaggccagcgtgatcgagatgttcctggtgctgctggtgaccggcgtgcacagcaacaaggagaccgccaagaagatcaagagacccaagttcaccgtgccccagatcaactgcgacgtgaaggccggcaagatcatcgaccccgagttcatcgtgaagtgccccgccggctgccaggaccccaagtaccacgtgtacggcaccgacgtgtacgccagctacagcagcgtgtgcggcgccgccgtgcacagcggcgtgctggacaacagcggcggcaagatcctggtgagaaaggtggccggccagagcggctacaagggcagctacagcaacggcgtgcagagcctgagcctgcccagatggagagagagcttcatcgtgctggagagcaagcccaagaagggcgtgacctaccccagcgccctgacctacagcagcagcaagagccccgccgcccaggccggcgagaccaccaaggcctaccagagaccccccatccccggcaccaccgcccagcccgtgaccctgatgcagctgctggccgtgaccgtggccgtggccacccccaccaccctgcccagacccagccccagcgccgccagcaccaccagcatccccagaccccagagcgtgggccacagaagccaggagatggacctgtggagcaccgccacctacaccagcagccagaacagacccagagccgaccccggcatccagagacaggaccccagcggcgccgccttccagaagcccgtgggcgccgacgtgagcctggactgcaagatcgacctgagcttcctgatcgacggcagcaccagcatcggcaagagaagattcagaatccagaagcagctgctggccgacgtggcccaggccctggacatcggccccgccggccccctgatgggcgtggtgcagtacggcgacaaccccgccacccacttcaacctgaagacccacaccaacagcagagacctgaagaccgccatcgagaagatcacccagagaggcggcctgagcaacgtgggcagagccatcagcttcgtgaccaagaacttcttcagcaaggccaacggcaacagaagcggcgcccccaacgtggtggtggtgatggtggacggctggcccaccgacaaggtggaggaggccagcagactggccagagagagcggcatcaacatcttcttcatcaccatcgagggcgccgccgagaacgagaagcagtacgtggtggagcccaacttcgccaacaaggccgtgtgcagaaccaacggcttctacagcctgcacgtgcagagctggttcggcctgcacaagaccctgcagcccctggtgaagagagtgtgcgacaccgacagactggcctgcagcaagacctgcctgaacagcgccgacatcggcttcgtgatcgacggcagcagcagcgtgggcaccggcaacttcagaaccgtgctgcagttcgtgaccaacctgaccaaggagttcgagatcagcgacaccgacaccagaatcggcgccgtgcagtacacctacgagcagagactggagttcggcttcgacaagtacagcagcaagcccgacatcctgaacgccatcaagagagtgggctactggagcggcggcaccagcaccggcgccgccatcaacttcgccctggagcagctgttcaagaagagcaagcccaacaagagaaagctgatgatcctgatcaccgacggcagaagctacgacgacgtgagaatccccgccatggccgcccacctgaagggcgtgatcacctacgccatcggcgtggcctgggccgcccaggaggagctggaggtgatcgccacccaccccgccagagaccacagcttcttcgtggacgagttcgacaacctgcaccagtacgtgcccagaatcatccagaacatctgcaccgagttcaacagccagcccagaaactag

SEQ ID NO: 4428 - DNA, 3975 bp, Artificial Sequence
  Description of Artificial Sequence: Synthetic coding sequence
atgagacacggcgtggcctgggccctgctggtggccgccgccctgggcctgggcgccagaggcgtgagaggcgccgtggccctggccgacttctaccccttcggcgccgagagaggcgacgccgtgacccccaagcaggacgacggcggcagcggcctgagacccctgagcgtgcccttccccttcttcggcgccgagcacagcggcctgtacgtgaacaacaacggcatcatcagcttcctgaaggaggtgagccagttcacccccgtggccttccccatcgccaaggacagatgcgtggtggccgccttctgggccgacgtggacaacagaagagccggcgacgtgtactacagagaggccaccgaccccgccatgctgagaagagccaccgaggacgtgagacactacttccccgagctgctggacttcaacgccacctgggtgttcgtggccacctggtacagagtgaccttcttcggcggcagcagcagcagccccgtgaacaccttccagaccgtgctgatcaccgacggcaagctgagcttcaccatcttcaactacgagagcatcgtgtggaccaccggcacccacgccagcagcggcggcaacgccaccggcctgggcggcatcgccgcccaggccggcttcaacgccggcgacggccagagatacttcagcatccccggcagcagaaccgccgacatggccgaggtggagaccaccaccaacgtgggcgtgcccggcagatgggccttcagaatcgacgacgcccaggtgagagtgggcggctgcggccacaccaccagcgtgtgcctggccctgagaccctgcctgaacggcggcaagtgcatcgacgactgcgtgaccggcaaccccagctacacctgcagctgcctgagcggcttcaccggcagaagatgccacctggacgtgaacgagtgcgccagccagccctgccagaacggcggcacctgcacccacggcatcaacagcttcagatgccagtgccccgccggcttcggcggccccacctgcgagaccgcccagagcccctgcgacaccaaggagtgccagcacggcggccagtgccaggtggagaacggcagcgccgtgtgcgtgtgccaggccggctacaccggcgccgcctgcgagatggacgtggacgactgcagccccgacccctgcctgaacggcggcagctgcgtggacctggtgggcaactacacctgcctgtgcgccgagcccttcaagggcctgagatgcgagaccggcgaccaccccgtgcccgacgcctgcctgagcgccccctgccacaacggcggcacctgcgtggacgccgaccagggctacgtgtgcgagtgccccgagggcttcatgggcctggactgcagagagagagtgcccgacgactgcgagtgcagaaacggcggcagatgcctgggcgccaacaccaccctgtgccagtgccccctgggcttcttcggcctgctgtgcgagttcgagatcaccgccatgccctgcaacatgaacacccagtgccccgacggcggctactgcatggagcacggcggcagctacctgtgcgtgtgccacaccgaccacaacgccagccacagcctgcccagcccctgcgacagcgacccctgcttcaacggcggcagctgcgacgcccacgacgacagctacacctgcgagtgccccagaggcttccacggcaagcactgcgagaaggccagaccccacctgtgcagcagcggcccctgcagaaacggcggcacctgcaaggaggccggcggcgagtaccactgcagctgcccctacagattcaccggcagacactgcgagatcggcaagcccgacagctgcgccagcggcccctgccacaacggcggcacctgcttccactacatcggcaagtacaagtgcgactgcccccccggcttcagcggcagacactgcgagatcgcccccagcccctgcttcagaagcccctgcgtgaacggcggcacctgcgaggacagagacaccgacttcttctgccactgccaggccggctacatgggcagaagatgccaggccgaggtggactgcggcccccccgaggaggtgaagcacgccaccctgagattcaacggcaccagactgggcgccgtggccctgtacgcctgcgacagaggctacagcctgagcgcccccagcagaatcagagtgtgccagccccacggcgtgtggagcgagcccccccagtgcctggagatcgacgagtgcagaagccagccctgcctgcacggcggcagctgccaggacagagtggccggctacctgtgcctgtgcagcaccggctacgagggcgcccactgcgagctggagagagacgagtgcagagcccacccctgcagaaacggcggcagctgcagaaacctgcccggcgcctacgtgtgcagatgccccgccggcttcgtgggcgtgcactgcgagaccgaggtggacgcctgcgacagcagcccctgccagcacggcggcagatgcgagagcggcggcggcgcctacctgtgcgtgtgccccgagagcttcttcggctaccactgcgagaccgtgagcgacccctgcttcagcagcccctgcggcggcagaggctactgcctggccagcaacggcagccacagctgcacctgcaaggtgggctacaccggcgaggactgcgccaaggagctgttcccccccaccgccctgaagatggagagagtggaggagagcggcgtgagcatcagctggaacccccccaacggccccgccgccagacagatgctggacggctacgccgtgacctacgtgagcagcgacggcagctacagaagaaccgacttcgtggacagaaccagaagcagccaccagctgcaggccctggccgccggcagagcctacaacatcagcgtgttcagcgtgaagagaaacagcaacaacaagaacgacatcagcagacccgccgtgctgctggccagaaccagacccagacccgtggagggcttcgaggtgaccaacgtgaccgccagcaccatcagcgtgcagtgggccctgcacagaatcagacacgccaccgtgagcggcgtgagagtgagcatcagacaccccgaggccctgagagaccaggccaccgacgtggacagaagcgtggacagattcaccttcagagccctgctgcccggcaagagatacaccatccagctgaccaccctgagcggcctgagaggcgaggagcaccccaccgagagcctggccaccgcccccacccacgtgtggaccagacccctgccccccgccaacctgaccgccgccagagtgaccgccaccagcgcccacgtggtgtgggacgcccccacccccggcagcctgctggaggcctacgtgatcaacgtgaccaccagccagagcaccaagagcagatacgtgcccaacggcaagctggccagctacaccgtgagagacctgctgcccggcagaagataccagctgagcgtgatcgccgtgcagagcaccgagctgggcccccagcacagcgagcccgcccacctgtacatcatcaccagccccagagacggcgccgacagaagatggcaccagggcggccaccaccccagagtgctgaagaacagacccccccccgccagactgcccgagctgagactgctgaacgaccacagcgcccccgagacccccacccagccccccagattcagcgagctggtggacggcagaggcagagtgagcgccagattcggcggcagccccagcaaggccgccaccgtgagaagccagcccaccgccagcgcccagctggagaacatggaggaggcccccaagagagtgagcctggccctgcagctgcccgagcacggcagcaaggacatcggcagcgagagcgccgccctggtgggcaccctgggcctgaccgactgcagccagggcccctag

SEQ ID NO: 4429 - DNA, 732 bp, Artificial Sequence
  Description of Artificial Sequence: Synthetic coding sequence
atgggcatcttcctggtgtacgtgggcttcgtgttcttcagcgtgctgtacgtgcagcagggcctgagcagccaggccaagttcaccgagttccccagaaacgtgaccgccaccgagggccagaacgtggagatgagctgcgccttccagagcggcagcgccagcgtgtacctggagatccagtggtggttcctgagaggccccgaggacctggaccccggcgccgagggcgccggcgcccaggtggagctgctgcccgacagagaccccgacagcgacggcaccaagatcagcaccgtgaaggtgcagggcaacgacatcagccacaagctgcagatcagcaaggtgagaaagaaggacgagggcctgtacgagtgcagagtgaccgacgccaactacggcgagctgcaggagcacaaggcccaggcctacctgaaggtgaacgccaacagccacgccagaagaatgcaggccttcgaggccagccccatgtggctgcaggacatgaagcccagaaagaacgtgagcgccgccatccccagcagcatccacggcagcgccaaccagagaacccacagcaccagcagcccccaggtggtggccaagatccccaagcagagcccccagagcggcatggagacccacttcgagcccttcatcctgcccctgaccaacgccccccagaagggccagagctacagagtggacagattcatgaacggcgacttctag

SEQ ID NO: 4430 - DNA, 1218 bp, Artificial Sequence; identical to SEQ ID NO: 3919
  Description of Artificial Sequence: Synthetic coding sequence

SEQ ID NO: 4431 - DNA, 573 bp, Artificial Sequence
  Description of Artificial Sequence: Synthetic coding sequence
atgagaaccgtggtgctgaccatgaaggccagcgtgatcgagatgttcctggtgctgctggtgaccggcgtgcacagcaacaaggagaccgccaagaagatcaagagacccaagttcaccgtgccccagatcaactgcgacgtgaaggccggcaagatcatcgaccccgagttcatcgtgaagtgccccgccggctgccaggaccccaagtaccacgtgtacggcaccgacgtgtacgccagctacagcagcgtgtgcggcgccgccgtgcacagcggcgtgctggacaacagcggcggcaagatcctggtgagaaaggtggccggccagagcggctacaagggcagctacagcaacggcgtgcagagcctgagcctgcccagatggagagagagcttcatcgtgctggagagcaagcccaagaagggcgtgacctaccccagcgccctgacctacagcagcagcaagagccccgccgcccaggccgacctgtggagcaccgccacctacaccagcagccagaacagacccagagccgaccccgtgcagagacagccctgctacagcctgtag

SEQ ID NO: 4432 - DNA, 399 bp, Artificial Sequence
  Description of Artificial Sequence: Synthetic coding sequence
atggcccccagccccagaaccggcagcagacaggacgccaccgccctgcccagcatgagcagcaccttctgggccttcatgatcctggccagcctgctgatcgcctactgcagccagctggccgccggcacctgcgagatcgtgaccctggacagagacagcagccagcccagaagaaccatcgccagacagaccgccagatgcgcctgcagaaagggccagatcgccggcaccaccagagccagacccgcctgcgtggacgccagaatcatcaagaccaagcagtggtgcgacatgctgccctgcctggagggcgagggctgcgacctgctgatcaacagaagcggctggacctgcacccagcccggcggcagaatcaagaccaccaccgtgagctag

SEQ ID NO: 4433 - DNA, 957 bp, Artificial Sequence; identical to SEQ ID NO: 3752
  Description of Artificial Sequence: Synthetic coding sequence

SEQ ID NO: 4434 - DNA, 399 bp, Artificial Sequence
  Description of Artificial Sequence: Synthetic coding sequence
atgctgcccctgaccatgaccgtgctgatcctgctgctgctgcccaccggccaggccgcccccaaggacggcgtgaccagacccgacagcgaggtgcagcaccagctgctgcccaaccccttccagcccggccaggagcagctgggcctgctgcagagctacctgaagggcctgggcagaaccgaggtgcagctggagcacctgagcagagagcaggtgctgctgtacctgttcgccctgcacgactacgaccagagcggccagctggacggcctggagctgctgagcatgctgaccgccgccctggcccccggcgccgccaacagccccaccaccaaccccggcaacctggacgccagactggacggcggcgagaaggccatgcagccccagtggtag

SEQ ID NO: 4435 - DNA, 732 bp, Artificial Sequence
  Description of Artificial Sequence: Synthetic coding sequence
atgctgctgagcctgctgggcgcctgcgccgtggtgggccccttccacggccccgagtgggagcccgtgcagggcctgctgagccagaaccacagctgcagagacccccagtgctgcggcaacctgctggtgctgtgcctgttcctggtgtggcaggtgagacactgctggcaccaggtgaccagaaccagattcagcaccagaaacgtgatcaaggtgcccctgcagaagagagccgtgcccagcatgagatgcgagaccgtgttcaagctgacccccgagttcttcagccccggcaagagcagaggcctggacagccagcagtgcgcccagagacagagatggggctacagaagaagcctgcaggagagctgggcccagaacctgctgagcccccagcacccctgccccggcccccccagcggcgtgcacacccacagcgagcccatcttctgcaccaccagcatcagcaacacctgcctgctgccccagaacagcagctggaaggcctggcaggtgccctggtgcctgcacgacggccagaccagacccgccctggacatgtgccaggagatggagcagctgctgctgcacagccaggagagactggtgagcctggagcccgtgatcagcgtgagaagcagacccaccagcatgaccctgaccaccagcctgcccaacctgctgagcgccgagagactgcagttctgcccccagagagcccccgcctag

SEQ ID NO: 4436 - DNA, 2505 bp, Artificial Sequence; identical to SEQ ID NO: 3768
  Description of Artificial Sequence: Synthetic coding sequence

SEQ ID NO: 4437 - DNA, 1185 bp, Artificial Sequence
  Description of Artificial Sequence: Synthetic coding sequence
atgtggagatgccccctgggcctgctgctgctgctgcccctggccggccacctggccctgggcgcccagcagggcagaggcagaagagagctggcccccggcctgcacctgagaggcatcagagacgccggcggcagatactgccaggagcaggacctgtgctgcagaggcagagccgacgactgcgccctgccctacctgggcgccatctgctactgcgacctgttctgcaacagaaccgtgagcgactgctgccccttcccccccatccagggctgcatgcacggcggcagaatctaccccgtgctgggcacctactgggacaactgcaacagatgcacctgccaggagaacagacagtggcagtgcgaccaggagccctgcctggtggaccccgacatgatcaaggccatcaaccagggcaactacggctggcaggccggcaaccacagcgccttctggggcatgaccctggacgagggcatcagatacagactgggcaccatcagacccagcagcagcgtgatgaacatgcacgagatctacaccgtgctgaaccccggcgaggtgctgcccaccgccttcgaggccagcgagaagtggcccaacctgatccacgagcccctggaccagggcaactgcgccggcagctgggccttcagcaccgccgccgtggccagcgacagagtgagcatccacagcctgggccacatgacccccgtgctgagcccccagaacctgctgagctgcgacacccaccagcagcagggctgcagaggcggcagactggacggcgcctggtggttcctgagaagaagaggcgtggtgagcgaccactgctaccccttcagcggcagagagagagacgaggccggccccgcccccccctgcatgatgcacagcagagccatgggcagaggcaagagacaggccaccgcccactgccccaacagctacgtgaacaacaacgacatctaccaggtgacccccgtgtacagactgggcagcaacgacaaggagatcatgaaggagctgatggagaacggccccgtgcaggccctgatggaggtgcacgaggacttcttcctgtacaagggcggcatctacagccacacccccgtgagcctgggcagacccgagagatacagaagacacggcacccacagcgtgaagatcaccggctag

SEQ ID NO: 4438 - DNA, 303 bp, Artificial Sequence
  Description of Artificial Sequence: Synthetic coding sequence
atggccgccgccctggccctggtggccggcgtgctgagcggcgccgtgctgcccctgtggagcgccctgccccagtacaagaagaagatcaccgacagatgcttccaccacagcgagtgctacagcggctgctgcctgatggacctggacagcggcggcgccttctgcgcccccagagccagaatcaccatgatctgcctgccccagaccaagggcgccaccaacatcatctgcccctgcagaatgggcctgacctgcatcagcaaggacctgatgtgcagcagaagatgccacatgatctag

SEQ ID NO: 4439 - DNA, 978 bp, Artificial Sequence
  Description of Artificial Sequence: Synthetic coding sequence
atgagactgcccagaagagccgccctgggcctgctgcccctgctgctgctgctgccccccgcccccgaggccgccaagaagcccaccccctgccacagatgcagaggcctggtggacaagttcaaccagggcatggtggacaccgccaagaagaacttcggcggcggcaacaccgcctgggaggagaagaccctgagcaagtacgagagcagcgagatcagactgctggagatcctggagggcctgtgcgagagcagcgacttcgagtgcaaccagatgctggaggcccaggaggagcacctggaggcctggtggctgcagctgaagagcgagtaccccgacctgttcgagtggttctgcgtgaagaccctgaaggtgtgctgcagccccggcacctacggccccgactgcctggcctgccagggcggcagccagagaccctgcagcggcaacggccactgcagcggcgacggcagcagacagggcgacggcagctgcagatgccacatgggctaccagggccccctgtgcaccgactgcatggacggctacttcagcagcctgagaaacgagacccacagcatctgcaccgcctgcgacgagagctgcaagacctgcagcggcctgaccaacagagactgcggcgagtgcgaggtgggctgggtgctggacgagggcgcctgcgtggagtgcgacagcagctgcgtgggctgcaccggcgagggccccggcaactgcaaggagtgcatcagcggctacgccagagagcacggccagtgcgccgacgtggacgagtgcagcctggccgagaagacctgcgtgagaaagaacgagaactgctacaacacccccggcagctacgtgtgcgtgtgccccgacggcttcgaggagaccgaggacgcctgcgtgccccccgccgaggccgaggccaccgagggcgagagccccacccagctgcccagcagagaggacctgtag

SEQ ID NO: 4440 - DNA, 459 bp, Artificial Sequence
  Description of Artificial Sequence: Synthetic coding sequence
atgagaggccccggccaccccctgctgctgggcctgctgctggtgctgggcgccgccggcagaggcagaggcggcgccgagcccagagagcccgccgacggccaggccctgctgagactggtggtggagctggtgcaggagctgagaaagcaccacagcgccgagcacaagggcctgcagctgctgggcagagactgcgccctgggcagagccgaggccgccggcctgggccccagccccgagcagagagtggagatcgtgcccagagacctgagaatgaaggacaagttcctgaagcacctgaccggccccctgtacttcagccccaagtgcagcaagcacttccacagactgtaccacaacaccagagactgcaccatccccgcctactacaagagatgcgccagactgctgaccagactggccgtgagccccgtgtgcatggaggacaagcagtag

SEQ ID NO: 4441 - DNA, 411 bp, Artificial Sequence; identical to SEQ ID NO: 3832
  Description of Artificial Sequence: Synthetic coding sequence

SEQ ID NO: 4442 - DNA, 1209 bp, Artificial Sequence
  Description of Artificial Sequence: Synthetic coding sequence
atgagactgcccagaagagccgccctgggcctgctgcccctgctgctgctgctgccccccgcccccgaggccgccaagaagcccaccccctgccacagatgcagaggcctggtggacaagttcaaccagggcatggtggacaccgccaagaagaacttcggcggcggcaacaccgcctgggaggagaagaccctgagcaagtacgagagcagcgagatcagactgctggagatcctggagggcctgtgcgagagcagcgacttcgagtgcaaccagatgctggaggcccaggaggagcacctggaggcctggtggctgcagctgaagagcgagtaccccgacctgttcgagtggttctgcgtgaagaccctgaaggtgtgctgcagccccggcacctacggccccgactgcctggcctgccagggcggcagccagagaccctgcagcggcaacggccactgcagcggcgacggcagcagacagggcgacggcagctgcagatgccacatgggctaccagggccccctgtgcaccgactgcatggacggctacttcagcagcctgagaaacgagacccacagcatctgcaccgtgagaaccggcctgagcgacagctaccccccctgctgcctgagcctgggctgctggagaggcgtgggccacgcctggatcagaggcagaaacacccacacccagcccggctacagcagcagagtgtggatcgccgccttcagccccgcctgcgacgagagctgcaagacctgcagcggcctgaccaacagagactgcggcgagtgcgaggtgggctgggtgctggacgagggcgcctgcgtggacgtggacgagtgcgccgccgagccccccccctgcagcgccgcccagttctgcaagaacgccaacggcagctacacctgcgaggagtgcgacagcagctgcgtgggctgcaccggcgagggccccggcaactgcaaggagtgcatcagcggctacgccagagagcacggccagtgcgccgacgtggacgagtgcagcctggccgagaagacctgcgtgagaaagaacgagaactgctacaacacccccggcagctacgtgtgcgtgtgccccgacggcttcgaggagaccgaggacgcctgcgtgccccccgccgaggccgaggccaccgagggcgagagccccacccagctgcccagcagagaggacctgtag

SEQ ID NO: 4443 - DNA, 633 bp, Artificial Sequence
  Description of Artificial Sequence: Synthetic coding sequence
atgagcgccggcaagatgatgagaaccctgatcaccacccaccccctgcccctgctgctgctgccccagcagctgctgcagctggtgcagttccaggaggtggacaccgacttcgacttccccgaggaggacaagaaggaggagttcgaggagtgcctggagaagttcttcagcaccggccccgccagaccccccaccaaggagaaggtgaagagaagagtgctgatcgagcccggcatgcccctgaaccacatcgagtactgcaaccacgagatcatgggcaagaacgtgtactacaagcacagatgggtggccgagcactacttcctgctgatgcagtacgacgagctgcagaagatctgctacaacagattcgtgccctgcaagaacggcatcagaaagtgcaacagaagcaagggcctggtggagggcgtgtactgcaacctgaccgaggccttcgagatccccgcctgcaagtacgagagcctgtacagaaagggctacgtgctgatcacctgcagctggcagaacgagatgcagaagagaatcccccacaccatcaacgacctggtggagccccccgagcacagaagcttcctgagcgaggacggcgtgttcgtgatcagcccctag

SEQ ID NO: 4444 - DNA, 585 bp, Artificial Sequence; identical to SEQ ID NO: 3585
  Description of Artificial Sequence: Synthetic coding sequence

SEQ ID NO: 4445 - DNA, 4059 bp, Artificial Sequence
  Description of Artificial Sequence: Synthetic coding sequence
atgagacacggcgtggcctgggccctgctggtggccgccgccctgggcctgggcgccagaggcgtgagaggcgccgtggccctggccgacttctaccccttcggcgccgagagaggcgacgccgtgacccccaagcaggacgacggcggcagcggcctgagacccctgagcgtgcccttccccttcttcggcgccgagcacagcggcctgtacgtgaacaacaacggcatcatcagcttcctgaaggaggtgagccagttcacccccgtggccttccccatcgccaaggacagatgcgtggtggccgccttctgggccgacgtggacaacagaagagccggcgacgtgtactacagagaggccaccgaccccgccatgctgagaagagccaccgaggacgtgagacactacttccccgagctgctggacttcaacgccacctgggtgttcgtggccacctggtacagagtgaccttcttcggcggcagcagcagcagccccgtgaacaccttccagaccgtgctgatcaccgacggcaagctgagcttcaccatcttcaactacgagagcatcgtgtggaccaccggcacccacgccagcagcggcggcaacgccaccggcctgggcggcatcgccgcccaggccggcttcaacgccggcgacggccagagatacttcagcatccccggcagcagaaccgccgacatggccgaggtggagaccaccaccaacgtgggcgtgcccggcagatgggccttcagaatcgacgacgcccaggtgagagtgggcggctgcggccacaccaccagcgtgtgcctggccctgagaccctgcctgaacggcggcaagtgcatcgacgactgcgtgaccggcaaccccagctacacctgcagctgcctgagcggcttcaccggcagaagatgccacctggacgtgaacgagtgcgccagccagccctgccagaacggcggcacctgcacccacggcatcaacagcttcagatgccagtgccccgccggcttcggcggccccacctgcgagaccgcccagagcccctgcgacaccaaggagtgccagcacggcggccagtgccaggtggagaacggcagcgccgtgtgcgtgtgccaggccggctacaccggcgccgcctgcgagatggacgtggacgactgcagccccgacccctgcctgaacggcggcagctgcgtggacctggtgggcaactacacctgcctgtgcgccgagcccttcaagggcctgagatgcgagaccggcgaccaccccgtgcccgacgcctgcctgagcgccccctgccacaacggcggcacctgcgtggacgccgaccagggctacgtgtgcgagtgccccgagggcttcatgggcctggactgcagagagagagtgcccgacgactgcgagtgcagaaacggcggcagatgcctgggcgccaacaccaccctgtgccagtgccccctgggcttcttcggcctgctgtgcgagttcgagatcaccgccatgccctgcaacatgaacacccagtgccccgacggcggctactgcatggagcacggcggcagctacctgtgcgtgtgccacaccgaccacaacgccagccacagcctgcccagcccctgcgacagcgacccctgcttcaacggcggcagctgcgacgcccacgacgacagctacacctgcgagtgccccagaggcttccacggcaagcactgcgagaaggccagaccccacctgtgcagcagcggcccctgcagaaacggcggcacctgcaaggaggccggcggcgagtaccactgcagctgcccctacagattcaccggcagacactgcgagatcggcaagcccgacagctgcgccagcggcccctgccacaacggcggcacctgcttccactacatcggcaagtacaagtgcgactgcccccccggcttcagcggcagacactgcgagatcgcccccagcccctgcttcagaagcccctgcgtgaacggcggcacctgcgaggacagagacaccgacttcttctgccactgccaggccggctacatgggcagaagatgccaggccgaggtggactgcggcccccccgaggaggtgaagcacgccaccctgagattcaacggcaccagactgggcgccgtggccctgtacgcctgcgacagaggctacagcctgagcgcccccagcagaatcagagtgtgccagccccacggcgtgtggagcgagcccccccagtgcctggagatcgacgagtgcagaagccagccctgcctgcacggcggcagctgccaggacagagtggccggctacctgtgcctgtgcagcaccggctacgagggcgcccactgcgagctggagagagacgagtgcagagcccacccctgcagaaacggcggcagctgcagaaacctgcccggcgcctacgtgtgcagatgccccgccggcttcgtgggcgtgcactgcgagaccgaggtggacgcctgcgacagcagcccctgccagcacggcggcagatgcgagagcggcggcggcgcctacctgtgcgtgtgccccgagagcttcttcggctaccactgcgagaccgtgagcgacccctgcttcagcagcccctgcggcggcagaggctactgcctggccagcaacggcagccacagctgcacctgcaaggtgggctacaccggcgaggactgcgccaaggagctgttcccccccaccgccctgaagatggagagagtggaggagagcggcgtgagcatcagctggaacccccccaacggccccgccgccagacagatgctggacggctacgccgtgacctacgtgagcagcgacggcagctacagaagaaccgacttcgtggacagaaccagaagcagccaccagctgcaggccctggccgccggcagagcctacaacatcagcgtgttcagcgtgaagagaaacagcaacaacaagaacgacatcagcagacccgccgtgctgctggccagaaccagacccagacccgtggagggcttcgaggtgaccaacgtgaccgccagcaccatcagcgtgcagtgggccctgcacagaatcagacacgccaccgtgagcggcgtgagagtgagcatcagacaccccgaggccctgagagaccaggccaccgacgtggacagaagcgtggacagattcaccttcagagccctgctgcccggcaagagatacaccatccagctgaccaccctgagcggcctgagaggcgaggagcaccccaccgagagcctggccaccgcccccacccacgtgtggaccagacccctgccccccgccaacctgaccgccgccagagtgaccgccaccagcgcccacgtggtgtgggacgcccccacccccggcagcctgctggaggcctacgtgatcaacgtgaccaccagccagagcaccaagagcagatacgtgcccaacggcaagctggccagctacaccgtgagagacctgctgcccggcagaagataccagctgagcgtgatcgccgtgcagagcaccgagctgggcccccagcacagcgagcccgcccacctgtacatcatcaccagccccagagacggcgccgacagaagatggcaccagggcggccaccaccccagagtgctgaagaacagacccccccccgccagactgcccgagctgagactgctgaacgaccacagcgcccccgagacccccacccagccccccagattcagcgagctggtggacggcagaggcagagtgagcgccagattcggcggcagccccagcaaggccgccaccgtgagaagccacgtgcccggcaactgcagcgagaacccctgccagaacggcggcacctgcgtgcccggcgccgacgcccacagctgcgactgcggccccggcttcaagggcagaagatgcgagctggcctgcatcaaggtgagcagaccctgcaccagactgttcagcgagaccaaggccttccccgtgtgggagggcggcgtgtgccaccacgtgaagcagagcaagagccagaccctggagaagagctag

SEQ ID NO: 4446 - DNA, 957 bp, Artificial Sequence; identical to SEQ ID NO: 3752
  Description of Artificial Sequence: Synthetic coding sequence

SEQ ID NO: 4447 - DNA, 816 bp, Artificial Sequence
  Description of Artificial Sequence: Synthetic coding sequence
atgcaggccgcctgctggtacgtgctgttcctgctgcagcccaccgtgtacctggtgacctgcgccaacctgaccaacggcggcaagagcgagctgctgaagagcggcagcagcaagagcaccctgaagcacatctggaccgagagcagcaaggacctgagcatcagcagactgctgagccagaccttcagaggcaaggagaacgacaccgacctggacctgagatacgacacccccgagccctacagcgagcaggacctgtgggactggctgagaaacagcaccgacctgcaggagcccagacccagagccaagagaagacccatcgtgaagaccggcaagttcaagaagatgttcggctggggcgacttccacagcaacatcaagaccgtgaagctgaacctgctgatcaccggcaagatcgtggaccacggcaacggcaccttcagcgtgtacttcagacacaacagcaccggccagggcaacgtgagcgtgagcctggtgccccccaccaagatcgtggagttcgacctggcccagcagaccgtgatcgacgccaaggacagcaagagcttcaactgcagaatcgagtacgagaaggtggacaaggccaccaagaacaccctgtgcaactacgaccccagcaagacctgctaccaggagcagacccagagccacgtgagctggctgtgcagcaagcccttcaaggtgatctgcatctacatcagcttctacagcaccgactacaagctggtgcagaaggtgtgccccgactacaactaccacagcgacaccccctacttccccagcggctag

SEQ ID NO: 4448 - DNA, 999 bp, Artificial Sequence
  Description of Artificial Sequence: Synthetic coding sequence
atgctgctgctggccgccgccttcctggtggccttcgtgctgctgctgtacatggtgagccccctgatcagccccaagcccctggccctgcccggcgcccacgtggtggtgaccggcggcagcagcggcatcggcaagtgcatcgccatcgagtgctacaagcagggcgccttcatcaccctggtggccagaaacgaggacaagctgctgcaggccaagaaggagatcgagatgcacagcatcaacgacaagcaggtggtgctgtgcatcagcgtggacgtgagccaggactacaaccaggtggagaacgtgatcaagcaggcccaggagaagctgggccccgtggacatgctggtgaactgcgccggcatggccgtgagcggcaagttcgaggacctggaggtgagcaccttcgagagactgatgagcatcaactacctgggcagcgtgtaccccagcagagccgtgatcaccaccatgaaggagagaagagtgggcagaatcgtgttcgtgagcagccaggccggccagctgggcctgttcggcttcaccgcctacagcgccagcaagttcgccatcagaggcctggccgaggccctgcagatggaggtgaagccctacaacgtgtacatcaccgtggcctacccccccgacaccgacacccccggcttcgccgaggagaacagaaccaagcccctggagaccagactgatcagcgagaccaccagcgtgtgcaagcccgagcaggtggccaagcagatcgtgaaggacgccatccagggcaacttcaacagcagcctgggcagcgacggctacatgctgagcgccctgacctgcggcatggcccccgtgaccagcatcaccgagggcctgcagcaggtggtgaccatgggcctgttcagaaccatcgccctgttctacctgggcagcttcgacagcatcgtgagaagatgcatgatgcagagagagaagagcgagaacgccgacaagaccgcctag

SEQ ID NO: 4449 - DNA, 1497 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgccctgggcctggccagagccaacaacgagctgctgaagagactgcaggaggaggtgggcgacctgagacagggcaaggtgagcatccccgacgaggacggcgagagcagagcccacagcagcccccccgaggagcccggccccctgaaggagagccccggcgaggccttcaaggccctgagcgccgtggaggaggagtgcgacagcgtgggcagcggcgtgcaggtggtgatcgaggagctgagacagctgggcgccgccagcgtgggccccggccccctgggcttccccgccacccagagagacatgagactgcccggctgcaccctggccgccagcgaggccgcccccctgctgaaccccctggtggacgactacgtggccagcgagggcgccgtgcagagagtgctggtgcccgcctacgccaagcagctgagccccgccacccagctggccatccagagagccacccccgagaccggccccgagaacggcaccaagctgcccccccccagacccgaggacatgctgaacgccgccgccgccctggacagcgccctggaggagagcggccccggcagcaccggcgagctgagacacagcctgggcctgaccgtgagcccctgcagaaccagaggcagcggccagaagaacagcagaagaaagagagacctggtgctgagcaagctggtgcacaacgtgcacaaccacatcaccaacgacaagagattcaacggcagcgagagcatcaagagcagctggaacatcagcgtggtgaagttcctgctggagaagctgaagcaggagctggtgaccagcccccacaactacaccgacaaggagctgaagggcgcctgcgtggcctacttcctgaccaagagaagagagtacagaaacagcctgaaccccttcaagggcctgaaggagaaggaggagaagaagctgagaagcagaagatacagactgttcgccaacagaagcagcatcatgagacacttcggccccgaggaccagagactgtggaacgacgtgaccgaggagctgatgagcgacgaggaggacagcctgaacgagcccgacagactgcccagcgccgaggcccagctgctgccccccgagctgtacaaccccaacttccaggaggaggaggacgagggcggcgacgagaacgcccccggcagccccagcttcgaccagccccacaagacctgctgccccgacctgaacagcttcatcgagatcaaggtggagaaggacgagtag

SEQ ID NO: 4450 - DNA, 966 bp, Artificial Sequence
  Description of Artificial Sequence: Synthetic coding sequence
atgagactgcccagaagagccgccctgggcctgctgcccctgctgctgctgctgccccccgcccccgaggccgccaagaagcccaccccctgccacagatgcagaggcctggtggacaagttcaaccagggcatggtggacaccgccaagaagaacttcggcggcggcaacaccgcctgggaggagaagaccctgagcaagtacgagagcagcgagatcagactgctggagatcctggagggcctgtgcgagagcagcgacttcgagtgcaaccagatgctggaggcccaggaggagcacctggaggcctggtggctgcagctgaagagcgagtaccccgacctgttcgagtggttctgcgtgaagaccctgaaggtgtgctgcagccccggcacctacggccccgactgcctggcctgccagggcggcagccagagaccctgcagcggcaacggccactgcagcggcgacggcagcagacagggcgacggcagctgcagatgccacatgggctaccagggccccctgtgcaccgactgcatggacggctacttcagcagcctgagaaacgagacccacagcatctgcaccgcctgcgacgagagctgcaagacctgcagcggcctgaccaacagagactgcggcgagtgcgaggtgggctgggtgctggacgagggcgcctgcgtggacgtggacgagtgcgccgccgagccccccccctgcagcgccgcccagttctgcaagaacgccaacggcagctacacctgcgaggacgtggacgagtgcagcctggccgagaagacctgcgtgagaaagaacgagaactgctacaacacccccggcagctacgtgtgcgtgtgccccgacggcttcgaggagaccgaggacgcctgcgtgccccccgccgaggccgaggccaccgagggcgagagccccacccagctgcccagcagagaggacctgtag

SEQ ID NO: 4451 - DNA, 711 bp, Artificial Sequence
  Description of Artificial Sequence: Synthetic coding sequence
atgatgggcatcttcctggtgtacgtgggcttcgtgttcttcagcgtgctgtacgtgcagcagggcctgagcagccaggccaagttcaccgagttccccagaaacgtgaccgccaccgagggccagaacgtggagatgagctgcgccttccagagcggcagcgccagcgtgtacctggagatccagtggtggttcctgagaggccccgaggacctggaccccggcgccgagggcgccggcgcccaggtggagctgctgcccgacagagaccccgacagcgacggcaccaagatcagcaccgtgaaggtgcagggcaacgacatcagccacaagctgcagatcagcaaggtgagaaagaaggacgagggcctgtacgagtgcagagtgaccgacgccaactacggcgagctgcaggagcacaaggcccaggcctacctgaaggtgaacgccaacagccacgccagaagaatgcaggccttcgaggccagccccatgtggctgcaggacatgaagcccagaaagaacgtgagcgccgccatccccagcagcatccacggcagcgccaaccagagaacccacagcaccagcagcccccaggtggtggccaagatccccaagcagagcccccagagcggcgccagaatcgccaccagccacggcctgagcgtgctgctgctggtgtgcggcttcgtgaagggcgccctgctgtag

SEQ ID NO: 4452 - DNA, 273 bp, Artificial Sequence
  Description of Artificial Sequence: Synthetic coding sequence
atgaacatgaagcccgccaccgccagcgccctgctgctgctgctgctgggcctggcctggacccagggcagccacggctggggcgccgacgccagcagcctgcagaagagagccggcagagacgaccagaactacaactacaaccagcacgcctaccccaccgcctacggcggcaagtacagcgtgaagacccccgccaagggcggcgtgagccccagcagcagcgccagcagagtgcagcccggcctgctgcagtgggtgaagttctggtag

SEQ ID NO: 4453 - DNA, 360 bp, Artificial Sequence
  Description of Artificial Sequence: Synthetic coding sequence
atgcccgccgtgttcatgctggccagcagcagcgccctgcagtgcggcagaggcgtgcccagattccccagaaccgaggtgggcgccggccacagcgtgaacgaggagaccaaggccgagaaggtgggcaaccagaccagcgtgatccccgccaccagcagacaggccgccctgggcaccagctggacccagagaagaacccagcccctgcaggagagaagccactggcaccccagaggcaacaacgccagcggcatgggcggccacagaatgttccccggccccctgagaggccccgccgcccaggtgctggagaacgagtgcggcagcctgggcagagccgccgagggcagaagctag

SEQ ID NO: 4454 - DNA, 639 bp, Artificial Sequence; identical to SEQ ID NO: 3841
  Description of Artificial Sequence: Synthetic coding sequence

SEQ ID NO: 4455 - DNA, 387 bp, Artificial Sequence
  Description of Artificial Sequence: Synthetic coding sequence
atgagagtggccagaagaaccagaaacgtgtgcagatgccccagagccgccggccccggcgtgcccgagcccagagccgcccccctgcccctgctggccatggcccccccccccgcctgcagaagccccatgagccccccccccccccccctgctgctgctgctgctgagcctggccctgctgggcgccagagccagagccgagcccgccggcagcgccgtgcccgcccagagcagaccctgcgtggactgccacgccttcgagttcatgcagagagccctgcaggacctgagaaagaccgcctgcagcctggacgccagaaccgagaccctgctgctgcaggccgagagaagagccctgtgcgcctgctggcccgccggccactag

SEQ ID NO: 4456 - DNA, 399 bp, Artificial Sequence
  Description of Artificial Sequence: Synthetic coding sequence
atgggccccagagtgctgcagccccccctgctgctgctgctgctggccctgctgctggccgccctgccctgcggcgccgaggaggccagccccctgagacccgcccaggtgaccctgagccccccccccgccgtgaccaacggcagccagcccggcgccccccacaacagcacccacaccagaccccccggcgccagcggcagcgccctgaccagaagcttctacgtgatcctgggcttctgcggcctgaccgccctgtacttcctgatcagagccttcagactgaagaagccccagagaagaagatacggcctgctggccaacaccgaggaccccaccgagatggccagcctggacagcgacgaggagaccgtgttcgagagcagaaacctgagatag

SEQ ID NO: 4457 - DNA, 585 bp, Artificial Sequence; identical to SEQ ID NO: 3737
  Description of Artificial Sequence: Synthetic coding sequence

SEQ ID NO: 4458 - DNA, 441 bp, Artificial Sequence
  Description of Artificial Sequence: Synthetic coding sequence
atggtgatcaccatctactacgacgtgaaggtgagattcatcgtgagaggctgcggccagtacatcagctacagatgccaggagaagagaaacacctacttcgccgagtactggtaccaggcccagtgctgccagtacgactactgcaacagctggagcagcccccagctgcagagcagcctgcccgagccccacgacagacccctggccctgcccctgagcgacagccagatccagtggttctaccaggccctgaacctgagcctgcccctgcccaacttccacgccggcaccgagcccgacggcctggaccccatggtgaccctgagcctgaacctgggcctgagcttcgccgagctgagaagaatgtacctgttcctgaacagcagcggcctgctggtgctgccccaggccggcctgctgaccccccaccccagctag

SEQ ID NO: 4459 - DNA, 234 bp, Artificial Sequence
  Description of Artificial Sequence: Synthetic coding sequence
atgggcagcagcggcctgctgagcctgctggtgctgttcgtgctgctggccaacgtgcagggccccggcctgaccgactggctgttccccagaagatgccccaagatcagagaggagtgcgagttccaggagagagacgtgtgcaccaaggacagacagtgccaggacaacaagaagtgctgcgtgttcagctgcggcaagaagtgcctggacctgaagcagggcaagcagtag

SEQ ID NO: 4460 - DNA, 444 bp, Artificial Sequence
  Description of Artificial Sequence: Synthetic coding sequence
atgggccaggaggtgcacggcagctgctgggccctgggcgccggcggcggccagagacagtgggtgggcagaagcatgccccccctggccccccagctgtgcagagccgtgttcctggtgcccatcctgctgctgctgcaggtgaagcccctgaacggcagccccggccccaaggacggcagccagaccgagaagacccccagcgccgaccagaaccaggagcagttcgaggagcacttcgtggccagcagcgtgggcgagatgtggcaggtggtggacatggcccagcaggaggaggaccagagcagcaagaccgccgccgtgcacaagcacagcttccacctgagcttctgcttcagcctggccagcgtgatggtgttcagcggcggccccctgagaagaaccttccccaacatccagctgtgcttcatgctgacccactag

SEQ ID NO: 4461 - DNA, 1695 bp, Artificial Sequence; identical to SEQ ID NO: 3963
  Description of Artificial Sequence: Synthetic coding sequence

SEQ ID NO: 4462 - DNA, 423 bp, Artificial Sequence; identical to SEQ ID NO: 3735
  Description of Artificial Sequence: Synthetic coding sequence

SEQ ID NO: 4463 - DNA, 528 bp, Artificial Sequence; identical to SEQ ID NO: 3724
  Description of Artificial Sequence: Synthetic coding sequence

SEQ ID NO: 4464 - DNA, 381 bp, Artificial Sequence; identical to SEQ ID NO: 3676
  Description of Artificial Sequence: Synthetic coding sequence

SEQ ID NO: 4465 - DNA, 288 bp, Artificial Sequence
  Description of Artificial Sequence: Synthetic coding sequence
atggcccccccccccgcctgcagaagccccatgagccccccccccccccccctgctgctgctgctgctgagcctggccctgctgggcgccagagccagagccgagcccgccggcagcgccgtgcccgcccagagcagaccctgcgtggactgccacgccttcgagttcatgcagagagccctgcaggacctgagaaagaccgcctgcagcctggacgccagaaccgagaccctgctgctgcaggccgagagaagagccctgtgcgcctgctggcccgccggccactag

SEQ ID NO: 4466 - DNA, 423 bp, Artificial Sequence; identical to SEQ ID NO: 3735
  Description of Artificial Sequence: Synthetic coding sequence

SEQ ID NO: 4467 - DNA, 291 bp, Artificial Sequence; identical to SEQ ID NO: 3992
  Description of Artificial Sequence: Synthetic coding sequence

SEQ ID NO: 4468 - DNA, 678 bp, Artificial Sequence
  Description of Artificial Sequence: Synthetic coding sequence
tgagccgacctgcccagctgctggggcgccggcccctgctacaccggccacaaggtgggcgccctgagaagagacaccgtgatctgctgctgcagacacggcgactacagcaccccctgcctgttcacccccggcaagcccagcagaaaccccagcccctggaagagaaccctgtggaccctgagcgccccctgggccggccccgccggctggaccggcgaggagcagaacgccaccaagaccggcctgatcaccagaagacccagacccctgagaagaagaccccaccccgcccccgccagccccctgcccgagatcatcagaggcaacatccccagaatgctgggcaagttcgtgcccgtgaactgggagcccccccagcccctgcccttccccaagtacctgagatgctacagatgcctgctggagaccaaggagctgggctgcctgctgggcagcgacatctgcctgacccccgccggcagcagctgcatcaccctgcacaagaagaacagcagcggcagcgacgtgatggtgagcgactgcagaagcaaggagcagatgagcgactgcagcaacaccagaaccagccccgtgagcggcttctggatcttcagccagtactgcttcctggacttctgcaacgacccccagaacagaggcctgtacaccccctag

SEQ ID NO: 4469 - DNA, 684 bp, Artificial Sequence
  Description of Artificial Sequence: Synthetic coding sequence
atgggcgccgtgatgggcaccttcagcagcctgcagaccaagcagagaagacccagcaaggacatcgcctggtggtactaccagtaccagagagacaagatcgaggacgagctggagatgaccatggtgtgccacagacccgagggcctggagcagctggaggcccagaccaacttcaccaagagagagctgcaggtgctgtacagaggcttcaagaacgagtgccccagcggcgtggtgaacgaggacaccttcaagcagatctacgcccagttcttcccccacggcgacgccagcacctacgcccactacctgttcaacgccttcgacaccacccagaccggcagcgtgaagttcgaggacttcgtgaccgccctgagcatcctgctgagaggcaccgtgcacgagaagctgagatggaccttcaacctgtacgacatcaacaaggacggctacatcaacaaggaggagatgatggacatcgtgaaggccatctacgacatgatgggcaagtacacctaccccgtgctgaaggaggacacccccagacagcacgtggacgtgttcttccagaagatggacaagaacaaggacggcatcgtgaccctggacgagttcctggagagctgccaggaggacgacaacatcatgagaagcctgcagctgttccagaacgtgatgtag

SEQ ID NO: 4470 - DNA, 546 bp, Artificial Sequence
  Description of Artificial Sequence: Synthetic coding sequence
atgcaggtgaacttcgtgagctacgtgcagctgaccagcagagccctgcccagcctgaccgacagcaagggcagcctggtggtggtgagcagcctgctgggcagagtgcccaccagcttcagcaccccctacagcgccgccaagttcgccctggacggcttcttcggcagcctgagaagagagctggacgtgcaggacgtgaacgtggccatcaccatgtgcgtgctgggcctgagagacagagccagcgccgccgaggccgtgagaagcagcaccagcagacccagacagcccgagcacagaggcgtgcccctgcagagccagaccgccatgttcctgccccccaccgtgcccggcgccagaaccctgaccgagacccccctgagaggctggccccagcccaagatgaagagcagcagacagaagagcaagaccgagaagaacgacggccacctggagcccgtgaccgcctgggaggtgcaggtgcccagagtgagaagactgtgcagaggcctggccagaccccacctgttcggccacgactag

SEQ ID NO: 4471 - DNA, 423 bp, Artificial Sequence
  Description of Artificial Sequence: Synthetic coding sequence
atgagcgacctgctgctgctgggcctgatcggcggcctgaccctgctgctgctgctgaccctgctggccttcgccggctacagcggcctgctggccggcgtggaggtgagcgccggcagcccccccatcagaaacgtgaccgtggcctacaagttccacatgggcctgtacggcgagaccggcagactgttcaccgagagctgcagcatcagccccaagctgagaagcatcgccgtgtactacgacaacccccacatggtgccccccgacaagtgcagatgcgccgtgggcagcatcctgagcgagggcgaggagagccccagccccgagctgatcgacctgtaccagaagttcggcttcaaggtgttcagcttccccgcccccagccacgtggtgaccgccaccttcccctacaccacctag

SEQ ID NO: 4472 - DNA, 177 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgcctag

SEQ ID NO: 4473 - DNA, 2742 bp, Artificial Sequence; identical to SEQ ID NO: 3799
  Description of Artificial Sequence: Synthetic coding sequence

SEQ ID NO: 4474 - DNA, 1146 bp, Artificial Sequence
  Description of Artificial Sequence: Synthetic coding sequence
atgagactgctggcctggctgatcttcctggccaactggggcggcgccagagccgagcccggcaagttctggcacatcgccgacctgcacctggaccccgactacaaggtgagcaaggaccccttccaggtgtgccccagcgccggcagccagcccgtgcccgacgccggcccctggggcgactacctgtgcgacagcccctgggccctgatcaacagcagcatctacgccatgaaggagatcgagcccgagcccgacttcatcctgtggaccggcgacgacaccccccacgtgcccgacgagaagctgggcgaggccgccgtgctggagatcgtggagagactgaccaagctgatcagagaggtgttccccggcgccttctactgcgagaagctgcccggccccagcggcgccggcagaatcgtggtgctgaacaccaacctgtactacaccagcaacgccctgaccgccgacatggccgaccccggccagcagttccagtggctggaggacgtgctgaccgacgccagcaaggccggcgacatggtgtacatcgtgggccacgtgccccccggcttcttcgagaagacccagaacaaggcctggttcagagagggcttcaacgagaagtacctgaaggtggtgagaaagcaccacagagtgatcgccggccagttcttcggccaccaccacaccgacagcttcagaatgctgtacgacgacgccggcgtgcccatcagcgccatgttcatcacccccggcgtgaccccctggaagaccaccctgcccggcgtggtgaacggcgccaacaaccccgccatcagagtgttcgagtacgacagagccaccctgagcctgaaggacatggtgacctacttcatgaacctgagccaggccaacgcccagggcacccccagatgggagctggagtaccagagcaccctgcagagatactacgtgtacaacagcgtgagctacagcgccggcgtgtgcgacgaggcctgcagcatgcagcacgtgtgcgccatgagacaggtggacatcgacgcctacaccacctgcctgtacgccagcggcaccacccccgtgccccagctgcccctgctgctgatggccctgctgggcctgtgcaccctggtgctgtag

SEQ ID NO: 4475 - DNA, 456 bp, Artificial Sequence
  Description of Artificial Sequence: Synthetic coding sequence
atgagagtggccggcgccgccaagctggtggtggccgtggccgtgttcctgctgaccttctacgtgatcagccaggtgttcgagatcaagatggacgccagcctgggcaacctgttcgccagaagcgccctggacaccgccgccagaagcaccaagccccccagatacaagtgcggcatcagcaaggcctgccccgagaagcacttcgccttcaagatggccagcggcgccgccaacgtggtgggccccaagatctgcctggaggacaacgtgctgatgagcggcgtgaagaacaacgtgggcagaggcatcaacgtggccctggccaacggcaagaccggcgaggtgctggacaccaagtacttcgacatgtggggcggcgacgtggcccccttcatcgagttcctgaaggccatccaggacggcaccatcgtgctgatgggcacctacgactag

SEQ ID NO: 4476 - DNA, 936 bp, Artificial Sequence
  Description of Artificial Sequence: Synthetic coding sequence
tgagcccccagcccctgcagccacttcaactgcggcagccaggtgaccgacggcggcaccatcaagcagaagatcttcaccttcgacgccatgttcagcaccaactacagccacatggagaactacagaaagagagaggacctggtgtaccagagcaccgtgagactgcccgaggtgagaatcagcgacaacggcccctacgagtgccacgtgggcatctacgacagagccaccagagagaaggtggtgctggccagcggcaacatcttcctgaacgtgatggccccccccaccagcatcgaggtggtggccgccgacacccccgcccccttcagcagataccaggcccagaacttcaccctggtgtgcatcgtgagcggcggcaagcccgcccccatggtgtacttcaagagagacggcgagcccatcgacgccgtgcccctgagcgagccccccgccgccagcagcggccccctgcaggacagcagacccttcagaagcctgctgcacagagacctggacgacaccaagatgcagaagagcctgagcctgctggacgccgagaacagaggcggcagaccctacaccgagagacccagcagaggcctgacccccgaccccaacatcctgctgcagcccaccaccgagaacatccccgagaccgtggtgagcagagagttccccagatgggtgcacagcgccgagcccacctacttcctgagacacagcagaacccccagcagcgacggcaccgtggaggtgagagccctgctgacctggaccctgaacccccagatcgacaacgaggccctgttcagctgcgaggtgaagcaccccgccctgagcatgcccatgcaggccgaggtgaccctggtggcccccaagggccccaagatcgtgatgacccccagcagagccagagtgggcgacacctag

SEQ ID NO: 4477 - DNA, 978 bp, Artificial Sequence; identical to SEQ ID NO: 3582
  Description of Artificial Sequence: Synthetic coding sequence

SEQ ID NO: 4478 - DNA, 957 bp, Artificial Sequence
  Description of Artificial Sequence: Synthetic coding sequence
atgggcctgcacctgagaccctacagagtgggcctgctgcccgacggcctgctgttcctgctgctgctgctgatgctgctggccgaccccgccctgcccgccggcagacacccccccgtggtgctgggctggttcaccaccaagcaccccggcccccccagcttcctgatggtgtggatgtacgtgagcctggccctgggcagacccagccactggagcagctggacccccgccaaggccgcctgggtgcccatcagcaccccctggtggagagccctgtgggccggcgccacccacggcgtgagaatgagcgagggcctgcccatgaccggcgccgagccccagagacagccccaggcctggaaggacaagtacatcagagccttcgtgagcctgggcgccccctggggcggcgtggccaagaccctgagagtgctggccagcggcgacaacaacagaatccccgtgatcggccccctgaagatcagagagcagcagagaagcgccgtgagcaccagctggctgctgccctacaactacacctggagccccgagaaggtgttcgtgcagacccccaccatcaactacaccctgagagactacagaaagttcttccaggacatcggcttcgaggacggctggctgatgagacaggacaccgagggcctggtggaggccaccatgccccccggcgtgcagctgcactgcctgtacggcaccggcgtgcccacccccgacagcttctactacgagagcttccccgacagagaccccaagatctgcttcggcgacggcgacggcaccgtgaacctgaagagcgccctgcagtgccaggcctggcagagcagacaggagcaccaggtgctgctgcaggagctgcccggcagcgagcacatcgagatgctggccaacgccaccaccctggcctacctgaagagagtgctgctgggcccctag

SEQ ID NO: 4479 - DNA, 1575 bp, Artificial Sequence
  Description of Artificial Sequence: Synthetic coding sequence
tacgccctgagagacagacagggcaacgccatcggcgtgaccgcctgcgacatcgacggcgacggcagagaggagatctacttcctgaacaccaacaacgccttcagcggcgtggccacctacaccgacaagctgttcaagttcagaaacaacagatgggaggacatcctgagcgacgaggtgaacgtggccagaggcgtggccagcctgttcgccggcagaagcgtggcctgcgtggacagaaagggcagcggcagatacagcatctacatcgccaactacgcctacggcaacgtgggccccgacgccctgatcgagatggaccccgaggccagcgacctgagcagaggcatcctggccctgagagacgtggccgccgaggccggcgtgagcaagtacaccggcggcagaggcgtgagcgtgggccccatcctgagcagcagcgccagcgacatcttctgcgacaacgagaacggccccaacttcctgttccacaacagaggcgacggcaccttcgtggacgccgccgccagcgccggcgtggacgacccccaccagcacggcagaggcgtggccctggccgacttcaacagagacggcaaggtggacatcgtgtacggcaactggaacggcccccacagactgtacctgcagatgagcacccacggcaaggtgagattcagagacatcgccagccccaagttcagcatgcccagccccgtgagaaccgtgatcaccgccgacttcgacaacgaccaggagctggagatcttcttcaacaacatcgcctacagaagcagcagcgccaacagactgttcagagtgatcagaagagagcacggcgaccccctgatcgaggagctgaaccccggcgacgccctggagcccgagggcagaggcaccggcggcgtggtgaccgacttcgacggcgacggcatgctggacctgatcctgagccacggcgagagcatggcccagcccctgagcgtgttcagaggcaaccagggcttcaacaacaactggctgagagtggtgcccagaaccagattcggcgccttcgccagaggcgccaaggtggtgctgtacaccaagaagagcggcgcccacctgagaatcatcgacggcggcagcggctacctgtgcgagatggagcccgtggcccacttcggcctgggcaaggacgaggccagcagcgtggaggtgacctggcccgacggcaagatggtgagcagaaacgtggccagcggcgagatgaacagcgtgctggagatcctgtaccccagagacgaggacaccctgcaggaccccgcccccctggagacccccatgaacgccagcagcagccacagctgcgccctggagaccagcccctacgtgagcacccccatggaggccaccggcgccggccccaccagaagcgccgtgggcgccaccagccccaccagaatggcccagcccgcctggggcctgagcgccagccacagagcccccgcccccccccccccccccctgctgctgcccctgcccctgctgctgcccctgctggagctgcccctgctgcacagaagcagctag

SEQ ID NO: 4480 - DNA, 636 bp, Artificial Sequence
  Description of Artificial Sequence: Synthetic coding sequence
atggtgagcagaatggtgagcaccatgctgagcggcctgctgttctggctggccagcggctggacccccgccttcgcctacagccccagaacccccgacagagtgagcgaggccgacatccagagactgctgcacggcgtgatggagcagctgggcatcgccagacccagagtggagtaccccgcccaccaggccatgaacctggtgggcccccagagcatcgagggcggcgcccacgagggcctgcagcacctgggccccttcggcaacatccccaacatcgtggccgagctgaccggcgacaacatccccaaggacttcagcgaggaccagggctaccccgacccccccaacccctgccccgtgggcaagaccgacgacggctgcctggagaacacccccgacaccgccgagttcagcagagagttccagctgcaccagcacctgttcgaccccgagcacgactaccccggcctgggcaagtggaacaagaagctgctgtacgagaagatgaagggcggcgagagaagaaagagaagaagcgtgaacccctacctgcagggccagagactggacaacgtggtggccaagaagagcgtgccccacttcagcgacgaggacaaggaccccgagtag

SEQ ID NO: 4481 - DNA, 465 bp, Artificial Sequence
  Description of Artificial Sequence: Synthetic coding sequence
atggccctgggcgtgcccatcagcgtgtacctgctgttcaacgccatgaccgccctgaccgaggaggccgccgtgaccgtgaccccccccatcaccgcccagcagggcaactggaccgtgaacaagaccgaggccgacaacatcgagggccccatcgccctgaagttcagccacctgtgcctggaggaccacaacagctactgcatcaacggcgcctgcgccttccaccacgagctggagaaggccatctgcagatgcttcaccggctacaccggcgagagatgcgagcacctgaccctgaccagctacgccgtggacagctacgagaagtacatcgccatcggcatcggcgtgggcctgctgctgagcggcttcctggtgatcttctactgctacatcagaaagagatgcctgaagctgaagagcccctacaacgtgtgcagcggcgagagaagacccctgtag

SEQ ID NO: 4482 - DNA, 1446 bp, Artificial Sequence
  Description of Artificial Sequence: Synthetic coding sequence
atgggcaagctgagacccggcagagtggagtggctggccagcggccacaccgagagaccccacctgttccagaacctgctgctgttcctgtgggccctgctgaactgcggcctgggcgtgagcgcccagggccccggcgagtggaccccctgggtgagctggaccagatgcagcagcagctgcggcagaggcgtgagcgtgagaagcagaagatgcctgagactgcccggcgaggagccctgctggggcgacagccacgagtacagactgtgccagctgcccgactgcccccccggcgccgtgcccttcagagacctgcagtgcgccctgtacaacggcagacccgtgctgggcacccagaagacctaccagtgggtgcccttccacggcgcccccaaccagtgcgacctgaactgcctggccgagggccacgccttctaccacagcttcggcagagtgctggacggcaccgcctgcagccccggcgcccagggcgtgtgcgtggccggcagatgcctgagcgccggctgcgacggcctgctgggcagcggcgccctggaggacagatgcggcagatgcggcggcgccaacgacagctgcctgttcgtgcagagagtgttcagagacgccggcgccttcgccggctactggaacgtgaccctgatccccgagggcgccagacacatcagagtggagcacagaagcagaaaccacctggccctgatgggcggcgacggcagatacgtgctgaacggccactgggtggtgagcccccccggcacctacgaggccgccggcacccacgtggtgtacaccagagacaccggcccccaggagaccctgcaggccgccggccccaccagccacgacctgctgctgcaggtgctgctgcaggagcccaaccccggcatcgagttcgagttctggctgcccagagagagatacagccccttccaggccagagtgcaggccctgggctggcccctgagacagccccagcccagaggcgtggagccccagccccccgccgcccccgccgtgacccccgcccagacccccaccctggcccccgacccctgccccccctgccccgacaccagaggcagagcccacagactgctgcactactgcggcagcgacttcgtgttccaggccagagtgctgggccaccaccaccaggcccaggagaccagatacgaggtgagaatccagctggtgtacaagaacagaagccccctgagagccagagagtacgtgtgggcccccggccactgcccctgccccatgctggccccccacagagactacctgatggccgtgcagagactggtgagccccgacggcacccaggaccagctgctgctgccccacgccggctacgccagaccctggagccccgccgaggacagcagaatcagactgaccgccagaagatgccccggctag

SEQ ID NO: 4483 - DNA, 627 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacaccaccggcctggcctggagctag

SEQ ID NO: 4484 - DNA, 1482 bp, Artificial Sequence
  Description of Artificial Sequence: Synthetic coding sequence
agcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctacgtggagatggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggtgctggagagccaccccagaaccagaagccccggcctggtgggcatcagacccacccccctgcccgtgagccccatggccctgagatgctgcagccccatccagcccaccgccagcttctggcccctgacccccgtgcccctggaggccagagcccccccccacccccccggccccaacccccccacccccagaggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaactag

SEQ ID NO: 4485 - DNA, 2319 bp, Artificial Sequence
  Description of Artificial Sequence: Synthetic coding sequence
atgcagttccagctgaccctgttcctgcacctgggctggctgagctacagcaaggcccaggacgactgcaacagaggcgcctgccaccccaccaccggcgacctgctggtgggcagaaacacccagctgatggccagcagcacctgcggcctgagcagagcccagaagtactgcatcctgagctacctggagggcgagcagaagtgcttcatctgcgacagcagattcccctacgacccctacgaccagcccaacagccacaccatcgagaacgtgatcgtgagcttcgagcccgacagagagaagaagtggtggcagagcgagaacggcctggaccacgtgagcatcagactggacctggaggccctgttcagattcagccacctgatcctgaccttcaagaccttcagacccgccgccatgctggtggagagaagcaccgactacggccacaactggaaggtgttcaagtacttcgccaaggactgcgccaccagcttccccaacatcaccagcggccaggcccagggcgtgggcgacatcgtgtgcgacagcaagtacagcgacatcgagcccagcaccggcggcgaggtggtgctgaaggtgctggaccccagcttcgagatcgagaacccctacagcccctacatccaggacctggtgaccctgaccaacctgagaatcaacttcaccaagctgcacaccctgggcgacgccctgctgggcagaagacagaacgacagcctggacaagtactactacgccctgtacgagatgatcgtgagaggcagctgcttctgcaacggccacgccagcgagtgcagacccatgcagaagatgagaggcgacgtgttcagcccccccggcatggtgcacggccagtgcgtgtgccagcacaacaccgacggccccaactgcgagagatgcaaggacttcttccaggacgccccctggagacccgccgccgacctgcaggacaacgcctgcagaagctgcagctgcaacagccacagcagcagatgccacttcgacatgaccacctacctggccagcggcggcctgagcggcggcgtgtgcgaggactgccagcacaacaccgagggccagcactgcgacagatgcagacccctgttctacagagaccccctgaagaccatcagcgacccctacgcctgcatcccctgcgagtgcgaccccgacggcaccatcagcggcggcatctgcgtgagccacagcgaccccgccctgggcagcgtggccggccagtgcctgtgcaaggagaacgtggagggcgccaagtgcgaccagtgcaagcccaaccactacggcctgagcgccaccgaccccctgggctgccagccctgcgactgcaaccccctgggcagcctgcccttcctgacctgcgacgtggacaccggccagtgcctgtgcctgagctacgtgaccggcgcccactgcgaggagtgcaccgtgggctactggggcctgggcaaccacctgcacggctgcagcccctgcgactgcgacatcggcggcgcctacagcaacgtgtgcagccccaagaacggccagtgcgagtgcagaccccacgtgaccggcagaagctgcagcgagcccgcccccggctacttcttcgcccccctgaacttctacctgtacgaggccgaggaggccaccaccctgcagggcctggcccccctgggcagcgagaccttcggccagagccccgccgtgcacgtggtgctgggcgagcccgtgcccggcaaccccgtgacctggaccggccccggcttcgccagagtgctgcccggcgccggcctgagattcgccgtgaacaacatccccttccccgtggacttcaccatcgccatccactacgagacccagagcgccgccgactggaccgtgcagatcgtggtgaacccccccggcggcagcgagcactgcatccccaagaccctgcagagcaagccccagagcttcgccctgcccgccgccaccagaatcatgctgctgcccacccccatctgcctggagcccgacgtgcagtacagcatcgacgtgtacttcagccagcccctgcagggcgagagccacgcccacagccacgtgctggtggacagcgccgccgtgcagtggcacaacctgggcagcctgcagccccccccccccgagtgcaagcagttcagctgcttcagcttccccagcagctgggactacagacacccccccccccacctggccaacttctgcatcttcagcagagacggcgtgagcccccactggcccggctggagccagacccccgacctgagatag

SEQ ID NO: 4486 - DNA, 1371 bp, Artificial Sequence
  Description of Artificial Sequence: Synthetic coding sequence
atgggcagagccggcgccgccgccgtgatccccggcctggccctgctgtgggccgtgggcctgggcagcgccgcccccagcccccacctgagactgagcttccaggagctgcaggcctggcacggcctgcagaccttcagcctggagagaacctgctgctaccaggccctgctggtggacgaggagagaggcagactgttcgtgggcgccgagaaccacgtggccagcctgaacctggacaacatcagcaagagagccaagaagctggcctggcccgcccccgtggagtggagagaggagtgcaactgggccggcaaggacatcggcaccgagtgcatgaacttcgtgaagctgctgcacgcctacaacagaacccacctgctggcctgcggcaccggcgccttccaccccacctgcgccttcgtggaggtgggccacagagccgaggagcccgtgctgagactggaccccggcagaatcgaggacggcaagggcaagagcccctacgaccccagacacagagccgccagcgtgctggtgggcgaggagctgtacagcggcgtggccgccgacctgatgggcagagacttcaccatcttcagaagcctgggccagagacccagcctgagaaccgagccccacgacagcagatggctgaacgagcccaagttcgtgaaggtgttctggatccccgagagcgagaaccccgacgacgacaagatctacttcttcttcagagagaccgccgtggaggccgcccccgccctgggcagactgagcgtgagcagagtgggccagatctgcagaaacgacgtgggcggccagagaagcctggtgaacaagtggaccaccttcctgaaggccagactggtgtgcagcgtgcccggcgtggagggcgacacccacttcgaccagctgcaggacgtgttcctgctgagcagcagagaccacagaacccccctgctgtacgccgtgttcagcaccagcagcagcatcttccagggcagcgccgtgtgcgtgtacagcatgaacgacgtgagaagagccttcctgggccccttcgcccacaaggagggccccatgcaccagtgggtgagctaccagggcagagtgccctaccccagacaggcctgcgcccccgccagacccctggcccccagcgtgccccccagaaccagccagaccatgagcagcagcctgagaggcaccacccccagctgcaccaccctgagctgccccctgggcggcgccctgttcagctacaagctggagcccatcacccccagcctgaagctgcccagaaccggcctgcagcccctgaccgacaccatgaccagcagcagcctggcccagaccctggccagatgctag

SEQ ID NO: 4487 - DNA, 333 bp, Artificial Sequence
  Description of Artificial Sequence: Synthetic coding sequence
ctgttcatgctgcacaagatcgtgcaggtgtacaacagcgacgtgatcgacaagcagagcgccagcatgaccagcgacaacgccgacgacaaggccgtgatcatcctggtgcccgtgagactgggcggcgagagaaccaacaccgactacctggagttcgtgaagggcatcctgagcctggagtactgcgtgggcatcatcggcggcaagcccaagcagagctactacttcgccggcttccaggacgacagcctgatctacatggacccccactactgccagagcttcgtggacgtgagcatcaaggacttccccctggaggtgatcctgtag

SEQ ID NO: 4488 - DNA, 420 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggagtag

SEQ ID NO: 4489 - DNA, 570 bp, Artificial Sequence
  Description of Artificial Sequence: Synthetic coding sequence
atgctgggcatcaccagctgcagcgaccagcaggccaaggagggcgagggcctggagggcagcagcaccggcagcagcagcggcaaccacggcggcagcggcggcggcaacggccacaagcccggctgcgagaagcccggcaacgaggccagaggcagcggcgagagcggcatccagaacagcgagaccagccccggcatgttcaacttcgacaccttctggaagaacttcaagagcaagctgggcttcatcaactgggacgccatcaacaagaaccaggtgcccccccccagcaccagagccctgctgtacttcagcagactgtgggaggacttcaagcagaacacccccttcctgaactggaaggccatcatcgagggcgccgacgccagcagcctgcagaagagagccggcagagacgaccagaactacaactacaaccagcacgcctaccccaccgcctacggcggcaagtacagcgtgaagacccccgccaagggcggcgtgagccccagcagcagcgccagcagagtgcagcccggcctgctgcagtgggtgaagttctggtag

SEQ ID NO: 4490 - DNA, 438 bp, Artificial Sequence; identical to SEQ ID NO: 4107
  Description of Artificial Sequence: Synthetic coding sequence

SEQ ID NO: 4491 - DNA, 264 bp, Artificial Sequence
  Description of Artificial Sequence: Synthetic coding sequence
tgcaagagaaagccctacctgctgcccagcatcagagagggcgccagactgggcatccaggagtgcggcagccagttcagacacgagagatggaactgcatgatcaccgccgccgccaccaccgcccccatgggcgccagccccctgttcggctacgagctgagcagcggctgcagacaggtggacgtgagcagactgcccctgcccagaagcttcagactgctgtgctgcgagaacatgctggagaaccacgtgttcttctag

SEQ ID NO: 4492 - DNA, 2535 bp, Artificial Sequence; identical to SEQ ID NO: 3960
  Description of Artificial Sequence: Synthetic coding sequence

SEQ ID NO: 4493 - DNA, 2631 bp, Artificial Sequence; identical to SEQ ID NO: 3583
  Description of Artificial Sequence: Synthetic coding sequence

SEQ ID NO: 4494 - DNA, 942 bp, Artificial Sequence; identical to SEQ ID NO: 3906
  Description of Artificial Sequence: Synthetic coding sequence

SEQ ID NO: 4495 - DNA, 843 bp, Artificial Sequence
  Description of Artificial Sequence: Synthetic coding sequence
atgaagaccttcacctggaccctgggcgtgctgttcttcctgctggtggacaccggccactgcagaggcggccagttcaagatcaagaagatcaaccagagaagataccccagaaccatcaaggacatgatcaccagaatggacctggagaacctgaaggacgtgctgagcagacagaagagagagatcgacgtgctgcagctggtggtggacgtggacggcaacatcgtgaacgaggtgaagctgctgagaaaggagagcagaaacatgaacagcagagtgacccagctgtacatgcagctgctgcacgagatcatcagaaagagagacaacagcctggagctgagccagctggagaacaagatcctgaacgtgaccaccgagatgctgaagatggccaccagatacagagagctggaggtgaagtacgccagcctgaccgacctggtgaacaaccagagcgtgatgatcaccctgctggaggagcagtgcctgagaatcttcagcagacaggacacccacgtgagcccccccctggtgcaggtggtgccccagcacatccccaacagccagcagtacacccccggcctgctgggcggcaacgagatccagagagaccccggctaccccagagacctgatgcccccccccgacctggccaccagccccaccaagagccccttcaagatcccccccgtgaccttcatcaacgagggccccttcaaggactgccagcaggccaaggaggccggccacagcgtgaacggcatcttctgggccgagtacagaggcggcagctacagcctgagagccgtgcagatgatgatcaagcccatcgactag

SEQ ID NO: 4496 - DNA, 522 bp, Artificial Sequence; identical to SEQ ID NO: 3879
  Description of Artificial Sequence: Synthetic coding sequence

SEQ ID NO: 4497 - DNA, 309 bp, Artificial Sequence
  Description of Artificial Sequence: Synthetic coding sequence
atggagagaggcgccggcgccaagctgctgcccctgctgctgctgctgagagccaccggcttcacctgcgcccagaccgacggcagaaacggctacaccgccgtgatcgaggtgaccagcggcggcccctggggcgactgggcctggcccgagatgtgccccgacggcttcttcgccagcggcttcagcctgaaggtggagcccccccagggcatccccggcgacgacaccgccctgaacggcatcagactgcactgcgccagaggcaacgtgctgggcaacacccacgtgctgggcagaatggagtag

SEQ ID NO: 4498 - DNA, 351 bp, Artificial Sequence; identical to SEQ ID NO: 4162
  Description of Artificial Sequence: Synthetic coding sequence

SEQ ID NO: 4499 - DNA, 1137 bp, Artificial Sequence
  Description of Artificial Sequence: Synthetic coding sequence
tgatacagcggcgactacatggagcccgagaagcccggcgcccccctgctgcccccccccccccagaacagcgtgccccactacgccgaggccgacatcgtgaccctgcagggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagcttcagcctgttcagcagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaacttcgtgcacagagacctggccaccagaaactgcctggtgggcgagaacttcaccatcaagatcgccgacttcggcatgagcagaaacctgtacgccggcgactactacagagtgcagggcagagccgtgctgcccatcagatggatggcctgggagtgcatcctgatgggcaagttcaccaccgccagcgacgtgtgggccttcggcgtgaccctgtgggaggtgctgatgctgtgcagagcccagcccttcggccagctgaccgacgagcaggtgatcgagaacgccggcgagttcttcagagaccagggcagacaggtgtacctgagcagaccccccgcctgcccccagggcctgtacgagctgatgctgagatgctggagcagagagagcgagcagagaccccccttcagccagctgcacagattcctggccgaggacgccctgaacaccgtgtag

SEQ ID NO: 4500 - DNA, 942 bp, Artificial Sequence; identical to SEQ ID NO: 3906
  Description of Artificial Sequence: Synthetic coding sequence

SEQ ID NO: 4501 - DNA, 420 bp, Artificial Sequence; identical to SEQ ID NO: 4488
  Description of Artificial Sequence: Synthetic coding sequence

SEQ ID NO: 4502 - DNA, 342 bp, Artificial Sequence
  Description of Artificial Sequence: Synthetic coding sequence
atggacaacgtgcagcccaagatcaagcacagacccttctgcttcagcgtgaagggccacgtgaagatgctgagactggccctgaccgtgaccagcatgaccttcttcatcatcgcccaggcccccgagccctacatcgtgatcaccggcttcgaggtgaccgtgatcctgttcttcatcctgctgtacgtgctgagactggacagactgatgaagtggctgttctggcccctgctggacatcatcaacagcctggtgaccaccgtgttcatgctgatcgtgagcgtgctggccctgatccccgagaccaccaccctgaccgtgggcggcggcctgttctag

SEQ ID NO: 4503 - DNA, 465 bp, Artificial Sequence
  Description of Artificial Sequence: Synthetic coding sequence
atgttcggctggggcgacttccacagcaacatcaagaccgtgaagctgaacctgctgatcaccggcaagatcgtggaccacggcaacggcaccttcagcgtgtacttcagacacaacagcaccggccagggcaacgtgagcgtgagcctggtgccccccaccaagatcgtggagttcgacctggcccagcagaccgtgatcgacgccaaggacagcaagagcttcaactgcagaatcgagtacgagaaggtggacaaggccaccaagaacaccctgtgcaactacgaccccagcaagacctgctaccaggagcagacccagagccacgtgagctggctgtgcagcaagcccttcaaggtgatctgcatctacatcagcttctacagcaccgactacaagctggtgcagaaggtgtgccccgactacaactaccacagcgacaccccctacttccccagcggctag

SEQ ID NO: 4504 - DNA, 531 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggactag

SEQ ID NO: 4505 - DNA, 2535 bp, Artificial Sequence; identical to SEQ ID NO: 3960
  Description of Artificial Sequence: Synthetic coding sequence

SEQ ID NO: 4506 - DNA, 2055 bp, Artificial Sequence
  Description of Artificial Sequence: Synthetic coding sequence
tgacccagaagcagcacccacgtgcccctggtgctgcccctgctggtgctgctgctgctggcccccgccagacaggccgccgcccagagatgcccccaggcctgcatctgcgacaacagcagaagacacgtggcctgcagataccagaacctgaccgaggtgcccgacgccatccccgagctgacccagagactggacctgcagggcaacctgctgaaggtgatccccgccgccgccttccagggcgtgccccacctgacccacctggacctgagacactgcgaggtggagctggtggccgagggcgccttcagaggcctgggcagactgctgctgctgaacctggccagcaaccacctgagagagctgccccaggaggccctggacggcctgggcagcctgagaagactggagctggagggcaacgccctggaggagctgagacccggcaccttcggcgccctgggcgccctggccaccctgaacctggcccacaacgccctggtgtacctgcccgccatggccttccagggcctgctgagagtgagatggctgagactgagccacaacgccctgagcgtgctggcccccgaggccctggccggcctgcccgccctgagaagactgagcctgcaccacaacgagctgcaggccctgcccggccccgtgctgagccaggccagaggcctggccagactggagctgggccacaaccccctgacctacgccggcgaggaggacggcctggccctgcccggcctgagagagctgctgctggacggcggcgccctgcaggccctgggccccagagccttcgcccactgccccagactgcacaccctggacctgagaggcaaccagctggacaccctgccccccctgcagggccccggccagctgagaagactgagactgcagggcaaccccctgtggtgcggctgccaggccagacccctgctggagtggctggccagagccagagtgagaagcgacggcgcctgccagggccccagaagactgagaggcgaggccctggacgccctgagaccctgggacctgagatgccccggcgacgccgcccaggaggaggaggagctggaggagagagccgtggccggccccagagccccccccagaggcccccccagaggccccggcgaggagagagccgtggccccctgccccagagcctgcgtgtgcgtgcccgagagcagacacagcagctgcgagggctgcggcctgcaggccgtgcccagaggcttccccagcgacacccagctgctggacctgagaagaaaccacttccccagcgtgcccagagccgccttccccggcctgggccacctggtgagcctgcacctgcagcactgcggcatcgccgagctggaggccggcgccctggccggcctgggcagactgatctacctgtacctgagcgacaaccagctggccggcctgagcgccgccgccctggagggcgcccccagactgggctacctgtacctggagagaaacagattcctgcaggtgcccggcgccgccctgagagccctgcccagcctgttcagcctgcacctgcaggacaacgccgtggacagactggcccccggcgacctgggcagaaccagagccctgagatgggtgtacctgagcggcaacagaatcaccgaggtgagcctgggcgccctgggccccgccagagagctggagaagctgcacctggacagaaaccagctgagagaggtgcccaccggcgccctggagggcctgcccgccctgctggagctgcagctgagcggcaaccccctgagagccctgagagacggcgccttccagcccgtgggcagaagcctgcagcacctgttcctgaacagcagcggcctggagcagatctgccccggcgccttcagcggcctgggccccggcctgcagagcctgcacctgcagaagaaccagctgagagccctgcccgccctgcccagcgccagaagaacccccatcaagggcagacagtgcggcgccgacaaggtgggcaaggagaagggcagactgtag

SEQ ID NO: 4507 - DNA, 2259 bp, Artificial Sequence
  Description of Artificial Sequence: Synthetic coding sequence
atggccagacacctgctgctgcccctggtgatgctggtgatcagccccatccccggcgccttccaggacagcgccctgagccccacccaggaggagcccgaggacctggactgcggcagacccgagcccagcgccagaatcgtgggcggcagcaacgcccagcccggcacctggccctggcaggtgagcctgcaccacggcggcggccacatctgcggcggcagcctgatcgcccccagctgggtgctgagcgccgcccactgcttcatgaccaacggcaccctggagcccgccgccgagtggagcgtgctgctgggcgtgcacagccaggacggccccctggacggcgcccacaccagagccgtggccgccatcgtggtgcccgccaactacagccaggtggagctgggcgccgacctggccctgctgagactggccagccccgccagcctgggccccgccgtgtggcccgtgtgcctgcccagagccagccacagattcgtgcacggcaccgcctgctgggccaccggctggggcgacgtgcaggaggccgaccccctgcccctgccctgggtgctgcaggaggtggagctgagactgctgggcgaggccacctgccagtgcctgtacagccagcccggccccttcaacctgaccctgcagatcctgcccggcatgctgtgcgccggctaccccgagggcagaagagacacctgccagggcgacagcggcggccccctggtgtgcgaggagggcggcagatggttccaggccggcatcaccagcttcggcttcggctgcggcagaagaaacagacccggcgtgttcaccgccgtggccacctacgaggcctggatcagagagcaggtgatgggcagcgagcccggccccgccttccccacccagccccagaagacccagagcgacccccaggagcccagagaggagaactgcaccatcgccctgcccgagtgcggcaaggcccccagacccggcgcctggccctgggaggcccaggtgatggtgcccggcagcagaccctgccacggcgccctggtgagcgagagctgggtgctggcccccgccagctgcttcctggaccccaacagcagcgacagcccccccagagacctggacgcctggagagtgctgctgcccagcagacccagagccgagagagtggccagactggtgcagcacgagaacgccagctgggacaacgccagcgacctggccctgctgcagctgagaacccccgtgaacctgagcgccgccagcagacccgtgtgcctgccccaccccgagcactacttcctgcccggcagcagatgcagactggccagatggggcagaggcgagcccgccctgggccccggcgccctgctggaggccgagctgctgggcggctggtggtgccactgcctgtacggcagacagggcgccgccgtgcccctgcccggcgaccccccccacgccctgtgccccgcctaccaggagaaggaggaggtgggcagctgctggaacgacagcagatggagcctgctgtgccaggaggagggcacctggttcctggccggcatcagagacttccccagcggctgcctgagacccagagccttcttccccctgcagacccacggcccctggatcagccacgtgaccagaggcgcctacctggaggaccagctggcctgggactggggccccgacggcgaggagaccgagacccagacctgccccccccacaccgagcacggcgcctgcggcctgagactggaggccgcccccgtgggcgtgctgtggccctggctggccgaggtgcacgtggccggcgacagagtgtgcaccggcatcctgctggcccccggctgggtgctggccgccacccactgcgtgctgagacccggcagcaccaccgtgccctacatcgaggtgtacctgggcagagccggcgccagcagcctgccccagggccaccagatgaccagcgccccccccctgctgtgccagatgaccgagggcagctggatcctggtgggcatggccgtgcagggcagcagagagctgttcgccgccatcggccccgaggaggcctggatcagccagaccgtgggcgaggccaacttcctgccccccagcggcagcccccactggcccaccggcggcagcaacctgtgcccccccgagctggccaaggccagcggcagcccccacgccgtgtacttcctgctgctgctgaccctgctgatccagagctag

SEQ ID NO: 4508 - DNA, 453 bp, Artificial Sequence; identical to SEQ ID NO: 3797
  Description of Artificial Sequence: Synthetic coding sequence

SEQ ID NO: 4509 - DNA, 1161 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcggcagcggcagccagagcggcagcagcggcagcggcagcaacggcgacaacaacaacggcagcagcagcggcggcagcagcagcggcagcagcagcggcggcagcagcggcggcagcagcggcggcagcagcggcaacagcggcggcagcagaggcgacagcggcagcgagagcagctggggcagcagcaccggcagcagcagcggcaaccacggcggcagcggcggcggcaacggccacaagcccggctgcgagaagcccggcaacgaggccagaggcagcggcgagagcggcatccagaacagcgagaccagccccggcatgttcaacttcgacaccttctggaagaacttcaagagcaagctgggcttcatcaactgggacgccatcaacaaggaccagagaagcagcagaatcccctag

SEQ ID NO: 4510 - DNA, 1995 bp, Artificial Sequence; identical to SEQ ID NO: 3643
  Description of Artificial Sequence: Synthetic coding sequence

SEQ ID NO: 4511 - DNA, 420 bp, Artificial Sequence; identical to SEQ ID NO: 4488
  Description of Artificial Sequence: Synthetic coding sequence

SEQ ID NO: 4512 - DNA, 285 bp, Artificial Sequence; identical to SEQ ID NO: 3803
  Description of Artificial Sequence: Synthetic coding sequence

SEQ ID NO: 4513 - DNA, 699 bp, Artificial Sequence
  Description of Artificial Sequence: Synthetic coding sequence
atgctgcccaagagcagaagagccctgaccatccaggagatcgccgccctggccagaagcagcctgcacggcatcagccaggtggtgaaggaccacgtgaccaagcccaccgccatggcccagggcagagtggcccacctgatcgagtggaagggctggagcaagcccagcgacagccccgccgccctggagagcgccttcagcagctacagcgacctgagcgagggcgagcaggaggccagattcgccgccggcgtggccgagcagttcgccatcgccgaggccaagctgagagcctggagcagcgtggacggcgaggacagcaccgacgacagctacgacgaggacttcgccggcggcatggacaccgacatggccggccagctgcccctgggcccccacctgcaggacctgttcaccggccacagattcagcagacccgtgagacagggcagcgtggagcccgagagcgactgcagccagaccgtgagccccgacaccctgtgcagcagcctgtgcagcctggaggacggcctgctgggcagccccgccagactggccagccagctgctgggcgacgagctgctgctggccaagctgccccccagcagagagagcgccttcagaagcctgggccccctggaggcccaggacagcctgtacaacagccccctgaccgagagctgcctgagcccctag

SEQ ID NO: 4514 - DNA, 2631 bp, Artificial Sequence; identical to SEQ ID NO: 3583
  Description of Artificial Sequence: Synthetic coding sequence

SEQ ID NO: 4515 - DNA, 165 bp, Artificial Sequence
  Description of Artificial Sequence: Synthetic coding sequence
atgtgcagagagaccgccggctacggctggctgctggccagcaccgagctgctgagcctgctggagcccctgagcccccagctgctgaaggagcacatcagctgcaccagccaggtggccgccggcgccaaggtgacccccgacagcgccgtgtgggccccctag

SEQ ID NO: 4516 - DNA, 2256 bp, Artificial Sequence; identical to SEQ ID NO: 3606
  Description of Artificial Sequence: Synthetic coding sequence

SEQ ID NO: 4517 - DNA, 630 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtactag

SEQ ID NO: 4518 - DNA, 315 bp, Artificial Sequence
  Description of Artificial Sequence: Synthetic coding sequence
atgagcgacctgctgctgctgggcctgatcggcggcctgaccctgctgctgctgctgaccctgctggccttcgccggctacagcggcctgctggccggcgtggaggtgagcgccggcagcccccccatcagaaacgtgaccgtggcctacaagttccacatgggcctgtacggcgagaccggcagactgttcaccgagagctgcagcatcagccccaagctgagaagcatcgccgtgtactacgacaacccccacatggtgccccccgacaagtgcagatgcgccgtgggcagcatcctgagcgagggcgagtag

SEQ ID NO: 4519 - DNA, 2631 bp, Artificial Sequence; identical to SEQ ID NO: 3583
  Description of Artificial Sequence: Synthetic coding sequence

SEQ ID NO: 4520 - DNA, 1053 bp, Artificial Sequence
  Description of Artificial Sequence: Synthetic coding sequence
atggaggccttcgccctgggccccgccagaagaggcagaagaagaaccagagccgccggcagcctgctgagcagagccgccatcctgctgttcatcagcgccttcctggtgagagtgcccagcagcgtgggccacctggtgagactgcccagagccttcagactgaccaaggacagcgtgaagatcgtgggcagcaccagcttccccgtgaaggcctacgtgatgctgcaccagaagagcccccacgtgctgtgcgtgacccagcagctgagaaacgccgagctgatcgaccccagcttccagtggtacggccccaagggcaaggtggtgagcgagaacagaaccgcccagatcaccagcaccggcagcctggtgttccagaacttcgaggagagcatgagcggcatctacacctgcttcctggagtacaagcccaccgtggaggagatcgtgaagagactgcagctgaagtacgccatctacgcctacagagagccccactactactaccagttcaccgccagataccacgccgccccctgcaacagcatctacaacatcagcttcgagaagaagctgctgcagatcctgagcaagctgctgctggacctgagctgcgagatcagcctgctgaagagcgagtgccacagagtgaagatgcagagagccggcctgcagaacgagctgttcttcgccttcagcgtgagcagcctggacaccgagaagggccccaagagatgcaccgaccacaactgcgagccctacaagagactgttcaaggccaagaacctgatcgagagattcttcaaccagcaggtggagatcctgggcagaagagccgagcagctgccccagatctactacatcgagggcaccctgcagatggtgtggatcaacagatgcttccccggctacggcatgaacgtgcagcagcaccccaagtgccccgagtgctgcgtgatctgcagccccggcagctacaaccccagagacggcatccactgcctgcagtgcaacagcagcctggtgtacggcgccaagacctgcctgtag

SEQ ID NO: 4521 - DNA, 1392 bp, Artificial Sequence
  Description of Artificial Sequence: Synthetic coding sequence
tgactggccctggtgctgtgcaccgtggacagcagaccccccgcccagctggccctgagccacgccggcagactgctggccagcagcaccgccgccagcgtgcccaacaccctgagactggagctgagaggcccccagcccagagacgagggcttctacagctgcagcgccagaagccccctgggccaggccaacaccagcctggagctgagactggagggcgtgagagtgatcctggcccccgaggccgccgtgcccgagggcgcccccatcaccgtgacctgcgccgaccccgccgcccacgcccccaccctgtacacctggtaccacaacggcagatggctgcaggagggccccgccgccagcctgagcttcctggtggccaccagagcccacgccggcgcctacagctgccaggcccaggacgcccagggcaccagaagcagcagacccgccgccctgcaggtgctgtacgccccccaggacgccgtgctgagcagcttcagagacagcagagccagaagcatggccgtgatccagtgcaccgtggacagcgagccccccgccgagctggccctgagccacgacggcaaggtgctggccaccagcagcggcgtgcacagcctggccagcggcaccggccacgtgcaggtggccagaaacgccctgagactgcaggtgcaggacgtgcccgccggcgacgacacctacgtgtgcaccgcccagaacctgctgggcagcatcagcaccatcggcagactgcaggtggagggcgccagagtggtggccgagcccggcctggacgtgcccgagggcgccgccctgaacctgagctgcagactgctgggcggccccggccccgtgggcaacagcaccttcgcctggttctggaacgacagaagactgcacgccgagcccgtgcccaccctggccttcacccacgtggccagagcccaggccggcatgtaccactgcctggccgagctgcccaccggcgccgccgccagcgcccccgtgatgctgagagtgctgtacccccccaagacccccaccatgatggtgttcgtggagcccgagggcggcctgagaggcatcctggactgcagagtggacagcgagcccctggccagcctgaccctgcacctgggcagcagactggtggccagcagccagccccagggcgcccccgccgagccccacatccacgtgctggccagccccaacgccctgagagtggacatcgaggccctgagacccagcgaccagggcgagtacatctgcagcgccagcaacgtgctgggcagcgccagcaccagcacctacttcggcgtgagaggcgagggcagaggcctgcacctgcccggccacagcgcccagaagcccagcagctag

SEQ ID NO: 4522 - DNA, 1398 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcagcagcaccggcagcagcagcggcaaccacggcggcagcggcggcggcaacggccacaagcccggctgcgagaagcccggcaacgaggccagaggcagcggcgagagcggcatccagggcttcagaggccagggcgtgagcagcaacatgagagagatcagcaaggagggcaacagactgctgggcggcagcggcgacaactacagaggccagggcagcagctggggcagcggcggcggcgacgccgtgggcggcgtgaacaccgtgaacagcgagaccagccccggcatgttcaacttcgacaccttctggaagaacttcaagagcaagctgggcttcatcaactgggacgccatcaacaagaaccaggtgcccccccccagcaccagagccctgctgtacttcagcagactgtgggaggacttcaagcagaacacccccttcctgaactggaaggccatcatcgagggcgccgacgccagcagcctgcagaagagagccggcagagacgaccagaactacaactacaaccagcacgcctaccccaccgcctacggcggcaagtacagcgtgaagacccccgccaagggcggcgtgagccccagcagcagcgccagcagagtgcagcccggcctgctgcagtgggtgaagttctggtag

SEQ ID NO: 4523 - DNA, 2700 bp, Artificial Sequence; identical to SEQ ID NO: 4183
  Description of Artificial Sequence: Synthetic coding sequence

SEQ ID NO: 4524 - DNA, 381 bp, Artificial Sequence
  Description of Artificial Sequence: Synthetic coding sequence
atgtggtacgtgagcaccagaggcgtggcccccagagtgaacttcgagggcgccctgttcagcggctacgcccccgacggcggcctgttcatgcccgaggagctgccccagctggacagaggcaccctgtgccagtggagcaccctgagctaccccggcctggtgaaggagctgtgcgccctgttcatcggcagcgagctgctgcccaaggacgagctgaacgacctgatcgacagagccttcagcagattcagacacagagaggtggtgcacctgagcagactgagaaacggcctgaacgtgctggagctgtggcacggcgtgacctacgccttcaaggacctgagcctgagctgcaccacccagttcctgcagtactag

SEQ ID NO: 4525 - DNA, 147 bp, Artificial Sequence
  Description of Artificial Sequence: Synthetic coding sequence
atgccccccttcctgatcaccctgttcctgttccacagctgctgcctgagagccaacggccacctgagagagggcatgaccctgctgaagaccgagttcgccctgcacctgtaccagagcgtggccgcctgcagaaacgagacctag

SEQ ID NO: 4526 - DNA, 390 bp, Artificial Sequence; identical to SEQ ID NO: 4161
  Description of Artificial Sequence: Synthetic coding sequence

SEQ ID NO: 4527 - DNA, 462 bp, Artificial Sequence
  Description of Artificial Sequence: Synthetic coding sequence
atgaccatccacatcctgatcctgctgctgctgctggccttcagcgcccagggcgacctggacaccgccgccagaagaggccagcaccaggtgccccagcacagaggccacgtgtgctacctgggcgtgtgcagaacccacagactggccgagatcatctactggatcagatgcctgcaccagggcgccctgggcgagggccagcccagagcccccggccccctgcagctgtgggccccccccgtggccagaggcggcagccccgccagattccccggcttcagacccgccgccagaggcctggcccagtgccccgccagatgggtgaccagcggcaccgccagacccctgctgggcttcagcctgcccatctgcatgctggagctgctgctgcacatcagcagccccctgacccccgcccccgagaccgtgttccccagccccagccccggctgcgactag

SEQ ID NO: 4528 - DNA, 450 bp, Artificial Sequence
  Description of Artificial Sequence: Synthetic coding sequence
atgggctggctgaccagaatcgtgtgcctgttctggggcgtgctgctgaccgccagagccaactaccagaacggcaagaacaacgtgcccagactgaagctgagctacaaggagatgctggagagcaacaacgtgatcaccttcaacggcctggccaacagcagcagctaccacaccttcctgctggacgaggagagaagcagactgtacgtgggcgccaaggaccacatcttcagcttcgacctggtgaacatcaaggacttccagaagatcgtgtggcccgtgagctacaccagaagagacgagtgcaagtgggccggcaaggacatcctgaaggagtgcgccaacttcatcaaggtgctgaaggcctacaaccagacccacctgtacgcctgcggcaccggcgccttccaccccatctgcacctacatcgagatcggccaccactag

SEQ ID NO: 4529 - DNA, 543 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtgtag

SEQ ID NO: 4530 - DNA, 630 bp, Artificial Sequence; identical to SEQ ID NO: 4517
  Description of Artificial Sequence: Synthetic coding sequence

SEQ ID NO: 4531 - DNA, 630 bp, Artificial Sequence; identical to SEQ ID NO: 4517
  Description of Artificial Sequence: Synthetic coding sequence

SEQ ID NO: 4532 - DNA, 2631 bp, Artificial Sequence; identical to SEQ ID NO: 3583
  Description of Artificial Sequence: Synthetic coding sequence

SEQ ID NO: 4533 - DNA, 2103 bp, Artificial Sequence
  Description of Artificial Sequence: Synthetic coding sequence
atgctggcccccttcctgctgctgctgacccacagcagaagccccctgagcttcagaccctgcagccacgtgcccggcgccctgatcgcccagaagcccatgggcagcagcagactggccgccctgctgctgcccctgctgctgatcgtgatcgacctgagcgacagcgccggcatcggcttcagacacctgccccactggaacaccagatgccccctggccagccacaccgacgacagcttcaccggcagcagcgcctacatcccctgcagaacctggtgggccctgttcagcaccaagccctggtgcgtgagagtgtggcactgcagcagatgcctgtgccagcacctgctgagcggcggcagcggcctgcagagaggcctgttccacctgctggtgcagaagagcaagaagagcagcaccttcaagttctacagaagacacaagatgcccgcccccgcccagagaaagctgctgcccagaagacacctgagcgagaagagccaccacatcagcatccccagccccgacatcagccacaagggcctgagaagcaagagaacccagcccagcgaccccgagacctgggagagcctgcccagactggacagccagagacacggcggccccgagttcagcttcgacctgctgcccgaggccagagccatcagagtgaccatcagcagcggccccgaggtgagcgtgagactgtgccaccagtgggccctggagtgcgaggagctgagcagcccctacgacgtgcagaagatcgtgagcggcggccacaccgtggagctgccctacgagttcctgctgccctgcctgtgcatcgaggccagctacctgcaggaggacaccgtgagaagaaagaagtgccccttccagagctggcccgaggcctacggcagcgacttctggaagagcgtgcacttcaccgactacagccagcacacccagatggtgatggccctgaccctgagatgccccctgaagctggaggccgccctgtgccagagacacgactggcacaccctgtgcaaggacctgcccaacgccaccgccagagagagcgacggctggtacgtgctggagaaggtggacctgcacccccagctgtgcttcaagttcagcttcggcaacagcagccacgtggagtgcccccaccagaccggcagcctgaccagctggaacgtgagcatggacacccaggcccagcagctgatcctgcacttcagcagcagaatgcacgccaccttcagcgccgcctggagcctgcccggcctgggccaggacaccctggtgccccccgtgtacaccgtgagccaggccagaggcagcagccccgtgagcctggacctgatcatccccttcctgagacccggctgctgcgtgctggtgtggagaagcgacgtgcagttcgcctggaagcacctgctgtgccccgacgtgagctacagacacctgggcctgctgatcctggccctgctggccctgctgaccctgctgggcgtggtgctggccctgacctgcagaagaccccagagcggccccggccccgccagacccgtgctgctgctgcacgccgccgacagcgaggcccagagaagactggtgggcgccctggccgagctgctgagagccgccctgggcggcggcagagacgtgatcgtggacctgtgggagggcagacacgtggccagagtgggccccctgccctggctgtgggccgccagaaccagagtggccagagagcagggcaccgtgctgctgctgtggagcggcgccgacctgagacccgtgagcggccccgaccccagagccgcccccctgctggccctgctgcacgccgcccccagacccctgctgctgctggcctacttcagcagactgtgcgccaagggcgacatccccccccccctgagagccctgcccagatacagactgctgagagacctgcccagactgctgagagccctggacgccagacccttcgccgaggccaccagctggggcagactgggcgccagacagagaagacagagcagactggagctgtgcagcagactggagagagaggccgccagactggccgacctgggctag

SEQ ID NO: 4534 - DNA, 1194 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagaaacgtgacctggaagctgggcagcagactgtacggccccagcagcgtgagcttcgccgacgacttcgtgagaagcagcaagcagcactacaactgcgagcacagcaagatcaacttcagagacaagagaagcgccctgcagagcatcaacgagtgggccgcccagaccaccgacggcaagctgcccgaggtgaccaaggacgtggagagaaccgacggcgccctgctggtgaacgccatgttcttcaagccccactgggacgagaagttccaccacaagatggtggacaacagaggcttcatggtgaccagaagctacaccgtgggcgtgatgatgatgcacagaaccggcctgtacaactactacgacgacgagaaggagaagctgcagatcgtggagatgcccctggcccacaagctgagcagcctgatcatcctgatgccccaccacgtggagcccctggagagactggagaagctgctgaccaaggagcagctgaagatctggatgggcaagatgcagaagaaggccgtggccatcagcctgcccaagggcgtggtggaggtgacccacgacctgcagaagcacctggccggcctgggcctgaccgaggccatcgacaagaacaaggccgacctgagcagaatgagcggcaagaaggacctgtacctggccagcgtgttccacgccaccgccttcgagctggacaccgacggcaaccccttcgaccaggacatctacggcagagaggagctgagaagccccaagctgttctacgccgaccaccccttcatcttcctggtgagagacacccagagcggcagcctgctgttcatcggcagactggtgagacccaagggcgacaagatgagagacgagctgtag

SEQ ID NO: 4535 - DNA, 612 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacaccacctag

SEQ ID NO: 4536 - DNA, 1293 bp, Artificial Sequence
  Description of Artificial Sequence: Synthetic coding sequence
atgagaaagctgatgaagcaggtgcaggagcagtgccccaacatcaccagaatctacagcatcggcaagagctaccagggcctgaagctgtacgtgatggagatgagcgacaagcccggcgagcacgagctgggcgagcccgaggtgagatacgtggccggcatgcacggcaacgaggccctgggcagagagctgctgctgctgctgatgcagttcctgtgccacgagttcctgagaggcaaccccagagtgaccagactgctgagcgagatgagaatccacctgctgcccagcatgaaccccgacggctacgagatcgcctaccacagaggcagcgagctggtgggctgggccgagggcagatggaacaaccagagcatcgacctgaaccacaacttcgccgacctgaacacccccctgtgggaggcccaggacgacggcaaggtgccccacatcgtgcccaaccaccacctgcccctgcccacctactacaccctgcccaacgccaccgtggcccccgagaccagagccgtgatcaagtggatgaagagaatccccttcgtgctgagcgccaacctgcacggcggcgagctggtggtgagctaccccttcgacatgaccagaaccccctgggccgccagagagctgacccccacccccgacgacgccgtgttcagatggctgagcaccgtgtacgccggcagcaacctggccatgcaggacaccagcagaagaccctgccacagccaggacttcagcgtgcacggcaacatcatcaacggcgccgactggcacaccgtgcccggcagcatgaacgacttcagctacctgcacaccaactgcttcgaggtgaccgtggagctgagctgcgacaagttcccccacgagaacgagctgccccaggagtgggagaacaacaaggacgccctgctgacctacctggagcaggtgagaatgggcatcgccggcgtggtgagagacaaggacaccgagctgggcatcgccgacgccgtgatcgccgtggacggcatcaaccacgacgtgaccaccgcctggggcggcgactactggagactgctgacccccggcgactacatggtgaccgccagcgccgagggctaccacagcgtgaccagaaactgcagagtgaccttcgaggagggccccttcccctgcaacttcgtgctgaccaagacccccaagcagagactgagagagctgctggccgccggcgccaaggtgccccccgacctgagaagaagactggagagactgagaggccagaaggactag

SEQ ID NO: 4537 - DNA, 1680 bp, Artificial Sequence; identical to SEQ ID NO: 3622
  Description of Artificial Sequence: Synthetic coding sequence

SEQ ID NO: 4538 - DNA, 8199 bp, Artificial Sequence
  Description of Artificial Sequence: Synthetic coding sequence
atggagcagaccgactgcaagccctaccagcccctgcccaaggtgaagcacgagatggacctggcctacaccagcagcagcgacgagagcgaggacggcagaaagcccagacagagctacaacagcagagagaccctgcacgagtacaaccaggagctgagaatgaactacaacagccagagcagaaagagaaaggaggtggagaagagcacccaggagatggagttctgcgagaccagccacaccctgtgcagcggctaccagaccgacatgcacagcgtgagcagacacggctaccagctggagatgggcagcgacgtggacaccgagaccgagggcgccgccagccccgaccacgccctgagaatgtggatcagaggcatgaagagcgagcacagcagctgcctgagcagcagagccaacagcgccctgagcctgaccgacaccgaccacgagagaaagagcgacggcgagaacggcttcaagttcagccccgtgtgctgcgacatggaggcccaggccggcagcacccaggacgtgcagagcagcccccacaaccagttcaccttcagacccctgccccccccccccccccccccccacgcctgcacctgcgccagaaagcccccccccgccgccgacagcctgcagagaagaagcatgaccaccagaagccagcccagccccgccgcccccgccccccccaccagcacccaggacagcgtgcacctgcacaacagctgggtgctgaacagcaacatccccctggagaccagacacttcctgttcaagcacggcagcggcagcagcgccatcttcagcgccgccagccagaactaccccctgaccagcaacaccgtgtacagccccccccccagacccctgcccagaagcaccttcagcagacccgccttcaccttcaacaagccctacagatgctgcaactggaagtgcaccgccctgagcgccaccgccatcaccgtgaccctggccctgctgctggcctacgtgatcgccgtgcacctgttcggcctgacctggcagctgcagcccgtggagggcgagctgtacgccaacggcgtgagcaagggcaacagaggcaccgagagcatggacaccacctacagccccatcggcggcaaggtgagcgacaagagcgagaagaaggtgttccagaagggcagagccatcgacaccggcgaggtggacatcggcgcccaggtgatgcagaccatcccccccggcctgttctggagattccagatcaccatccaccaccccatctacctgaagttcaacatcagcctggccaaggacagcctgctgggcatctacggcagaagaaacatcccccccacccacacccagttcgacttcgtgaagctgatggacggcaagcagctggtgaagcaggacagcaagggcagcgacgacacccagcacagccccagaaacctgatcctgaccagcctgcaggagaccggcttcatcgagtacatggaccagggcccctggtacctggccttctacaacgacggcaagaagatggagcaggtgttcgtgctgaccaccgccatcgagatcatggacgactgcagcaccaactgcaacggcaacggcgagtgcatcagcggccactgccactgcttccccggcttcctgggccccgactgcgccagagacagctgccccgtgctgtgcggcggcaacggcgagtacgagaagggccactgcgtgtgcagacacggctggaagggccccgagtgcgacgtgcccgaggagcagtgcatcgaccccacctgcttcggccacggcacctgcatcatgggcgtgtgcatctgcgtgcccggctacaagggcgagatctgcgaggaggaggactgcctggaccccatgtgcagcaaccacggcatctgcgtgaagggcgagtgccactgcagcaccggctggggcggcgtgaactgcgagacccccctgcccgtgtgccaggagcagtgcagcggccacggcaccttcctgctggacgccggcgtgtgcagctgcgaccccaagtggaccggcagcgactgcagcaccgagctgtgcaccatggagtgcggcagccacggcgtgtgcagcagaggcatctgccagtgcgaggagggctgggtgggccccacctgcgaggagagaagctgccacagccactgcaccgagcacggccagtgcaaggacggcaagtgcgagtgcagccccggctgggagggcgaccactgcaccatcgcccactacctggacgccgtgagagacggctgccccggcctgtgcttcggcaacggcagatgcaccctggaccagaacggctggcactgcgtgtgccaggtgggctggagcggcaccggctgcaacgtggtgatggagatgctgtgcggcgacaacctggacaacgacggcgacggcctgaccgactgcgtggaccccgactgctgccagcagagcaactgctacatcagccccctgtgccagggcagccccgaccccctggacctgatccagcagagccagaccctgttcagccagcacaccagcagactgttctacgacagaatcaagttcctgatcggcaaggacagcacccacgtgatcccccccgaggtgagcttcgacagcagaagagcctgcgtgatcagaggccaggtggtggccatcgacggcacccccctggtgggcgtgaacgtgagcttcctgcaccacagcgactacggcttcaccatcagcagacaggacggcagcttcgacctggtggccatcggcggcatcagcgtgatcctgatcttcgacagaagccccttcctgcccgagaagagaaccctgtggctgccctggaaccagttcatcgtggtggagaaggtgaccatgcagagagtggtgagcgacccccccagctgcgacatcagcaacttcatcagccccaaccccatcgtgctgcccagccccctgaccagcttcggcggcagctgccccgagagaggcaccatcgtgcccgagctgcaggtggtgcaggaggagatccccatccccagcagcttcgtgagactgagctacctgagcagcagaacccccggctacaagaccctgctgagaatcctgctgacccacagcaccatccccgtgggcatgatcaaggtgcacctgaccgtggccgtggagggcagactgacccagaagtggttccccgccgccatcaacctggtgtacaccttcgcctggaacaagaccgacatctacggccagaaggtgtggggcctggccgaggccctggtgagcgtgggctacgagtacgagacctgccccgacttcatcctgtgggagcagagaaccgtggtgctgcagggcttcgagatggacgccagcaacctgggcggctggagcctgaacaagcaccacatcctgaacccccagagcggcatcatccacaagggcaacggcgagaacatgttcatcagccagcagccccccgtgatcagcaccatcatgggcaacggccaccagagaagcgtggcctgcaccaactgcaacggccccgcccacaacaacaagctgttcgcccccgtggccctggccagcggccccgacggcagcgtgtacgtgggcgacttcaacttcgtgagaagaatcttccccagcggcaacagcgtgagcatcctggagctgagaaacagagacaccagacacagcaccagccccgcccacaagtactacctggccatggaccccgtgagcgagagcctgtacctgagcgacaccaacaccagaaaggtgtacaagctgaagagcctggtggagaccaaggacctgagcaagaacttcgaggtggtggccggcaccggcgaccagtgcctgcccttcgaccagagccactgcggcgacggcggcagagccagcgaggccagcctgaacagccccagaggcatcaccgtggacagacacggcttcatctacttcgtggacggcaccatgatcagaaagatcgacgagaacgccgtgatcaccaccgtgatcggcagcaacggcctgaccagcacccagcccctgagctgcgacagcggcatggacatcacccaggtgagactggagtggcccaccgacctggccgtgaaccccatggacaacagcctgtacgtgctggacaacaacatcgtgctgcagatcagcgagaacagaagagtgagaatcatcgccggcagacccatccactgccaggtgcccggcatcgaccacttcctggtgagcaaggtggccatccacagcaccctggagagcgccagagccatcagcgtgagccacagcggcctgctgttcatcgccgagaccgacgagagaaaggtgaacagaatccagcaggtgaccaccaacggcgagatctacatcatcgccggcgcccccaccgactgcgactgcaagatcgaccccaactgcgactgcttcagcggcgacggcggctacgccaaggacgccaagatgaaggcccccagcagcctggccgtgagccccgacggcaccctgtacgtggccgacctgggcaacgtgagaatcagaaccatcagcagaaaccaggcccacctgaacgacatgaacatctacgagatcgccagccccgccgaccaggagctgtaccagttcaccgtgaacggcacccacctgcacaccctgaacctgatcaccagagactacgtgtacaacttcacctacaacagcgagggcgacctgggcgccatcaccagcagcaacggcaacagcgtgcacatcagaagagacgccggcggcatgcccctgtggctggtggtgcccggcggccaggtgtactggctgaccatcagcagcaacggcgtgctgaagagagtgagcgcccagggctacaacctggccctgatgacctaccccggcaacaccggcctgctggccaccaagagcaacgagaacggctggaccaccgtgtacgagtacgaccccgagggccacctgaccaacgccaccttccccaccggcgaggtgagcagcttccacagcgacctggagaagctgaccaaggtggagctggacaccagcaacagagagaacgtgctgatgagcaccaacctgaccgccaccagcaccatctacatcctgaagcaggagaacacccagagcacctacagagtgaaccccgacggcagcctgagagtgaccttcgccagcggcatggagatcggcctgagcagcgagccccacatcctggccggcgccgtgaaccccaccctgggcaagtgcaacatcagcctgcccggcgagcacaacgccaacctgatcgagtggagacagagaaaggagcagaacaagggcaacgtgagcgccttcgagagaagactgagagcccacaacagaaacctgctgagcatcgacttcgaccacatcaccagaaccggcaagatctacgacgaccacagaaagttcaccctgagaatcctgtacgaccagaccggcagacccatcctgtggagccccgtgagcagatacaacgaggtgaacatcacctacagccccagcggcctggtgaccttcatccagagaggcacctggaacgagaagatggagtacgaccagagcggcaagatcatcagcagaacctgggccgacggcaagatctggagctacacctacctggagaagagcgtgatgctgctgctgcacagccagagaagatacatcttcgagtacgaccagcccgactgcctgctgagcgtgaccatgcccagcatggtgagacacagcctgcagaccatgctgagcgtgggctactacagaaacatctacaccccccccgacagcagcaccagcttcatccaggactacagcagagacggcagactgctgcagaccctgcacctgggcaccggcagaagagtgctgtacaagtacaccaagcaggccagactgagcgaggtgctgtacgacaccacccaggtgaccctgacctacgaggagagcagcggcgtgatcaagaccatccacctgatgcacgacggcttcatctgcaccatcagatacagacagaccggccccctgatcggcagacagatcttcagattcagcgaggagggcctggtgaacgccagattcgactacagctacaacaacttcagagtgaccagcatgcaggccgtgatcaacgagacccccctgcccatcgacctgtacagatacgtggacgtgagcggcagaaccgagcagttcggcaagttcagcgtgatcaactacgacctgaaccaggtgatcaccaccaccgtgatgaagcacaccaagatcttcagcgccaacggccaggtgatcgaggtgcagtacgagatcctgaaggccatcgcctactggatgaccatccagtacgacaacgtgggcagaatggtgatctgcgacatcagagtgggcgtggacgccaacatcaccagatacttctacgagtacgacgccgacggccagctgcagaccgtgagcgtgaacgacaagacccagtggagatacagctacgacctgaacggcaacatcaacctgctgagccacggcaagagcgccagactgacccccctgagatacgacctgagagacagaatcaccagactgggcgagatccagtacaagatggacgaggacggcttcctgagacagagaggcaacgacatcttcgagtacaacagcaacggcctgctgcagaaggcctacaacaaggccagcggctggaccgtgcagtactactacgacggcctgggcagaagagtggccagcaagagcagcctgggccagcacctgcagttcttctacgccgacctgaccaaccccatcagagtgacccacctgtacaaccacaccagcagcgagatcaccagcctgtactacgacctgcagggccacctgatcgccatggagctgagcagcggcgaggagtactacgtggcctgcgacaacaccggcacccccctggccgtgttcagcagcagaggccaggtgatcaaggagatcctgtacaccccctacggcgacatctaccacgacacctaccccgacttccaggtgatcatcggcttccacggcggcctgtacgacttcctgaccaagctggtgcacctgggccagagagactacgacgtggtggccggcagatggaccacccccaaccaccacatctggaagcagctgaacctgctgcccaagcccttcaacctgtacagcttcgagaacaactaccccgtgggcaagatccaggacgtggccaagtacaccaccgacatcagaagctggctggagctgttcggcttccagctgcacaacgtgctgcccggcttccccaagcccgagctggagaacctggagctgacctacgagctgctgagactgcagaccaagacccaggagtgggaccccggcaagaccatcctgggcatccagtgcgagctgcagaagcagctgagaaacttcatcagcctggaccagctgcccatgacccccagatacaacgacggcagatgcctggagggcggcaagcagcccagattcgccgccgtgcccagcgtgttcggcaagggcatcaagttcgccatcaaggacggcatcgtgaccgccgacatcatcggcgtggccaacgaggacagcagaagactggccgccatcctgaacaacgcccactacctggagaacctgcacttcaccatcgagggcagagacacccactacttcatcaagctgggcagcctggaggaggacctggtgctgatcggcaacaccggcggcagaagaatcctggagaacggcgtgaacgtgaccgtgagccagatgaccagcgtgctgaacggcagaaccagaagattcgccgacatccagctgcagcacggcgccctgtgcttcaacatcagatacggcaccaccgtggaggaggagaagaaccacgtgctggagatcgccagacagagagccgtggcccaggcctggaccaaggagcagagaagactgcaggagggcgaggagggcatcagagcctggaccgagggcgagaagcagcagctgctgagcaccggcagagtgcagggctacgacggctacttcgtgctgagcgtggagcagtacctggagctgagcgacagcgccaacaacatccacttcatgagacagagcgagatcggcagaagatag

SEQ ID NO: 4539 - DNA, 264 bp, Artificial Sequence
  Description of Artificial Sequence: Synthetic coding sequence
atgaaggtgctgctgctgaccggcctgggcgccctgttcttcgcctactactgggacgacaacttcgaccccgccagcctgcagggcgccagagtgctgctgaccggcgccaacgccggcgtgggcgaggagctggcctaccactacgccagactgggcagccacctggtgctgaccgcccacaccgaggccctgctgcagaaggccagatggctgaccctggtggtgagcaccctgggcggcagaggcaagtggatcacctag

SEQ ID NO: 4540 - DNA, 1233 bp, Artificial Sequence
  Description of Artificial Sequence: Synthetic coding sequence
atgagagcctgcatcagcctggtgctggccgtgctgtgcggcctggcctgggccggcaagatcgagagctgcgccagcagatgcaacgagaagttcaacagagacgccgcctgccagtgcgacagaagatgcctgtggcacggcaactgctgcgaggactacgagcacctgtgcaccgaggaccacaaggagagcgagcccctgccccagctggaggaggagaccgaggaggccctggccagcaacctgtacagcgcccccaccagctgccagggcagatgctacgaggccttcgacaagcaccaccagtgccactgcaacgccagatgccaggagttcggcaactgctgcaaggacttcgagagcctgtgcagcgaccacgaggtgagccacagcagcgacgccatcaccaaggaggagatccagagcatcagcgagaagatctacagagccgacaccaacaaggcccagaaggaggacatcgtgctgaacagccagaactgcatcagccccagcgagaccagaaaccaggtggacagatgccccaagcccctgttcacctacgtgaacgagaagctgttcagcaagcccacctacgccgccttcatcaacctgctgaacaactaccagagagccaccggccacggcgagcacttcagcgcccaggagctggccgagcaggacgccttcctgagagagatcatgaagaccgccgtgatgaaggagctgtacagcttcctgcaccaccagaacagatacggcagcgagcaggagttcgtggacgacctgaagaacatgtggttcggcctgtacagcagaggcaacgaggagggcgacagcagcggcttcgagcacgtgttcagcggcgaggtgaagaagggcaaggtgaccggcttccacaactggatcagattctacctggaggagaaggagggcctggtggactactacagccacatctacgacggcccctgggacagctaccccgacgtgctggccatgcagttcaactgggacggctactacaaggaggtgggcagcgccttcatcggcagcagccccgagttcgagttcgccctgtacagcctgtgcttcatcgccagacccggcaaggtgtgccagctgagcctgggcggctaccccctggccgtgagaacctacacctgggacaagagcacctacggcaacggcaagaagtacatcgccaccgcctacatcgtgagcagcacctag

SEQ ID NO: 4541 - DNA, 351 bp, Artificial Sequence; identical to SEQ ID NO: 4162
  Description of Artificial Sequence: Synthetic coding sequence

SEQ ID NO: 4542 - DNA, 1200 bp, Artificial Sequence
  Description of Artificial Sequence: Synthetic coding sequence
atgagcgccagaggcagatgggagggcggcggcagaagagcctgcagaggcagcctgggcctggccagagcccagggcgccgagagagtgaccagcagcgagcagagacccgccatggccagcctgggcctgctgctgctgctgctgctgaccgccctgccccccctgtggagcagcagcctgcccggcctggacaccgccgagagcaaggccaccatcgccgacctgatcctgagcgccctggagagagccaccgtgttcctggagcagagactgcccgagatcaacctggacggcatggtgggcgtgagagtgctggaggagcagctgaagagcgtgagagagaagtgggcccaggagcccctgctgcagcccctgagcctgagagtgggcatgctgggcgagaagctggaggccgccatccagagaagcctgcactacctgaagctgagcgaccccaagtacctgagagagttccagctgaccctgcagcccggcttctggaagctgccccacgcctggatccacaccgacgccagcctggtgtaccccaccttcggcccccaggacagcttcagcgaggagagaagcgacgtgtgcctggtgcagctgctgggcaccggcaccgacagcagcgagccctgcggcctgagcgacctgtgcagaagcctgatgaccaagcccggctgcagcggctactgcctgagccaccagctgctgttcttcctgtgggccagaatgagaggctgcacccagggccccctgcagcagagccaggactacatcaacctgttctgcgccaacatgatggacctgaacagaagagccgaggccatcggctacgcctaccccaccagagacatcttcatggagaacatcatgttctgcggcatgggcggcttcagcgacttctacaagctgagatggctggaggccatcctgagctggcagaagcagcaggagggctgcttcggcgagcccgacgccgaggacgaggagctgagcaaggccatccagtaccagcagcacttcagcagaagagtgaagagaagagagaagcagttccccgacggctgcagcagccacaacaccgccaccgccgtggccgccctgggcggcttcctgtacatcctggccgagtacccccccgccaacagagagccccaccccagcaccccccccccccccagcagcagatag

SEQ ID NO: 4543 - DNA, 510 bp, Artificial Sequence
  Description of Artificial Sequence: Synthetic coding sequence
atgctgagcagcgtggtgttctggggcctgatcgccctgatcggcaccagcagaggcagctaccccttcagccacagcatgaagccccacctgcaccccagactgtaccacggctgctacggcgacatcatgaccatgaagaccagcggcgccacctgcgacgccaacagcgtgatgaactgcggcatcagaggcagcgagatgttcgccgagatggacctgagagccatcaagccctaccagaccctgatcaaggaggtgggccagagacactgcgtggaccccgccgtgatcgccgccatcatcagcagagagagccacggcggcagcgtgctgcaggacggctgggaccacagaggcctgaagttcggcctgatgcagctggacaagcagacctaccaccccgtgggcgcctgggacagcaaggagcacctgagccaggccaccggcatcctgaccgagagaatcaaggccatccagaagaagttccccacctggagcgtggcctag

SEQ ID NO: 4544 - DNA, 300 bp, Artificial Sequence
  Description of Artificial Sequence: Synthetic coding sequence
atggagagaatcagcgccttcttcagcagcatctgggacaccatcctgaccaagcaccaggagggcatctacaacaccatctgcctgggcgtgctgctgggcctgcccctgctggtgatcatcaccctgctgttcatctgctgccactgctgctggagcccccccggcaagagaggccagcagcccgagaagaacaagaagaagaagaagaagaagaagaagaaggacgaggaggacctgtggatcagcgcccagcccaagctgctgcagatggagaagagacccagcctgcccgtgtag

SEQ ID NO: 4545 - DNA, 468 bp, Artificial Sequence
  Description of Artificial Sequence: Synthetic coding sequence
atgaccagcctgaagtgcggcgagaacctgtacatgagcagcgccagcagcagctggagccaggccatccagagctggttcgacgagtacaacgacttcgacttcggcgtgggccccaagacccccaacgccgtggtgggccactacacccaggtggtgtggtacagcagctacctggtgggctgcggcaacgcctactgccccaaccagaaggtgctgaagtactactacgtgtgccagtactgccccgccggcaactgggccaacagactgtacgtgccctacgagcagggcgccccctgcgccagctgccccgacaactgcgacgacggcctgtgcaccaacggctgcaagtacgaggacctgtacagcaactgcaagagcctgaagctgaccctgacctgcaagcaccagctggtgagagacagctgcaaggccagctgcaactgcagcaacagcatctactag

SEQ ID NO: 4546 - DNA, 2886 bp, Artificial Sequence; identical to SEQ ID NO: 4184
  Description of Artificial Sequence: Synthetic coding sequence

SEQ ID NO: 4547 - DNA, 444 bp, Artificial Sequence
  Description of Artificial Sequence: Synthetic coding sequence
atggccggcccctggaccttcaccctgctgtgcggcctgctggccgccaccctgatccaggccaccctgagccccaccgccgtgctgatcctgggccccaaggtgatcaaggagaagctgacccaggagctgaaggaccacaacgccaccagcatcctgcagcagctgcccctgctgagcgccatgagagagaagcccgccggcggcatccccgtgctgggcagcctggtgaacaccgtgctgaagcacatcatctggctgaaggtgatcaccgccaacatcctgcagctgcaggtgaagcccagcgccaacgaccaggagctgctggtgaagatccccctggacatggtggccggcttcaacacccccctggtgaagaccatcgtggagttccacatgaccaccgaggcccaggccaccatcagaatggacaccagcgcctag

SEQ ID NO: 4548 - DNA, 948 bp, Artificial Sequence
  Description of Artificial Sequence: Synthetic coding sequence
atgaaggtgctgctgctgaccggcctgggcgccctgttcttcgcctactactgggacgacaacttcgaccccgccagcctgcagggcgccagagtgctgctgaccggcgccaacgccggcgtgggcgaggagctggcctaccactacgccagactgggcagccacctggtgctgaccgcccacaccgaggccctgctgcagaaggtggtgggcaactgcagaaagctgggcgcccccaaggtgttctacatcgccgccgacatggccagccccgaggcccccgagagcgtggtgcagttcgccctggacaagctgggcggcctggactacctggtgctgaaccacatcggcggcgcccccgccggcaccagagccagaagcccccaggccaccagatggctgatgcaggtgaacttcgtgagctacgtgcagctgaccagcagagccctgcccagcctgaccgacagcaagggcagcctggtggtggtgagcagcctgctgggcagagtgcccaccagcttcagcaccccctacagcgccgccaagttcgccctggacggcttcttcggcagcctgagaagagagctggacgtgcaggacgtgaacgtggccatcaccatgtgcgtgctgggcctgagagacagagccagcgccgccgaggccgtgagaagcagcaccagcagacccagacagcccgagcacagaggcgtgcccctgcagagccagaccgccatgttcctgccccccaccgtgcccggcgccagaaccctgaccgagacccccctgagaggctggccccagcccaagatgaagagcagcagacagaagagcaagaccgagaagaacgacggccacctggagcccgtgaccgcctgggaggtgcaggtgcccagagtgagaagactgtgcagaggcctggccagaccccacctgttcggccacgactag

SEQ ID NO: 4549 - DNA, 285 bp, Artificial Sequence; identical to SEQ ID NO: 3803
  Description of Artificial Sequence: Synthetic coding sequence

SEQ ID NO: 4550 - DNA, 783 bp, Artificial Sequence
  Description of Artificial Sequence: Synthetic coding sequence
atggagaagttcaacaccatcagcgtgagcaagtgcaacaaggagaccgtggccatgaaggagaagtgcaagttcggcatgaccagcaccatccccagcggccacgtgtggagaaacacctggaaccccgtgagctgcagcctggccaccgtgaagatgaaggagtgcctgagaggcaagctgatctacctgatgggcgacagcaccatcagacagtggatggagtacttcaaggccagcatcaacaccctgaagagcgtggacctgcacgagagcggcaagctgcagcaccagctggccgtggacctggacagaaacatcaacatccagtggcagaagtactgctaccccctgatcggcagcatgacctacagcgtgaaggagatggagtacctgaccagagccatcgacagaaccggcggcgagaagaacaccgtgatcgtgatcagcctgggccagcacttcagacccttccccatcgacgtgttcatcagaagagccctgaacgtgcacaaggccatccagcacctgctgctgagaagccccgacaccatggtgatcatcaagaccgagaacatcagagagatgtacaacgacgccgagagattcagcgacttccacggctacatccagtacctgatcatcaaggacatcttccaggacctgagcgtgagcatcatcgacgcctgggacatcaccatcgcctacggcaccaacaacgtgcaccccccccagcacgtggtgggcaaccagatcaacatcctgctgaactacatctgctag

SEQ ID NO: 4551 - DNA, 1644 bp, Artificial Sequence
  Description of Artificial Sequence: Synthetic coding sequence
atgagcagcaacaccatgctgcagaagaccctgctgatcctgatcagcttcagcgtggtgacctggatgatcttcatcatcagccagaacttcaccaagctgtggagcgccctgaacctgagcatcagcgtgcactactggaacaacagcgccaagagcctgttccccaagaccagcctgatccccctgaagcccctgaccgagaccgagctgagaatcaaggagatcatcgagaagctggaccagcagatcccccccagacccttcacccacgtgaacaccaccaccagcgccacccacagcaccgccaccatcctgaaccccagagacacctactgcagaggcgaccagctggacatcctgctggaggtgagagaccacctgggccagagaaagcagtacggcggcgacttcctgagagccagaatgagcagccccgccctgaccgccggcgccagcggcaaggtgatggacttcaacaacggcacctacctggtgagcttcaccctgttctgggagggccaggtgagcctgagcctgctgctgatccaccccagcgagggcgccagcgccctgtggagagccagaaaccagggctacgacaagatcatcttcaagggcaagttcgtgaacggcaccagccacgtgttcaccgagtgcggcctgaccctgaacagcaacgccgagctgtgcgagtacctggacgacagagaccaggaggccttctactgcatgaagccccagcacatgccctgcgaggccctgacctacatgaccaccagaaacagagaggtgagctacctgaccgacaaggagaacagcctgttccacagaagcaaggtgggcgtggagatgatgaaggacagaaagcacatcgacgtgaccaactgcaacaagagagagaagatcgaggagacctgccaggtgggcatgaagccccccgtgcccggcggctacaccctgcagggcaagtggatcaccaccttctgcaaccaggtgcagctggacaccatcaagatcaacggctgcctgaagggcaagctgatctacctgctgggcgacagcaccctgagacagtggatctactacttccccaaggtggtgaagaccctgaagttcttcgacctgcacgagaccggcatcttcaagaagcacctgctgctggacgccgagagacacacccagatccagtggaagaagcacagctaccccttcgtgaccttccagctgtacagcctgatcgaccacgactacatccccagagagatcgacagactgagcggcgacaagaacaccgccatcgtgatcaccttcggccagcacttcagacccttccccatcgacatcttcatcagaagagccatcggcgtgcagaaggccatcgagagactgttcctgagaagccccgccaccaaggtgatcatcaagaccgagaacatcagagagatgcacatcgagaccgagagattcggcgacttccacggctacatccactacctgatcatgaaggacatcttcaaggacctgaacgtgggcatcatcgacgcctgggacatgaccatcgcctacggcaccgacaccatccacccccccgaccacgtgatcggcaaccagatcaacatgttcctgaactacatctgctag

SEQ ID NO: 4552 - DNA, 399 bp, Artificial Sequence
  Description of Artificial Sequence: Synthetic coding sequence
atgctgatgctgttcgtgttcggcgtgctgctgcacgaggtgagcctgagcggccagaacgaggccccccccaacacccacagcatccccggcgagcccctgtacaactacgccagcatcagactgcccgaggagcacatccccttcttcctgcacaacaacagacacatcgccaccgtgtgcagaaaggacagcctgtgcccctacaagaagcacctggagaagctgaagtactgctggggctacgagaagagctgcaagcccgagttcagattcggctaccccgtgtgcagctacgtggacatgggctggaccgacaccctggagagcgccgaggacatcttctggaagcaggccgacttcggctacgccagagagagactggaggagatgcactag

SEQ ID NO: 4553 - DNA, 861 bp, Artificial Sequence
  Description of Artificial Sequence: Synthetic coding sequence
atgggcagcgccctgttcgtgaagaaggagctgcagctgcaggccaacttcctgggcaacgtgaagagactgtacgaggccgaggtgttcagcaccgacttcagcaaccccagcatcgcccaggccagaatcaacagccacgtgaagaagaagacccagggcaaggtggtggacatcatccagggcctggacctgctgaccgccatggtgctggtgaaccacatcttcttcaaggccaagtgggagaagcccttccaccccgagtacaccagaaagaacttccccttcctggtgggcgagcaggtgaccgtgcacgtgcccatgatgcaccagaaggagcagttcgccttcggcgtggacaccgagctgaactgcttcgtgctgcagatggactacaagggcgacgccgtggccttcttcgtgctgcccagcaagggcaagatgagacagctggagcaggccctgagcgccagaaccctgagaaagtggagccacagcctgcagaagagatggatcgaggtgttcatccccagattcagcatcagcgccagctacaacctggagaccatcctgcccaagatgggcatccagaacgtgttcgacaagaacgccgacttcagcggcatcgccaagagagacagcctgcaggtgagcaaggccacccacaaggccgtgctggacgtgagcgaggagggcaccgaggccaccgccgccaccaccaccaagttcatcgtgagaagcaaggacggccccagctacttcaccgtgagcttcaacagaaccttcctgatgatgatcaccaacaaggccaccgacggcatcctgttcctgggcaaggtggagaaccccaccaagagctag

SEQ ID NO: 4554 - DNA, 60 bp, Artificial Sequence
  Description of Artificial Sequence: Synthetic coding sequence
atgggctggctgaccagaatcgtgtgcctgttctggggcgtgctgctgaccgccagatag

SEQ ID NO: 4555 - DNA, 1197 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcggcagcggcagccagagcggcagcagcggcagcggcagcaacggcgacaacaacaacggcagcagcagcggcggcagcagcagcggcagcagcagcggcggcagcagcggcggcagcagcggcggcagcagcggcaacagcggcggcagcagaggcgacagcggcagcgagagcagctggggcagcagcaccggcagcagcagcggcaaccacggcggcagcggcggcggcaacggccacaagcccggctgcgagaagcccggcaacgaggccagaggcagcggcgagagcggcatccagggcttcagaggccagggcgtgagcagcaacatgagaaacagcgagaccagccccggcatgttcaacttcgacaccttctggaagaacttcaagagcaagctgggcttcatcaactgggacgccatcaacaaggaccagagaagcagcagaatcccctag

SEQ ID NO: 4556 - DNA, 81 bp, Artificial Sequence
  Description of Artificial Sequence: Synthetic coding sequence
atggcccccaagaagctgagctgcctgagaagcctgctgctgcccctgagcctgaccctgctgctgccccaggccgactag

SEQ ID NO: 4557 - DNA, 696 bp, Artificial Sequence
  Description of Artificial Sequence: Synthetic coding sequence
atggcccagctgttcctgcccctgctggccgccctggtgctggcccaggcccccgccgccctggccgacgtgctggagggcgacagcagcggcatctacagatgcgaggtgcagcacggcatcgacgacagcagcgacgccgtggaggtgaaggtgaagggcgtggtgttcctgtacagagagggcagcgccagatacgccttcagcttcagcggcgcccaggaggcctgcgccagaatcggcgcccacatcgccacccccgagcagctgtacgccgcctacctgggcggctacgagcagtgcgacgccggctggctgagcgaccagaccgtgagataccccatccagacccccagagaggcctgctacggcgacatggacggcttccccggcgtgagaaactacggcgtggtggaccccgacgacctgtacgacgtgtactgctacgccgaggacctgaacggcgagctgttcctgggcgacccccccgagaagctgaccctggaggaggccagagcctactgccaggagagaggcgccgagatcgccaccaccggccagctgtacgccgcctgggacggcggcctggaccactgcagccccggctggctggccgacggcagcgtgagataccccatcgtgacccccagccagagatgcggcggcggcctgcccggcgtgaagaccctgttctag

SEQ ID NO: 4558 - DNA, 600 bp, Artificial Sequence
  Description of Artificial Sequence: Synthetic coding sequence
atggacgagctgctgcccctgatccccgtgctggagcagtacaagaccgacgccaagctgatcacccagttcaaggaggagatcagaaacctgagcgccgtgctgaccggcatccaggaggagatcggcgcctacgactacgaggagctgcaccagagagtgctgagcctggagaccagactgagagactgcatgaagaagctgacctgcggcaagctgatgaagatcaccggccccgtgaccgtgaagaccagcggcaccagattcggcgcctggatgaccgaccccctggccagcgagaagaacaacagagtgtggtacatggacagctacaccaacaacaagatcgtgagagagtacaagagcatcgccgacttcgtgagcggcgccgagagcagaacctacaacctgcccttcaagtgggccggcaccaaccacgtggtgtacaacggcagcctgtacttcaacaagtaccagagcaacatcatcatcaagtacagcttcgacatgggcagagtgctggcccagagaagcctggagtacgccggcttccacaacgtgacccccacccacggcgtggacagcctgaccagcacctag

SEQ ID NO: 4559 - DNA, 609 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacacctag

SEQ ID NO: 4560 - DNA, 2886 bp, Artificial Sequence; identical to SEQ ID NO: 4184
  Description of Artificial Sequence: Synthetic coding sequence

SEQ ID NO: 4561 - DNA, 351 bp, Artificial Sequence; identical to SEQ ID NO: 4162
  Description of Artificial Sequence: Synthetic coding sequence

SEQ ID NO: 4562 - DNA, 2334 bp, Artificial Sequence
  Description of Artificial Sequence: Synthetic coding sequence
atggccgccgccggcctggtggccgtggccgccgccgccgagtacagcggcaccgtggccagcggcggcaacctgcccggcgtgcactgcggccccagcagcggcgccggccccggcttcggccccggcagctggagcagaagcctggacagagccctggaggaggccgccgtgaccggcgtgctgagcctgagcggcagaaagctgagagagttccccagaggcgccgccaaccacgacctgaccgacaccaccagagccgacctgagcagaaacagactgagcgagatccccatcgaggcctgccacttcgtgagcctggagaacctgaacctgtaccagaactgcatcagatacatccccgaggccatcctgaacctgcaggccctgaccttcctgaacatcagcagaaaccagctgagcaccctgcccgtgcacctgtgcaacctgcccctgaaggtgctgatcgccagcaacaacaagctggtgagcctgcccgaggagatcggccacctgagacacctgatggagctggacgtgagctgcaacgagatccagaccatccccagccagatcggcaacctggaggccctgagagacctgaacgtgagaagaaaccacctggtgcacctgcccgaggagctggccgagctgcccctgatcagactggacttcagctgcaacaagatcaccaccatccccgtgtgctacagaaacctgagacacctgcagaccatcaccctggacaacaaccccctgcagagcccccccgcccagatctgcatcaagggcaaggtgcacatcttcaagtacctgaacatccaggcctgcaagatcgcccccgacctgcccgactacgacagaagacccctgggcttcggcagctgccacgaggagctgtacagcagcagaccctacggcgccctggacagcggcttcaacagcgtggacagcggcgacaagagatggagcggcaacgagcccaccgacgagttcagcgacctgcccctgagagtggccgagatcaccaaggagcagagactgagaagagagagccagtaccaggagaacagaggcagcctggtggtgaccaacggcggcgtggagcacgacctggaccagatcgactacatcgacagctgcaccgccgaggaggaggaggccgaggtgagacagcccaagggccccgaccccgacagcctgagcagccagttcatggcctacatcgagcagagaagaatcagccacgagggcagccccgtgaagcccgtggccatcagagagttccagaagaccgaggacatgagaagatacctgcaccagaacagagtgcccgccgagcccagcagcctgctgagcctgagcgccagccacaaccagctgagccacaccgacctggagctgcaccagagaagagagcagctggtggagagaaccagaagagaggcccagctggccgccctgcagtacgaggaggagaagatcagaaccaagcagatccagagagacgccgtgctggacttcgtgaagcagaaggccagccagagcccccagaagcagcaccccctgctggacggcgtggacggcgagtgccccttccccagcagaagaagccagcacaccgacgacagcgccctgtgcatgagcctgagcggcctgaaccaggtgggctgcgccgccaccctgccccacagcagcgccttcacccccctgaagagcgacgacagacccaacgccctgctgagcagccccgccaccgagaccgtgcaccacagccccgcctacagcttccccgccgccatccagagaaaccagccccagagacccgagagcttcctgttcagagccggcgtgagagccgagaccaacaagggccacgccagccccctgccccccagcgccgcccccaccaccgacagcaccgacagcatcaccggccagaacagcagacagagagaggaggagctggagctgatcgaccagctgagaaagcacatcgagtacagactgaaggtgagcctgccctgcgacctgggcgccgccctgaccgacggcgtggtgctgtgccacctggccaaccacgtgagacccagaagcgtgcccagcatccacgtgcccagccccgccgtgcccaagctgaccatggccaagtgcagaagaaacgtggagaacttcctggaggcctgcagaaagatcggcgtgccccaggagcagctgtgcctgcccctgcacatcctggaggagaagggcctgagccaggtggccgtgaccgtgcaggccctgctggagctggccccccccaagcagcagcagcaccagctgagcgccgtgtag

SEQ ID NO: 4563 - DNA, 834 bp, Artificial Sequence
  Description of Artificial Sequence: Synthetic coding sequence
atgctgcaccccgagaccagccccggcagaggccacctgctggccgtgctgctggccctgctgggcaccacctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactgctggtgtgggccaccagcagccagctgggctgcggcagacacctgtgcagcgccggccagaccgccatcgaggccttcgtgtgcgcctacagccccggcggcaactgggaggtgaacggcaagaccatcatcccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccagggccacctgcccaacagcaacatgccccacagcgccatgggcaccaagcccaagacccccggcgtgcccgccatcggcagcctggtgagatgcagcctgcagtgcgtgcacggcagattcagagaggaggagtgcagctgcgtgtgcgacatcggctacggcggcgcccagtgcgccagcgagagctgccccagagcccccaaggagcccgcccccctgaagacccccctgcagtggggcatcagcagccaggagcccgccgtgtgcctgagcttccagctgatccagtag

SEQ ID NO: 4564 - DNA, 456 bp, Artificial Sequence
  Description of Artificial Sequence: Synthetic coding sequence
atgagcgacctgctgctgctgggcctgatcggcggcctgaccctgctgctgctgctgaccctgctggccttcgccggctacagcggcctgctggccggcgtggaggtgagcgccggcagcccccccatcagaaacgtgaccgtggcctacaagttccacatgggcctgtacggcgagaccggcagactgttcaccgagagctgcagcatcagccccaagctgagaagcatcgccgtgtactacgacaacccccacatggtgccccccgacaagtgcagatgcgccgtgggcagcatcctgagcgagggcgaggagagccccagccccgagctgatcgacctgtaccagaagttcggcttcaaggtgttcagcttccccgcccccagccacgtggtgaccgccaccttcccctacaccaccatcctgagcatctggctggccaccagaagagtgtag

SEQ ID NO: 4565 - DNA, 390 bp, Artificial Sequence; identical to SEQ ID NO: 4161
  Description of Artificial Sequence: Synthetic coding sequence

SEQ ID NO: 4566 - DNA, 390 bp, Artificial Sequence; identical to SEQ ID NO: 4161
  Description of Artificial Sequence: Synthetic coding sequence

SEQ ID NO: 4567 - DNA, 891 bp, Artificial Sequence
  Description of Artificial Sequence: Synthetic coding sequence
atggaggccctgctgctgggcgccggcctgctgctgggcgcctacgtgctggtgtactacaacctggtgaaggcccccccctgcggcggcatgggcaacctgagaggcagaaccgccgtggtgaccggcatcagcagctgcggcagaaccagagaggccttcaacctgctgctgagagtgaaccacatcggccccttcctgctgacccacctgctgctgccctgcctgaaggcctgcgcccccagcagagtggtggtggtggccagcgccgcccactgcagaggcagactggacttcaagagactggacagacccgtggtgggctggagacaggagctgagagcctacgccgacaccaagctggccaacgtgctgttcgccagagagctggccaaccagctggaggccaccggcgtgacctgctacgccgcccaccccggccccgtgaacagcgagctgttcctgagacacgtgcccggctggctgagacccctgctgagacccctggcctggctggtgctgagagcccccagaggcggcgcccagacccccctgtactgcgccctgcaggagggcatcgagcccctgagcggcagatacttcgccaactgccacgtggaggaggtgccccccgccgccagagacgacagagccgcccacagactgtgggaggccagcaagagactggccggcctgggccccggcgaggacgccgagcccgacgaggacccccagagcgaggacagcgaggcccccagcagcctgagcaccccccaccccgaggagcccaccgtgagccagccctaccccagcccccagagcagccccgacctgagcaagatgacccacagaatccaggccaaggtggagcccgagatccagctgagctag

SEQ ID NO: 4568 - DNA, 567 bp, Artificial Sequence; identical to SEQ ID NO: 4160
  Description of Artificial Sequence: Synthetic coding sequence

SEQ ID NO: 4569 - DNA, 978 bp, Artificial Sequence; identical to SEQ ID NO: 3582
  Description of Artificial Sequence: Synthetic coding sequence

SEQ ID NO: 4570 - DNA, 2631 bp, Artificial Sequence; identical to SEQ ID NO: 3583
  Description of Artificial Sequence: Synthetic coding sequence

SEQ ID NO: 4571 - DNA, 1482 bp, Artificial Sequence
  Description of Artificial Sequence: Synthetic coding sequence
atggccctgctggccggcggcctgagcagaggcctgggcagccaccccgccgccgccggcagagacgccgtggtgttcgtgtggctgctgctgagcacctggtgcaccgcccccgccagagccatccaggtgaccgtgagcaacccctaccacgtggtgatcctgttccagcccgtgaccctgccctgcacctaccagatgaccagcacccccacccagcccatcgtgatctggaagtacaagagcttctgcagagacagaatcgccgacgccttcagccccgccagcgtggacaaccagctgaacgcccagctggccgccggcaaccccggctacaacccctacgtggagtgccaggacagcgtgagaaccgtgagagtggtggccaccaagcagggcaacgccgtgaccctgggcgactactaccagggcagaagaatcaccatcaccggcatgtacgccgccggcaaggccgccaccagcggcgtgcccagcatctacgcccccagcacctacgcccacctgagccccgccaagaccccccccccccccgccatgatccccatgggccccgcctacaacggctaccccggcggctaccccggcgacgtggacagaagcagcagcgccggcggccagggcagctacgtgcccctgctgagagacaccgacagcagcgtggccagcgaggtgagaagcggctacagaatccaggccagccagcaggacgacagcatgagagtgctgtactacatggagaaggagctggccaacttcgaccccagcagacccggcccccccagcggcagagtggagagagccatgagcgaggtgaccagcctgcacgaggacgactggagaagcagacccagcagaggccccgccctgacccccatcagagacgaggagtggggcggccacagccccagaagccccagaggctgggaccaggagcccgccagagagcaggccggcggcggctggagagccagaagacccagagccagaagcgtggacgccctggacgacctgaccccccccagcaccgccgagagcggcagcagaagccccaccagcaacggcggcagaagcagagcctacatgccccccagaagcagaagcagagacgacctgtacgaccaggacgacagcagagacttccccagaagcagagacccccactacgacgacttcagaagcagagagagaccccccgccgaccccagaagccaccaccacagaaccagagaccccagagacaacggcagcagaagcggcgacctgccctacgacggcagactgctggaggaggccgtgagaaagaagggcagcgaggagagaagaagaccccacaaggaggaggaggaggaggcctactacccccccgccccccccccctacagcgagaccgacagccaggccagcagagagagaagactgaagaagaacctggccctgagcagagagagcctggtggtgtag

SEQ ID NO: 4572 - DNA, 1788 bp, Artificial Sequence
  Description of Artificial Sequence: Synthetic coding sequence
atggacttcctgctggccctggtgctggtgagcagcctgtacctgcaggccgccgccgagttcgacggcagatggcccagacagatcgtgagcagcatcggcctgtgcagatacggcggcagaatcgactgctgctggggctgggccagacagagctggggccagtgccagcccgtgtgccagcccagatgcaagcacggcgagtgcatcggccccaacaagtgcaagtgccaccccggctacgccggcaagacctgcaaccaggacgagcacatccccgcccccctggaccagggcagcgagcagcccctgttccagcccctggaccaccaggccaccagcctgcccagcagagacctgaacgagtgcggcctgaagcccagaccctgcaagcacagatgcatgaacacctacggcagctacaagtgctactgcctgaacggctacatgctgatgcccgacggcagctgcagcagcgccctgacctgcagcatggccaactgccagtacggctgcgacgtggtgaagggccagatcagatgccagtgccccagccccggcctgcagctggcccccgacggcagaacctgcgtggacgtggacgagtgcgccaccggcagagccagctgccccagattcagacagtgcgtgaacaccttcggcagctacatctgcaagtgccacaagggcttcgacctgatgtacatcggcggcaagtaccagtgccacgacatcgacgagtgcagcctgggccagtaccagtgcagcagcttcgccagatgctacaacatcagaggcagctacaagtgcaagtgcaaggagggctaccagggcgacggcctgacctgcgtgtacatccccaaggtgatgatcgagcccagcggccccatccacgtgcccaagggcaacggcaccatcctgaagggcgacaccggcaacaacaactggatccccgacgtgggcagcacctggtggccccccaagaccccctacatcccccccatcatcaccaacagacccaccagcaagcccaccaccagacccacccccaagcccacccccatccccaccccccccccccccccccccctgcccaccgagctgagaacccccctgccccccaccacccccgagagacccaccaccggcctgaccaccatcgcccccgccgccagcaccccccccggcggcatcaccgtggacaacagagtgcagaccgacccccagaagcccagaggcgacgtgttcatccccagacagcccagcaacgacctgttcgagatcttcgagatcgagagaggcgtgagcgccgacgacgaggccaaggacgaccccggcgtgctggtgcacagctgcaacttcgaccacggcctgtgcggctggatcagagagaaggacaacgacctgcactgggagcccatcagagaccccgccggcggccagtacctgaccgtgagcgccgccaaggcccccggcggcaaggccgccagactggtgctgcccctgggcagactgatgcacagcggcgacctgtgcctgagcttcagacacaaggtgaccggcctgcacagcggcaccctgcaggtgttcgtgagaaagcacggcgcccacggcgccgccctgtggggcagaaacggcggccacggctggagacagacccagatcaccctgagaggcgccgacatcaagagcgtggtgttcaagggcgagaagagaagaggccacaccggcgagatcggcctggacgacgtgagcctgaagaagggccactgcagcgaggagagatag

SEQ ID NO: 4573 - DNA, 210 bp, Artificial Sequence
  Description of Artificial Sequence: Synthetic coding sequence
atgaagaaccaggacaagaagaacggcgccgccaagcagagcaaccccaagagcagccccggccagcccgaggccggcagcttcgacagcctggacctggagaaggtgagcctgggcagagccctggccggcagaagcgagctgggcatcagctgcctggagcagggcacctggagaatgttcctgagaggcatgatgtgctggagctag

SEQ ID NO: 4574 - DNA, 483 bp, Artificial Sequence
  Description of Artificial Sequence: Synthetic coding sequence
atggccagagactacgaccacctgttcaagctgctgatcatcggcgacagcggcgtgggcaagagcagcctgctgctgagattcgccgacaacaccttcagcggcagctacatcaccaccatcggcgtggacttcaagatcagaaccgtggagatcaacggcgagaaggtgaagctgcagatctgggacaccgccggccaggagagattcagaaccatcaccagcaccgccgagaccgccctgagaagcctgccccagcccgaggcccacggcggcagcagcggcgacagcctgagcttcgtgcccctgttcaaggagttcagcccctgcttctgcatcggcagatgccacagacacttcctgcccagaccccccagagtgcccagaagatgctggaccagcccccccttccccaccggcgcccccagcagccccgccaaggcccccggccccggcgaggacgccgccagaagagccgactag

SEQ ID NO: 4575 - DNA, 360 bp, Artificial Sequence; identical to SEQ ID NO: 3899
  Description of Artificial Sequence: Synthetic coding sequence

SEQ ID NO: 4576 - DNA, 2514 bp, Artificial Sequence
  Description of Artificial Sequence: Synthetic coding sequence
atgttcaagtgctggagcgtggtgctggtgctgggcttcatcttcctggagagcgagggcagacccaccaaggagggcggctacggcctgaagagctaccagcccctgatgagactgagacacaaggagaagaaccaggagagcagcagagtgaagggcttcatgatccaggacggccccttcggcagctgcgagaacaagtactgcggcctgggcagacactgcgtgaccagcagagagaccggccaggccgagtgcgcctgcatggacctgtgcaagagacactacaagcccgtgtgcggcagcgacggcgagttctacgagaaccactgcgaggtgcacagagccgcctgcctgaagaagcagaagatcaccatcgtgcacaacgaggactgcttcttcaagggcgacaagtgcaagaccaccgagtacagcaagatgaagaacatgctgctggacctgcagaaccagaagtacatcatgcaggagaacgagaaccccaacggcgacgacatcagcagaaagaagctgctggtggaccagatgttcaagtacttcgacgccgacagcaacggcctggtggacatcaacgagctgacccaggtgatcaagcaggaggagctgggcaaggacctgttcgactgcaccctgtacgtgctgctgaagtacgacgacttcaacgccgacaagcacctggccctggaggagttctacagagccttccaggtgatccagctgagcctgcccgaggaccagaagctgagcatcaccgccgccaccgtgggccagagcgccgtgctgagctgcgccatccagggcaccctgagaccccccatcatctggaagagaaacaacatcatcctgaacaacctggacctggaggacatcaacgacttcggcgacgacggcagcctgtacatcaccaaggtgaccaccacccacgtgggcaactacacctgctacgccgacggctacgagcaggtgtaccagacccacatcttccaggtgaacgtgccccccgtgatcagagtgtaccccgagagccaggccagagagcccggcgtgaccgccagcctgagatgccacgccgagggcatccccaagccccagctgggctggctgaagaacggcatcgacatcacccccaagctgagcaagcagctgaccctgcaggccaacggcagcgaggtgcacatcagcaacgtgagatacgaggacaccggcgcctacacctgcatcgccaagaacgaggccggcgtggacgaggacatcagcagcctgttcgtggaggacagcgccagaaagaccagactgggcatcggcaacatgttctacgtgttctacgaggacggcatcaaggtgatccagcccatcgagtgcgagttccagagacacatcaagcccagcgagaagctgctgggcttccaggacgaggtgtgccccaaggccgagggcgacgaggtgcagagatgcgtgtgggccagcgccgtgaacgtgaaggacaagttcatctacgtggcccagcccaccctggacagagtgctgatcgtggacgtgcagagccagaaggtggtgcaggccgtgagcaccgaccccgtgcccgtgaagctgcactacgacaagagccacgaccaggtgtgggtgctgagctggggcaccctggagaagaccagccccaccctgcaggtgatcaccctggccagcggcaacgtgccccaccacaccatccacacccagcccgtgggcaagcagttcgacagagtggacgacttcttcatccccaccaccaccctgatcatcacccacatgagattcggcttcatcctgcacaaggacgaggccgccctgcagaagatcgacctggagaccatgagctacatcaagaccatcaacctgaaggactacaagtgcgtgccccagagcctggcctacacccacctgggcggctactacttcatcggctgcaagcccgacagcaccggcgccgtgagcccccaggtgatggtggacggcgtgaccgacagcgtgatcggcttcaacagcgacgtgaccggcaccccctacgtgagccccgacggccactacctggtgagcatcaacgacgtgaagggcctggtgagagtgcagtacatcaccatcagaggcgagatccaggaggccttcgacatctacaccaacctgcacatcagcgacctggccttccagcccagcttcaccgaggcccaccagtacaacatctacggcagcagcagcacccagaccgacgtgctgttcgtggagctgagcagcggcaaggtgaagatgatcaagagcctgaaggagcccctgaaggccgaggagtggccctggaacagaaagaacagacagatccaggacagcggcctgttcggccagtacctgatgacccccagcaaggacagcctgttcatcctggacggcagactgaacaagctgaactgcgagatcaccgaggtggagaagggcaacaccgtgatctgggtgggcgacgcctag

SEQ ID NO: 4577 - DNA, 648 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacaccaccggcctggcctggagcaagaccggccccgtggccaagtag

SEQ ID NO: 4578 - DNA, 3837 bp, Artificial Sequence
  Description of Artificial Sequence: Synthetic coding sequence
atgagactgctgctgctggtgcccctgctgctggcccccgcccccggcagcagcgcccccaaggtgagaagacagagcgacacctggggcccctggagccagtggagcccctgcagcagaacctgcggcggcggcgtgagcttcagagagagaccctgctacagccagagaagagacggcggcagcagctgcgtgggccccgccagaagccacagaagctgcagaaccgagagctgccccgacggcgccagagacttcagagccgagcagtgcgccgagttcgacggcgccgagttccagggcagaagatacagatggctgccctactacagcgcccccaacaagtgcgagctgaactgcatccccaagggcgagaacttctactacaagcacagagaggccgtggtggacggcaccccctgcgagcccggcaagagagacgtgtgcgtggacggcagctgcagagtggtgggctgcgaccacgagctggacagcagcaagcaggaggacaagtgcctgagatgcggcggcgacggcaccacctgctaccccgtggccggcaccttcgacgccaacgacctgagcagaggctacaaccagatcctgatcgtgcccatgggcgccaccagcatcctgatcgacgaggccgccgccagcagaaacttcctggccgtgaagaacgtgagaggcgagtactacctgaacggccactggaccatcgaggccgccagagccctgcccgccgccagcaccatcctgcactacgagagaggcgccgagggcgacctggcccccgagagactgcacgccagaggccccaccagcgagcccctggtgatcgagctgatcagccaggagcccaaccccggcgtgcactacgagtaccacctgcccctgagaagacccagccccggcttcagctggagccacggcagctggagcgactgcagcgccgagtgcggcggcggccaccagagcagactggtgttctgcaccatcgaccacgaggcctaccccgaccacatgtgccagagacagcccagacccgccgacagaagaagctgcaacctgcacccctgccccgagaccaagagatggaaggccggcccctgggccccctgcagcgccagctgcggcggcggcagccagagcagaagcgtgtactgcatcagcagcgacggcgccggcatccaggaggccgtggaggaggccgagtgcgccggcctgcccggcaagccccccgccatccaggcctgcaacctgcagagatgcgccgcctggagccccgagccctggggcgagtgcagcgtgagctgcggcgtgggcgtgagaaagagaagcgtgacctgcagaggcgagagaggcagcctgctgcacaccgccgcctgcagcctggaggacagaccccccctgaccgagccctgcgtgcacgaggactgccccctgctgagcgaccaggcctggcacgtgggcacctggggcctgtgcagcaagagctgcagcagcggcaccagaagaagacaggtgatctgcgccatcggcccccccagccactgcggcagcctgcagcacagcaagcccgtggacgtggagccctgcaacacccagccctgccacctgccccaggaggtgcccagcatgcaggacgtgcacacccccgccagcaacccctggatgcccctgggcccccaggagagccccgccagcgacagcagaggccagtggtgggccgcccaggagcaccccagcgccagaggcgaccacagaggcgagagaggcgaccccagaggcgaccagggcacccacctgagcgccctgggccccgcccccagcctgcagcagcccccctaccagcagcccctgagaagcggcagcggcccccacgactgcagacacagcccccacggctgctgccccgacggccacaccgccagcctgggcccccagtggcagggctgccccggcgccccctgccagcagagcagatacggctgctgccccgacagagtgagcgtggccgagggcccccaccacgccggctgcaccaagagctacggcggcgacagcaccggcggcatgcccagaagcagagccgtggccagcaccgtgcacaacacccaccagccccaggcccagcagaacgagcccagcgagtgcagaggcagccagttcggctgctgctacgacaacgtggccaccgccgccggccccctgggcgagggctgcgtgggccagcccagccacgcctaccccgtgagatgcctgctgcccagcgcccacggcagctgcgccgactgggccgccagatggtacttcgtggccagcgtgggccagtgcaacagattctggtacggcggctgccacggcaacgccaacaacttcgccagcgagcaggagtgcatgagcagctgccagggcagcctgcacggccccagaagaccccagcccggcgccagcggcagaagcacccacaccgacggcggcggcagcagccccgccggcgagcaggagcccagccagcacagaaccggcgccgccgtgcagagaaagccctggcccagcggcggcctgtggagacaggaccagcagcccggccccggcgaggccccccacacccaggccttcggcgagtggccctggggccaggagctgggcagcagagcccccggcctgggcggcgacgccggcagccccgccccccccttccacagcagcagctacagaatcagcctggccggcgtggagcccagcctggtgcaggccgccctgggccagctggtgagactgagctgcagcgacgacaccgcccccgagagccaggccgcctggcagaaggacggccagcccatcagcagcgacagacacagactgcagttcgacggcagcctgatcatccaccccctgcaggccgaggacgccggcacctacagctgcggcagcaccagacccggcagagacagccagaagatccagctgagaatcatcggcggcgacatggccgtgctgagcgaggccgagctgagcagattcccccagcccagagaccccgcccaggacttcggccaggccggcgccgccggccccctgggcgccatccccagcagccacccccagcccgccaacagactgagactggaccagaaccagcccagagtggtggacgccagccccggccagagaatcagaatgacctgcagagccgagggcttccccccccccgccatcgagtggcagagagacggccagcccgtgagcagccccagacaccagctgcagcccgacggcagcctggtgatcagcagagtggccgtggaggacggcggcttctacacctgcgtggccttcaacggccaggacagagaccagagatgggtgcagctgagagtgctgggcgagctgaccatcagcggcctgccccccaccgtgaccgtgcccgagggcgacaccgccagactgctgtgcgtggtggccggcgagagcgtgaacatcagatggagcagaaacggcctgcccgtgcaggccgacggccacagagtgcaccagagccccgacggcaccctgctgatctacaacctgagagccagagacgagggcagctacacctgcagcgcctaccagggcagccaggccgtgagcagaagcaccgaggtgaaggtggtgagccccgcccccaccgcccagcccagagaccccggcagagactgcgtggaccagcccgagctggccaactgcgacctgatcctgcaggcccagctgtgcggcaacgagtactacagcagcttctgctgcgccagctgcagcagattccagccccacgcccagcccatctggcagtag

SEQ ID NO: 4579 - DNA, 546 bp, Artificial Sequence
  Description of Artificial Sequence: Synthetic coding sequence
tgaaagggccacgccagccccctgccccccagcgccgcccccaccaccgacagcaccgacagcatcaccggccagaacagcagacagagagaggaggagctggagctgatcgaccagctgagaaagcacatcgagtacagactgaaggtgagcctgccctgcgacctgggcgccgccctgaccgacggcgtggtgctgtgccacctggccaaccacgtgagacccagaagcgtgcccagcatccacgtgcccagccccgccgtgcccaagctgaccatggccaagtgcagaagaaacgtggagaacttcctggaggcctgcagaaagatcggcgtgccccaggacaacctgtgcagccccagcgacatcctgcagctgaacctgagcgtgaagagaaccgtggagaccctgctgagcctgggcgcccacagcgaggagagcagcttcgtgtgcctgagcctgcagctgctgggcttcgtggccttctactgcaccgtgatgctgaccctgtgcgtgctgtactactggctgttccccgccagatag

SEQ ID NO: 4580 - DNA, 804 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctactag

SEQ ID NO: 4581 - DNA, 345 bp, Artificial Sequence
  Description of Artificial Sequence: Synthetic coding sequence
atggcccccaagaagctgagctgcctgagaagcctgctgctgcccctgagcctgaccctgctgctgccccaggccgacaccagaagcttcgtggtggacagaggccacgacagattcctgctggacggcgcccccttcagatacgtgagcggcagcctgcactacttcagagtgcccagagtgctgtgggccgacagactgctgaagatgagatggagcggcctgaacgccatccagttctacgtgccctggaactaccacgagccccagcccggcgtgtacaacttcaacggcagcagagacctgatcgccttcctgaacgaggccgccctggccaacctgtag

SEQ ID NO: 4582 - DNA, 507 bp, Artificial Sequence
  Description of Artificial Sequence: Synthetic coding sequence
gcccccagaatggagatgttccagggcctgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggacagcagcagcagcaaggcccccccccccagcctgcccagccccagcagactgcccggccccagcgacacccccatcctgccccagtag

SEQ ID NO: 4583 - DNA, 1203 bp, Artificial Sequence
  Description of Artificial Sequence: Synthetic coding sequence
atggagacccaggagctgagaggcgccctggccctgctgctgctgtgcttcttcaccagcgccagccaggacctgcaggtgatcgacctgctgaccgtgggcgagagcagacagatggtggccgtggccgagaagatcagaaccgccctgctgaccgccggcgacatctacctgctgagcaccttcagactgccccccaagcagggcggcgtgctgttcggcctgtacagcagacaggacaacaccagatggctggaggccagcgtggtgggcaagatcaacaaggtgaccaacgccctgcacagcatcctgggcgagggcaacgtgcccgaccccaagcaccactacggcgtgagcggcttccacgagcagagaagccactgcagccccaacccctgcttcagaggcgtggactgcatggaggtgtacgagtaccccggctacagatgcggcccctgcccccccggcctgcagggcaacggcacccactgcagcgacatcaacgagtgcgcccacgccgacccctgcttccccggcagcagctgcatcaacaccatgcccggcttccactgcgaggcctgccccagaggctacaagggcacccaggtgagcggcgtgggcatcgactacgccagagccagcaagcaggtgtgcaacgacatcgacgagtgcaacgacggcaacaacggcggctgcgaccccaacagcatctgcaccaacaccgtgggcagcttcaagtgcggcccctgcagactgggcttcctgggcaaccagagccagggctgcctgcccgccagaacctgccacagccccgcccacagcccctgccacatccacgcccactgcctgttcgagagaaacggcgccgtgagctgccagtgcaacgtgggctgggccggcaacggcaacgtgtgcggcaccgacaccgacatcgacggctaccccgaccaggccctgccctgcatggacaacaacaagcactgcaagcaggacaactgcctgctgacccccaacagcggccaggaggacgccgacaacgacggcgtgggcgaccagtgcgacgacgacgccgacggcgacggcatcaagaacgtggaggccagccccatggactggaccatcgccctgaagagccccacccactacagacagaccggcatgagaaccggctgggagatgctggccaccgccgccctgaagtag

SEQ ID NO: 4584 - DNA, 618 bp, Artificial Sequence; identical to SEQ ID NO: 3886
  Description of Artificial Sequence: Synthetic coding sequence

SEQ ID NO: 4585 - DNA, 177 bp, Artificial Sequence
  Description of Artificial Sequence: Synthetic coding sequence
atggacctgctgcagttcctggccttcctgttcgtgctgctgctgagcggcatgggcgccaccggcaccctgagaaccagcctggaccccagcctggagatctacaagaagatgttcgaggtgaagagaagagagcagctgctggccctgaagaacctggcccagctgaacgactag

SEQ ID NO: 4586 - DNA, 450 bp, Artificial Sequence
  Description of Artificial Sequence: Synthetic coding sequence
atgaaggtgatcgccatcctgaccctgctgctgttctgcagccccacccacagcagcttctggcagttccagagaagagtgaagcacatcaccggcagaagcgccttcttcagctactacggctacggctgctactgcggcctgggcgacaagggcatccccgtggacgacaccgacagacacagccccagcagccccagcccctacgagaagctgaaggagttcagctgccagcccgtgctgaacagctaccagttccacatcgtgaacggcgccgtggtgtgcggctgcaccctgggccccggcgccagctgccactgcagactgaaggcctgcgagtgcgacaagcagagcgtgcactgcttcaaggagagcctgcccacctacgagaagaacttcaagcagttcagcagccagcccagatgcggcagacacaagccctggtgctag

SEQ ID NO: 4587 - DNA, 237 bp, Artificial Sequence; identical to SEQ ID NO: 3991
  Description of Artificial Sequence: Synthetic coding sequence

SEQ ID NO: 4588 - DNA, 1461 bp, Artificial Sequence
  Description of Artificial Sequence: Synthetic coding sequence
atgatcagccccagccccagccaggaggagctgcagaccaccctggaggagaccgaccagagcacccaggagcccttcaccaccaagatccccagaaccaccgagctggccaagaccacccaggccccccacagattctacaccaccgtgagacccagaaccagcgacaagccccacatcagacccgtgctgaacagaaccaccaccagacccaccagacccaagcccagcggcatgcccagcggcaacggcgtgggcaccggcgtgaagcaggcccccagacccagcggcgccgacagaaacgtgagcgtggacagcacccaccccaccaagaagcccggcaccagaagaccccccctgccccccagacccacccaccccagaagaaagcccctgccccccaacaacgtgaccggcaagcccggcagcgccggcatcatcagcagcggccccatcaccaccccccccctgagaagcacccccagacccaccggcacccccctggagagaatcgagaccgacatcaagcagcccaccgtgcccgccagcggcgaggagctggagaacatcaccgacttcagcagcagccccaccagagagaccgaccccctgggcaagcccagattcaagggcccccacgtgagatacatccagaagcccgacaacagcccctgcagcatcaccgacagcgtgaagagattccccaaggaggaggccaccgagggcaacgccaccagccccccccagaacccccccaccaacctgaccgtggtgaccgtggagggctgccccagcttcgtgatcctggactgggagaagcccctgaacgacaccgtgaccgagtacgaggtgatcagcagagagaacggcagcttcagcggcaagaacaagagcatccagatgaccaaccagaccttcagcaccgtggagaacctgaagcccaacaccagctacgagttccaggtgaagcccaagaaccccctgggcgagggccccgtgagcaacaccgtggccttcagcaccgagagcgccgaccccagagtgagcgagcccgtgagcgccggcagagacgccatctggaccgagagacccttcaacagcgacagctacagcgagtgcaagggcaagcagtacgtgaagagaacctggtacaagaagttcgtgggcgtgcagctgtgcaacagcctgagatacaagatctacctgagcgacagcctgaccggcaagttctacaacatcggcgaccagagaggccacggcgaggaccactgccagttcgtggacagcttcctggacggcagaaccggccagcagctgaccagcgaccagctgcccatcaaggagggctacttcagagccgtgagacaggagcccgtgcagttcggcgagatcggcggccacacccagatcaactacgtgcagtggtacgagtgcggcaccaccatccccggcaagtggtag

SEQ ID NO: 4589 - DNA, 243 bp, Artificial Sequence
  Description of Artificial Sequence: Synthetic coding sequence
tgaaacggccccgtgctgtggttcaagggcaccggccccaacagaaagctgatctacaacttcaagcaggagcagaaccccagaccccccaagaacagacccgccggcagagccggcagcagagcccaccacgacgcccacacctgcctgagcgccctgcccgagagaaacagcaccaactacttcgtgcagccctgctgctgcctgagactgctgggcctgaccggcctgctgagcaagtag

SEQ ID NO: 4590 - DNA, 1341 bp, Artificial Sequence
  Description of Artificial Sequence: Synthetic coding sequence
atgctgcaccccgagaccagccccggcagaggccacctgctggccgtgctgctggccctgctgggcaccacctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcatccccacccccagcctggccagcggcctgtggagaaccctgcaggtgggctggaacatgcagctgctgcccgccggcctggccagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccagaccgccatcgaggccttcgtgtgcgcctacagccccagaggcaactgggaggtgaacggcaagaccatcatcccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcggcgcccagtgcgccaccaaggtgcacttccccttccacacctgcgacctgagaatcgacggcgactgcttcatggtgagcagcgaggccgacacctactacagagccagaatgaagtgccagagaaagggcggcgtgctggcccagatcaagagccagaaggtgcaggacatcctggccttctacctgggcagactggagaccaccaacgaggtgatcgacagcgacttcgagaccagaaacttctggatcggcctgacctacaagaccgccaaggacagcttcagatgggccaccggcgagcaccaggccttcaccagcttcgccttcggccagcccgacaaccacggcttcggcaactgcgtggagctgcaggccagcgccgccttcaactggaacgaccagagatgcaagaccagaaacagatacatctgccagttcgcccaggagcacatcagcagatggggccccggcagctag

SEQ ID NO: 4591 - DNA, 432 bp, Artificial Sequence
  Description of Artificial Sequence: Synthetic coding sequence
atgcaggccgcctgctggtacgtgctgttcctgctgcagcccaccgtgtacctggtgacctgcgccaacctgaccaacggcggcaagagcgagctgctgaagagcggcagcagcaagagcaccctgaagcacatctggaccgagagcagcaaggacctgagcatcagcagactgctgagccagaccttcagaggcaaggagaacgacaccgacctggacctgagatacgacacccccgagccctacagcgagcaggacctgtgggactggctgagaaacagcaccgacctgcaggagcccagacccagagccaagagaagacccatcgtgaagaccggcaagttcaagaagatgttcggctggggcgacttccacagcaacatcaagaccgtgaagctgaacctgctgatcaccggcaagatcgtggactag

SEQ ID NO: 4592 - DNA, 783 bp, Artificial Sequence
  Description of Artificial Sequence: Synthetic coding sequence
atgcagggcgagcccttcgcctgcctgacccaccaggagcccctgcccaagatgttcaagctgctgagcagagcctacgccgacgtgcaccccatgatgatggacagaagcgagaacagatgcggcggcaacttcctgaagagaggcagcatcatcaacggcgccgactggtacagcttcaccggcggcatgagcgacttcaactacctgcacaccaactgcttcgagatcaccgtggagctgggctgcgtgaagttcccccccgaggaggccctgtacatcctgtggcagcacaacaaggagagcctgctgaacttcgtggagaccgtgcacagaggcatcaagggcgtggtgaccgacaagttcggcaagcccgtgaagaacgccagaatcagcgtgaagggcatcagacacgacatcaccaccgcccccgacggcgactactggagactgctgccccccggcatccacatcgtgatcgcccaggcccccggctacgccaaggtgatcaagaaggtgatcatccccgccagaatgaagagagccggcagagtggacttcatcctgcagcccctgggcatgggccccaagaacttcatccacggcctgagaagaaccggcccccacgaccccctgggcggcgccagcagcctgggcgaggccaccgagcccgaccccctgagagccagaagacagcccagcgccgacggcagcaagccctggtggtggagctacttcaccagcctgagcacccacagacccagatggctgctgaagtactag

SEQ ID NO: 4593 - DNA, 882 bp, Artificial Sequence
  Description of Artificial Sequence: Synthetic coding sequence
atgagcagcggcggcggcagcagaggcctgctggcctggctgctgctgctgcagccctggcccggccagaactgggccggcatggccgcccccagactgcccagccccctgctgagcgaggagggcggcgagaaccccgaggccagccccgcccccggccccgaggccggcccccccctgaacctgttcaccagcttccccggcgacagcctgctgtgcggcagaacccccctgagaatcgtgggcggcgtggacgccgaggagggcagatggccctggcaggtgagcgtgagaaccaagggcagacacatctgcggcggcaccctggtgaccgccacctgggtgctgaccgccggccactgcatcagcagcagattccactacagcgtgaagatgggcgacagaagcgtgtacaacgagaacaccagcgtggtggtgagcgtgcagagagccttcgtgcaccccaagttcagcaccgtgaccaccatcagaaacgacctggccctgctgcagctgcagcaccccgtgaacttcaccagcaacatccagcccatctgcatcccccaggagaacttccaggtggagggcagaaccagatgctgggtgaccggctggggcaagacccccgagagagagaagctggccagcgagatcctgcaggacgtggaccagtacatcatgtgctacgaggagtgcaacaagatcatccagaaggccctgagcagcaccaaggacgtgatcatcaagggcatggtgtgcggctacaaggagcagggcaaggacagctgccagggcgacagcggcggcagactggcctgcgagtacaacgacacctgggtgcaggtgggcatcgtgagctggggcatcggctgcggcagatag

SEQ ID NO: 4594 - DNA, 870 bp, Artificial Sequence
  Description of Artificial Sequence: Synthetic coding sequence
atgttcgtgctgctgtacgtgaccagcttcgccatctgcgccagcggccagcccagaggcaaccagctgaagggcgagaactacagccccagatacatctgcagcatccccggcctgcccggcccccccggcccccccggcgccaacggcagccccggcccccacggcagaatcggcctgcccggcagagacggcagagacggcagaaagggcgagaagggcgagaagggcaccgccggcctgagaggcaagaccggccccctgggcctggccggcgagaagggcgaccagggcgagaccggcaagaagggccccatcggccccgagggcgagaagggcgaggtgggccccatcggcccccccggccccaagggcgacagaggcgagcagggcgaccccggcctgcccggcgtgtgcagatgcggcagcatcgtgctgaagagcgccttcagcgtgggcatcaccaccagctaccccgaggagagactgcccatcatcttcaacaaggtgctgttcaacgagggcgagcactacaaccccgccaccggcaagttcatctgcgccttccccggcatctactacttcagctacgacatcaccctggccaacaagcacctggccatcggcctggtgcacaacggccagtacagaatcaagaccttcgacgccaacaccggcaaccacgacgtggccagcggcagcaccgtgatctacctgcagcccgaggacgaggtgtggctggagatcttcttcaccgaccagaacggcctgttcagcgaccccggctgggccgacagcctgttcagcggcttcctgctgtacgtggacaccgactacctggacagcatcagcgaggacgacgagctgtag

SEQ ID NO: 4595 - DNA, 2742 bp, Artificial Sequence; identical to SEQ ID NO: 3799
  Description of Artificial Sequence: Synthetic coding sequence

SEQ ID NO: 4596 - DNA, 1089 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctacgtgaccccctggaacagccacggctacgacgtgaccaaggtgttcggcagcaagttcacccagatcagccccgtgtggctgcagctgaagagaagaggcagagagatgttcgaggtgaccggcctgcacgacgtggaccagggctggatgagagccgtgagaaagcacgccaagggcctgcacatcgtgcccagactgctgttcgaggactggacctacgacgacttcagaaacgtgctggacagcgaggacgagatcgaggagctgagcaagaccgtggtgcaggtggccaagaaccagcacttcgacggcttcgtggtggaggtgtggaaccagctgctgagccagaagagagtgaccgaccagctgggcatgttcacccacaaggagttcgagcagctggcccccgtgctggacggcttcagcctgatgacctacgactacagcaccgcccaccagcccggccccaacgcccccctgagctgggtgagagcctgcgtgcaggtgctggaccccaagagcaagtggagaagcaagatcctgctgggcctgaacttctacggcatggactacgccaccagcaaggacgccagagagcccgtggtgggcgccagatacatccagaccctgaaggaccacagacccagaatggtgtgggacagccaggccagcgagcacttcttcgagtacaagaagagcagaagcggcagacacgtggtgttctaccccaccctgaagagcctgcaggtgagactggagctggccagagagctgggcgtgggcgtgagcatctgggagctgggccagggcctggactacttctacgacctgctgtag

SEQ ID NO: 4597 - DNA, 1350 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcagcagcaccggcagcagcagcggcaaccacggcggcagcggcggcggcaacggccacaagcccggctgcgagaagcccggcaacgaggccagaggcagcggcgagagcggcatccagggccagggcagcagctggggcagcggcggcggcgacgccgtgggcggcgtgaacaccgtgaacagcgagaccagccccggcatgttcaacttcgacaccttctggaagaacttcaagagcaagctgggcttcatcaactgggacgccatcaacaagaaccaggtgcccccccccagcaccagagccctgctgtacttcagcagactgtgggaggacttcaagcagaacacccccttcctgaactggaaggccatcatcgagggcgccgacgccagcagcctgcagaagagagccggcagagacgaccagcccggcgccggctggcaggaggtggccgccgtgaccagcaagaactacaactacaaccagcacgcctaccccaccgcctacggcggcaagtacagcgtgaagacccccgccaagggcggcgtgagccccagcagcagcgccagcagagtgcagcccggcctgctgcagtgggtgaagttctggtag

SEQ ID NO: 4598 - DNA, 735 bp, Artificial Sequence
  Description of Artificial Sequence: Synthetic coding sequence
atgtggggcgcccccctgcccagaagacccgtgtgggacgtgagaagcgccagcgccggcccccagccctgcctgggcggcaagatgaagctgaacctggtgcagatcttcttcatgctgctgatgctgctgctgggcctgggcatgggcctgggcctgggcctgcacatggccaccgccgtgctggaggagagcgaccagcccctgaacgagttctggagcagcgacagccaggacaaggccgaggccaccgaggagggcgacggcacccagaccaccgagaccctggtgctgagcaacaaggaggtggtgcagcccggctggcccgaggaccccatcctgggcgaggacgaggtgggcggcaacaagatgctgagagccagcgccctgttccagagcaacaaggactacctgagactggaccagaccgacagagagtgcaacgacatgatggcccacaagatgaaggagcccagccagagctgcatcgcccagtacgccttcatccacgaggacctgaacaccgtgaaggccgtgtgcaacagccccgtgatcgcctgcgagctgaagggcggcaagtgccacaagagcagcagacccttcgacctgaccctgtgcgagctgagccagcccgaccaggtgacccccaactgcaactacctgaccagcgtgatcaagaagcacatcatcatcacctgcaacgacatgaagagacagctgcccaccggccagtag

SEQ ID NO: 4599 - DNA, 1728 bp, Artificial Sequence; identical to SEQ ID NO: 3621
  Description of Artificial Sequence: Synthetic coding sequence

SEQ ID NO: 4600 - DNA, 390 bp, Artificial Sequence; identical to SEQ ID NO: 4161
  Description of Artificial Sequence: Synthetic coding sequence

SEQ ID NO: 4601 - DNA, 567 bp, Artificial Sequence; identical to SEQ ID NO: 4160
  Description of Artificial Sequence: Synthetic coding sequence

SEQ ID NO: 4602 - DNA, 2676 bp, Artificial Sequence; identical to SEQ ID NO: 4153
  Description of Artificial Sequence: Synthetic coding sequence

SEQ ID NO: 4603 - DNA, 2742 bp, Artificial Sequence; identical to SEQ ID NO: 3799
  Description of Artificial Sequence: Synthetic coding sequence

SEQ ID NO: 4604 - DNA, 453 bp, Artificial Sequence; identical to SEQ ID NO: 3797
  Description of Artificial Sequence: Synthetic coding sequence

SEQ ID NO: 4605 - DNA, 192 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagatag

SEQ ID NO: 4606 - DNA, 1212 bp, Artificial Sequence
  Description of Artificial Sequence: Synthetic coding sequence
atgcagggcacccccggcggcggcaccagacccggccccagccccgtggacagaagaaccctgctggtgttcagcttcatcctggccgccgccctgggccagatgaacttcaccggcgaccaggtgctgagagtgctggccaaggacgagaagcagctgagcctgctgggcgacctggagggcctgaagccccagaaggtggacttctggagaggccccgccagacccagcctgcccgtggacatgagagtgcccttcagcgagctgaaggacatcaaggcctacctggagagccacggcctggcctacagcatcatgatcaaggacatccaggtgctgctggacgaggagagacaggccatggccaagagcagaagactggagagaagcaccaacagcttcagctacagcagctaccacaccctggaggagatctacagctggatcgacaacttcgtgatggagcacagcgacatcgtgagcaagatccagatcggcaacagcttcgagaaccagagcatcctggtgctgaagttcagcaccggcggcagcagacaccccgccatctggatcgacaccggcatccacagcagagagtggatcacccacgccaccggcatctggaccgccaacaagatcgtgagcgactacggcaaggacagagtgctgaccgacatcctgaacgccatggacatcttcatcgagctggtgaccaaccccgacggcttcgccttcacccacagcatgaacagactgtggagaaagaacaagagcatcagacccggcatcttctgcatcggcgtggacctgaacagaaactggaagagcggcttcggcggcaacggcagcaacagcaacccctgcagcgagacctaccacggccccagcccccagagcgagcccgaggtggccgccatcgtgaacttcatcaccgcccacggcaacttcaaggccctgatcagcatccacagctacagccagatgctgatgtacccctacggcagactgctggagcccgtgagcaaccagagagagctgatgtggcccgtgggcagccccagcaccggccccatgaccgtggccagcagcacccccagcgccctgagcagcggcaccctgggcagcatggccagctgctgcagaccccacagaagcagccccagacccagaagaagaggctggagattcggccccagctggagcaccccctag

SEQ ID NO: 4607 - DNA, 1542 bp, Artificial Sequence
  Description of Artificial Sequence: Synthetic coding sequence
atggcccccgccagaaccatggccagagccagactggcccccgccggcatccccgccgtggccctgtggctgctgtgcaccctgggcctgcagggcacccaggccggccccccccccgccccccccggcctgcccgccggcgccgactgcctgaacagcttcaccgccggcgtgcccggcttcgtgctggacaccaacgccagcgtgagcaacggcgccaccttcctggagagccccaccgtgagaagaggctgggactgcgtgagagcctgctgcaccacccagaactgcaacctggccctggtggagctgcagcccgacagaggcgaggacgccatcgccgcctgcttcctgatcaactgcctgtacgagcagaacttcgtgtgcaagttcgcccccagagagggcttcatcaactacctgaccagagaggtgtacagaagctacagacagctgagaacccagggcttcggcggcagcggcatccccaaggcctgggccggcatcgacctgaaggtgcagccccaggagcccctggtgctgaaggacgtggagaacaccgactggagactgctgagaggcgacaccgacgtgagagtggagagaaaggaccccaaccaggtggagctgtggggcctgaaggagggcacctacctgttccagctgaccgtgaccagcagcgaccaccccgaggacaccgccaacgtgaccgtgaccgtgctgagcaccaagcagaccgaggactactgcctggccagcaacaaggtgggcagatgcagaggcagcttccccagatggtactacgaccccaccgagcagatctgcaagagcttcgtgtacggcggctgcctgggcaacaagaacaactacctgagagaggaggagtgcatcctggcctgcagaggcgtgcagggccccagcatggagagaagacaccccgtgtgcagcggcacctgccagcccacccagttcagatgcagcaacggctgctgcatcgacagcttcctggagtgcgacgacacccccaactgccccgacgccagcgacgaggccgcctgcgagaagtacaccagcggcttcgacgagctgcagagaatccacttccccagcgacaagggccactgcgtggacctgcccgacaccggcctgtgcaaggagagcatccccagatggtactacaaccccttcagcgagcactgcgccagattcacctacggcggctgctacggcaacaagaacaacttcgaggaggagcagcagtgcctggagagctgcagaggcatcagcaagaaggacgtgttcggcctgagaagagagatccccatccccagcaccggcagcgtggagatggccgtggccgtgttcctggtgatctgcatcgtggtggtggtggccatcctgggctactgcttcttcaagaaccagagaaaggacttccacggccaccaccaccaccccccccccacccccgccagcagcaccgtgagcaccaccgaggacaccgagcacctggtgtacaaccacaccaccagacccctgtag

SEQ ID NO: 4608 - DNA, 798 bp, Artificial Sequence
  Description of Artificial Sequence: Synthetic coding sequence
atggccccctggagccaccccagcgcccagctgcagcccgtgggcggcgacgccgtgagccccgccctgatggtgctgctgtgcctgggcctgagcctgggccccagaacccacgtgcaggccggcaacctgagcaaggccaccctgtgggccgagcccggcagcgtgatcagcagaggcaacagcgtgaccatcagatgccagggcaccctggaggcccaggagtacagactggtgaaggagggcagccccgagccctgggacacccagaaccccctggagcccaagaacaaggccagattcagcatccccagcatgaccgagcaccacgccggcagatacagatgctactactacagccccgccggctggagcgagcccagcgaccccctggagctggtggtgaccggcttctacaacaagcccaccctgagcgccctgcccagccccgtggtgaccagcggcgagaacgtgaccctgcagtgcggcagcagactgagattcgacagattcatcctgaccgaggagggcgaccacaagctgagctggaccctggacagccagctgacccccagcggccagttccaggccctgttccccgtgggccccgtgacccccagccacagatggatgctgagatgctacggcagcagaagacacatcctgcaggtgtggagcgagcccagcgacctgctggagatccccgtgagcggcgaggaggccaccgtgttcagcagcaccatccagggcagccagaccggctgcggcgagctgtacagacagggcagcccctgctag

SEQ ID NO: 4609 - DNA, 795 bp, Artificial Sequence
  Description of Artificial Sequence: Synthetic coding sequence
atggagaagcccatcctgaagaacctgaacgagatgctgtgccccatcatcgccagcgaggtgaaggccctgaacgccaacctgagcaccctggaggtgctgaccaagatcgacaactacaccctgctggactacagcctgatcagcagccccgagatcaccgagaactacctggacctgaacctgaagggcgtgttctaccccctggagaacctgaccgacccccccttcagccccgtgcccttcgtgctgcccgagagaagcaacagcatgctgtacatcggcatcgccgagtacttcttcaagagcgccagcttcgcccacttcaccgccggcgtgttcaacgtgaccctgagcaccgaggagatcagcaaccacttcgtgcagaacagccagggcctgggcaacgtgctgagcagagtggccagcaccagcgtgggcctggtgatcctgggccagagactggtgtgcagcctgagcctgaacagattcagactggccctgcccgagagcaacagaagcaacatcgaggtgctgagattcgagaacatcctgagcagcatcctgcacttcggcgtgctgcccctggccaacgccaagctgcagcagggcttccccctgagcaacccccacaagttcctgttcgtgaacagcgacatcgaggtgctggagggcttcctgctgatcagcaccgacctgaagtacgagaccagcagcaagcagcagcccagcttccacgtgtgggagggcctgaacctgatcagcagacagtggagaggcaagagcgccccctag

SEQ ID NO: 4610 - DNA, 117 bp, Artificial Sequence
  Description of Artificial Sequence: Synthetic coding sequence
atgaacaagatcctgagcagcaccgtgtgcttcggcctgctgaccctgctgagcgtgctgagcttcctgcagagcgtgcacggcagaccctacctgacccagggcaacgagatctag

SEQ ID NO: 4611 - DNA, 567 bp, Artificial Sequence; identical to SEQ ID NO: 4160
  Description of Artificial Sequence: Synthetic coding sequence

SEQ ID NO: 4612 - DNA, 600 bp, Artificial Sequence; identical to SEQ ID NO: 3864
  Description of Artificial Sequence: Synthetic coding sequence

SEQ ID NO: 4613 - DNA, 30 bp, Artificial Sequence
  Description of Artificial Sequence: Synthetic coding sequence
atggcccccaagaagctgagctgcctgtag

SEQ ID NO: 4614 - DNA, 831 bp, Artificial Sequence
  Description of Artificial Sequence: Synthetic coding sequence
atggcccccagccccctgcagagactgcactgcggccccagccccagccccagacccaccgaggtgcccagaggcaccgtgagcgtgagctgcagatacctgaagaacagcctgcacgtgttcgtgagcggcggcgccatcggcaccagcagccccgccctgctggagtgccaggagggcgtgggccccgccagacccagcctgctggtgccccccccccccagacccagaagactggacctggccagaaccctgcccgccgagagaaccgacagccagagcctgtacatcgtgtacatcgccctgcccggcagaacccccagacccgccctggccttcgccttcctgatgcccgcctgctgcaacagacccagccccagacccagccccgcccacctgaccgccagcagcgtgctgagaagacagagacacgtgctggccgccagcgccgccagcccctgccagtggagcggcctgagagtggcccacagcctgagacaggtggtgagcctgtgccccagatgcaccggcagctgccccttcagcggcgcctgcgccagcagcctgcccagccccctgagctgcccccacagccacagcggcagctggggcacctggagccagggcagaccctgcagcagcaccgaggtggccggcctggccctgtggcccaccgacttcctgagctgcctgctggacgccagcgagctgcagacccagggcagccacggcttcagcttcacccccaccggcttcagcagcaacagaaaggtgggcgtgggcagctgcagagacggcgccggcagaggcgccatgggcggcctgttctag

SEQ ID NO: 4615 - DNA, 678 bp, Artificial Sequence; identical to SEQ ID NO: 4468
  Description of Artificial Sequence: Synthetic coding sequence

SEQ ID NO: 4616 - DNA, 534 bp, Artificial Sequence
  Description of Artificial Sequence: Synthetic coding sequence
atggtgcccgccgccggcgccctgctgtgggtgctgctgctgaacctgggccccagagccgccggcgcccagggcctgacccagacccccaccgagatgcagagagtgagcctgagattcggcggccccatgaccagaagctacagaagcaccgccagaaccggcctgcccagaaagaccagaatcatcctggaggacgagaacgacgccatggccgacgccgacagactggccggccccgccgccgccgagctgctggccgccaccgtgagcaccggcttcagcagaagcagcgccatcaacgaggaggacggcagcagcgaggagggcgtggtgatcaacgccggcaaggacagcaccagcagagagctgcccagcgccacccccaacaccgccggcagcagcagcaccagattcatcgccaacagccaggagcccgagatcagactgaccagcagcctgcccagaagccccggcagaagcaccgaggacctgcccccctgccacctgctgagaatctgcggctggtgctag

SEQ ID NO: 4617 - DNA, 912 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcatccccacccccagcctggccagcggcctgtggagaaccctgcaggtgggctggaacatgcagctgctgcccgccggcctggccagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcgagcccagcgtgccccccagatgcatcttccccagcacccccgtgacctag

SEQ ID NO: 4618 - DNA, 1482 bp, Artificial Sequence; identical to SEQ ID NO: 4484
  Description of Artificial Sequence: Synthetic coding sequence

SEQ ID NO: 4619 - DNA, 807 bp, Artificial Sequence
  Description of Artificial Sequence: Synthetic coding sequence
atgaagcagatcctgcaccccgccctggagaccaccgacccctgcagcaccggcttcgtgttccccgccatgaccctgttccccgtgctgctgttcctggtggccggcctgctgcccagcttccccgccaacgaggacaaggaccccgccttcaccgccctgctgaccacccagacccaggtgcagagagagatcgtgaacaagcacaacgagctgagaagagccgtgagcccccccgccagaaacatgctgaagatggagtggaacaaggaggccgccgccaacgcccagaagtgggccaaccagtgcaactacagacacagcaaccccaaggacagaatgaccagcctgaagtgcggcgagaacctgtacatgagcagcgccagcagcagctggagccaggccatccagagctggttcgacgagtacaacgacttcgacttcggcgtgggccccaagacccccaacgccgtggtgggccactacacccaggtggtgtggtacagcagctacctggtgggctgcggcaacgcctactgccccaaccagaaggtgctgaagtactactacgtgtgccagtactgccccgccggcaactgggccaacagactgtacgtgccctacgagcagggcgccccctgcgccagctgccccgacaactgcgacgacggcctgtgcaccaacggctgcaagtacgaggacctgtacagcaactgcaagagcctgaagctgaccctgacctgcaagcaccagctggtgagagacagctgcaaggccagctgcaactgcagcaacagcatctactag

SEQ ID NO: 4620 - DNA, 372 bp, Artificial Sequence
  Description of Artificial Sequence: Synthetic coding sequence
atgctgcccaagagcagaagagccctgaccatccaggagatcgccgccctggccagaagcagcctgcacggcatcagccaggtggtgaaggaccacgtgaccaagcccaccgccatggcccagggcagagtggcccacctgatcgagtggaagggctggagcaagcccagcgacagccccgccgccctggagagcgccttcagcagctacagcgacctgagcgagggcgagcaggaggccagattcgccgccggcgtggccgagcagttcgccatcgccgaggccaagctgagagcctggagcagcgtggacggcgaggacagcaccgacgacagctacgacgaggacttcgccggcggcatggacacctag

SEQ ID NO: 4621 - DNA, 726 bp, Artificial Sequence
  Description of Artificial Sequence: Synthetic coding sequence
atgggcgccgtgatgggcaccttcagcagcctgcagaccaagcagagaagacccagcaaggacaagatcgaggacgagctggagatgaccatggtgtgccacagacccgagggcctggagcagctggaggcccagaccaacttcaccaagagagagctgcaggtgctgtacagaggcttcaagaacgagtgccccagcggcgtggtgaacgaggacaccttcaagcagatctacgcccagttcttcccccacggcgccctgccctgcctggagggcagcccctgcgtggagttcctgccccccagccccgccctgctgttctgcctggtggacgccagcacctacgcccactacctgttcaacgccttcgacaccacccagaccggcagcgtgaagttcgaggacttcgtgaccgccctgagcatcctgctgagaggcaccgtgcacgagaagctgagatggaccttcaacctgtacgacatcaacaaggacggctacatcaacaaggaggagatgatggacatcgtgaaggccatctacgacatgatgggcaagtacacctaccccgtgctgaaggaggacacccccagacagcacgtggacgtgttcttccagaagatggacaagaacaaggacggcatcgtgaccctggacgagttcctggagagctgccaggaggacgacaacatcatgagaagcctgcagctgttccagaacgtgatgtag

SEQ ID NO: 4622 - DNA, 630 bp, Artificial Sequence; identical to SEQ ID NO: 4517
  Description of Artificial Sequence: Synthetic coding sequence

SEQ ID NO: 4623 - DNA, 312 bp, Artificial Sequence
  Description of Artificial Sequence: Synthetic coding sequence
atgagacagagactgctgcccagcgtgaccagcctgctgctggtggccctgctgttccccggcagcagccaggccagacacgtgaaccacagcgccaccgaggccctgggcgagctgagagagagagcccccggccagggcaccaacggcttccagctgctgagacacgccgtgaagagagacctgctgccccccagaacccccccctaccaggtgcacatcagccaccaggaggccagaggccccagcttcaagatctgcgtgggcttcctgggccccagatgggccagaggctgcagcaccggcaactag

SEQ ID NO: 4624 - DNA, 426 bp, Artificial Sequence
  Description of Artificial Sequence: Synthetic coding sequence
atgaagaccggcctgttcttcctgtgcctgctgggcaccgccgccgccatccccaccaacgccagactgctgagcgaccacagcaagcccaccgccgagaccgtggcccccgacaacaccgccatccccagcctgagagccgaggccgaggagaacgagaaggagaccgccgtgagcaccgaggacgacagccaccacaaggccgagaagagcagcgtgctgaagagcaaggaggagagccacgagcagagcgccgagcagggcaagagcagcagccaggagctgggcctgaaggaccaggaggacagcgacggccacctgagcgtgaacctggagtacgcccccaccgagggcaccctggacatcaaggaggacatgagcgagccccaggagaagaagctgagcgagaacaccgacttcctgtag

SEQ ID NO: 4625 - DNA, 642 bp, Artificial Sequence
  Description of Artificial Sequence: Synthetic coding sequence
atgagactggccggccccctgagaatcgtggtgctggtggtgagcgtgggcgtgacctggatcgtggtgagcatcctgctgggcggccccggcagcggcttccccagaatccagcagctgttcaccagccccgagagcagcgtgaccgccgcccccagagccagaaagtacaagtgcggcctgccccagccctgccccgaggagcacctggccttcagagtggtgagcggcgccgccaacgtgatcggccccaagatctgcctggaggacaagatgctgatgagcagcgtgaaggacaacgtgggcagaggcctgaacatcgccctggtgaacgacgtgaacgacctgctgaagttcatcagacccctgcacgagggcaccctggtgttcgtggccagctacgacgaccccgccaccaagatgaacgaggagaccagaaagctgttcagcgagctgggcagcagaaacgccaaggagctggccttcagagacagctgggtgttcgtgggcgccaagggcgtgcagaacaagagccccttcgagcagcacgtgaagaacagcaagcacagcaacaagtacgagggctggcccgaggccctggagatggagggctgcatccccagaagaagcaccgccagctag

SEQ ID NO: 4626 - DNA, 2700 bp, Artificial Sequence; identical to SEQ ID NO: 4183
  Description of Artificial Sequence: Synthetic coding sequence

SEQ ID NO: 4627 - DNA, 192 bp, Artificial Sequence; identical to SEQ ID NO: 4605
  Description of Artificial Sequence: Synthetic coding sequence

SEQ ID NO: 4628 - DNA, 489 bp, Artificial Sequence
  Description of Artificial Sequence: Synthetic coding sequence
gacgaggacagatacaccacctgctggcccaagacctggctggccaaggactgccccgccctgagaatcatcagcgtggagtacgacaccagcctgagcgactggagagccagatgccccatggagagaaagagcatcgccttcagaagcaacgagctgctgagaaagctgagagccgccggcgtgggcgacagacccgtggtgtggatcagccacagcatgggcggcctgctggtgaagaagatgctgctggaggccagcaccaagcccgagatgagcaccgtgatcaacaacaccagaggcatcatcttctacagcgtgccccaccacggcagcagactggccgagtacagcgtgaacatcagatacctgctgttccccagcctggaggtgaaggagctgagcaagggcaacaccttctgccacaagggcaactggggctacatcaacatcagctacaccgagaagaagaagaagttcctgccctag

SEQ ID NO: 4629 - DNA, 1083 bp, Artificial Sequence
  Description of Artificial Sequence: Synthetic coding sequence
atgcccgagctggtggtgaccgccctgctggcccccagcagactgagcctgaagctgctgagagccttcatgtggagcctggtgttcagcgtggccctggtggccgccgccgtgtacggctgcatcgccctgacccacgtgctgtgcagacccagaagaggctgctgcggcagaagaagaagcgccagccccgcctgcctgagcgaccccagcctgggcgagcacggcttcctgaacctgaagagcagcggcctgagactgcactacgtgagcgccggcagaggcaacggccccctgatgctgttcctgcacggcttccccgagaactggttcagctggagataccagctgagagagttccagagcagattccacgtggtggccgtggacctgagaggctacggccccagcgacgcccccagagacgtggactgctacaccatcgacctgctgctggtggacatcaaggacgtgatcctgggcctgggctacagcaagtgcatcctggtggcccacgactggggcgccctgctggcctggcacttcagcatctactaccccagcctggtggagagaatggtggtggtgagcggcgcccccatgagcgtgtaccaggactacagcctgcaccacatcagccagttcttcagaagccactacatgttcctgttccagctgccctggctgcccgagaagctgctgagcatgagcgacttccagatcctgaagaccaccctgacccacagaaagaccggcatcccctgcctgacccccagcgagctggaggccttcctgtacaacttcagccagcccggcggcctgaccggccccctgaactactacagaaacctgttcagaaacttccccctggagccccaggagctgaccacccccaccctgctgctgtggggcgagaaggacacctacctggagctgggcctggtggaggccatcggcagcagattcgtgcccggcagactggaggcccacatcctgcccggcatcggccactggatcccccagagcaacccccaggagatgcaccagtacatgtgggccttcctgcaggacctgctggactag

SEQ ID NO: 4630 - DNA, 678 bp, Artificial Sequence; identical to SEQ ID NO: 4468
  Description of Artificial Sequence: Synthetic coding sequence

SEQ ID NO: 4631 - DNA, 192 bp, Artificial Sequence; identical to SEQ ID NO: 3578
  Description of Artificial Sequence: Synthetic coding sequence

SEQ ID NO: 4632 - DNA, 5235 bp, Artificial Sequence; identical to SEQ ID NO: 4137
  Description of Artificial Sequence: Synthetic coding sequence

SEQ ID NO: 4633 - DNA, 792 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaagggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacaccaccggcctggcctggagcaagaccggccccgtggccaaggagctgagcggcctgcccagcggccccagcgccggcagctgccccccccccccccccccctgccccccccccccccccgtgagcaccatcagctgcagctacgagagcgccagcagaagcagcctgttcgcccagatcaaccagggctag

SEQ ID NO: 4634 - DNA, 501 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctag

SEQ ID NO: 4635 - DNA, 2349 bp, Artificial Sequence
  Description of Artificial Sequence: Synthetic coding sequence
agcatcctgagagtggaggccgtggacgccgactgcagcccccagttcagccagatctgcagctacgagatcatcacccccgacgtgcccttcaccgtggacaaggacggctacatcaagaacaccgagaagctgaactacggcaaggagcaccagtacaagctgaccgtgaccgcctacgactgcggcaagaagagagccaccgaggacgtgctggtgaagatcagcatcaagcccacctgcacccccggctggcagggctggaacaacagaatcgagtacgagcccggcaccggcgccctggccgtgttccccaacatccacctggagacctgcgacgagcccgtggccagcgtgcaggccaccgtggagctggagaccagccacatcggcaagggctgcgacagagacacctacagcgagaagagcctgcacagactgtgcggcgccgccgccggcaccgccgagctgctgcccagccccagcggcagcctgaactggaccatgggcctgcccaccgacaacggccacgacagcgaccaggtgttcgagttcaacggcacccaggccgtgagaatccccgacggcgtggtgagcgtgagccccaaggagcccttcaccatcagcgtgtggatgagacacggccccttcggcagaaagaaggagaccatcctgtgcagcagcgacaagaccgacatgaacagacaccactacagcctgtacgtgcacggctgcagactgatcttcctgttcagacaggaccccagcgaggagaagaagtacagacccgccgagttccactggaagctgaaccaggtgtgcgacgaggagtggcaccactacgtgctgaacgtggagttccccagcgtgaccctgtacgtggacggcaccagccacgagcccttcagcgtgaccgaggactaccccctgcaccccagcaagatcgagacccagctggtggtgggcgcctgctggcagggcggcgacctgcacatgacccagttcttcagaggcaacctggccggcctgaccctgagaagcggcaagctggccgacaagaaggtgatcgactgcctgtacacctgcaaggagggcctggacctgcaggtgctggaggacagcggcagaggcgtgcagatccaggcccaccccagccagctggtgctgaccctggagggcgaggacctgggcgagctggacaaggccatgcagcacatcagctacctgaacagcagacagttccccacccccggcatcagaagactgaagatcaccagcaccatcaagtgcttcaacgaggccacctgcatcagcgtgccccccgtggacggctacgtgatggtgctgcagcccgaggagcccaagatcagcctgagcggcgtgcaccacttcgccagagccgccagcgagttcgagagcagcgagggcgtgttcctgttccccgagctgagaatcatcagcaccatcaccagagaggtggagcccgagggcgacggcgccgaggaccccaccgtgcaggagagcctggtgagcgaggagatcgtgcacgacctggacacctgcgaggtgaccgtggagggcgaggagctgaaccacgagcaggagagcctggaggtggacatggccagactgcagcagaagggcatcgaggtgagcagcagcgagctgggcatgaccttcaccggcgtggacaccatggccagctacgaggaggtgctgcacctgctgagatacagaaactggcacgccagaagcctgctggacagaaagttcaagctgatctgcagcgagctgaacggcagatacatcagcaacgagttcaaggtggaggtgaacgtgatccacaccgccaaccccatggagcacgccaaccacatggccgcccagccccagttcgtgcaccccgagcacagaagcttcgtggacctgagcggccacaacctggccaacccccaccccttcgccgtggtgcccagcaccgccaccgtggtgatcgtggtgtgcgtgagcttcctggtgttcatgatcatcctgggcgtgttcagaatcagagccgcccacagaagaaccatgagagaccaggacaccggcaaggagaacgagatggactgggacgacagcgccctgaccatcaccgtgaaccccatggagacctacgaggaccagcacagcagcgaggaggaggaggaggaggaggaggaggaggagagcgaggacggcgaggaggaggacgacatcaccagcgccgagagcgagagcagcgaggaggaggagggcgagcagggcgacccccagaacgccaccagacagcagcagctggagtgggacgacagcaccctgagctactag

SEQ ID NO: 4636 - DNA, 531 bp, Artificial Sequence
  Description of Artificial Sequence: Synthetic coding sequence
atggccagaagacactgcttcagctactggctgctggtgtgctggctggtggtgaccgtggccgaggccctgagcaccttctacctgcagcagcacatcaacctgcacatggacaagaagagatacctgagactgctggagatccacaagatcatgagaaccctgcccaccgccagaagcctgcacagccccctgcacctgcccagaggcgtgagaagccagggccccagccccagccagagacaccccggcgtgcccagcatcttcttccacgagggccccgagagcatcctgggcttccagaccgacctgagcagcctgcagggcgtgaccaccgtgttccacagcagccacttcatcggccacaccgtgaccctgctgatcggcatcagccccgaggaggacagcagagaggaggcccacctgagaaaggccgagagagaggagaagcccaagcacaccgaggccaagaagagcctgagcttcagaaagaagcagcagaaggacttctgcttcatcttcagaaactag

SEQ ID NO: 4637 - DNA, 1182 bp, Artificial Sequence; identical to SEQ ID NO: 3793
  Description of Artificial Sequence: Synthetic coding sequence

SEQ ID NO: 4638 - DNA, 324 bp, Artificial Sequence
  Description of Artificial Sequence: Synthetic coding sequence
atgctgccctgcctggccctgctgctgctgatggagctgagcgtgtgcaccgtggccggcgacggcggcgaggagcagaccctgagcaccgaggccgagacctgggagggcgccggccccagcatccagctgcagctgcaggaggtgaagaccggcaaggccagccagttcttcggcctgatgggcaagagagtgggcggcagacccctgatccagcccagaagaaagaaggcctaccagctggagcacaccttccagggcctgctgggcaagagaagcctgttcaccgagggcagagaggacgaggcccagggcagcgagtag

SEQ ID NO: 4639 - DNA, 1086 bp, Artificial Sequence
  Description of Artificial Sequence: Synthetic coding sequence
atgggcatcatccagagcatcctggccaccagcagagactgctacagcttcaagaagaagcccatccccaagaagcccaccatgctggccctggccaagatcctgctgatcagcaccctgttctacagcctgctgagcggcagccacggcaaggagaaccaggacatcaacaccacccagaacatcgccgaggtgttcaagaccatggagaacaagcccatcagcctggagagcgaggccaacctgaacagcgacaaggagaacatcaccaccagcaacctgaaggccagccacagcccccccctgaacctgcccaacaacagccacggcatcaccgacttcagcagcaacagcagcgccgagcacagcctgggcagcctgaagcccaccagcaccatcagcaccagcccccccctgatccacagcttcgtgagcaaggtgccctggaacgcccccatcgccgacgaggacctgctgcccatcagcgcccaccccaacgccacccccgccctgagcagcgagaacttcacctggagcctggtgaacgacaccgtgaagacccccgacaacagcagcatcaccgtgagcatcctgagcagcgagcccaccagccccagcgtgacccccctgatcgtggagcccagcggctggctgaccaccaacagcgacagcttcaccggcttcaccccctaccaggagaagaccaccctgcagcccaccctgaagttcaccaacaacagcaagctgttccccaacaccagcgacccccagaaggagaacagaaacaccggcatcgtgttcggcgccatcctgggcgccatcctgggcgtgagcctgctgaccctggtgggctacctgctgtgcggcaagagaaagaccgacagcttcagccacagaagactgtacgacgacagaaacgagcccgtgctgagactggacaacgcccccgagccctacgacgtgagcttcggcaacagcagctactacaaccccaccctgaacgacagcgccatgcccgagagcgaggagaacgccagagacggcatccccatggacgacatcccccccctgagaaccagcgtgtag

SEQ ID NO: 4640 - DNA, 279 bp, Artificial Sequence
  Description of Artificial Sequence: Synthetic coding sequence
atgagaggccccggccaccccctgctgctgggcctgctgctggtgctgggccccagccccgagcagagagtggagatcgtgcccagagacctgagaatgaaggacaagttcctgaagcacctgaccggccccctgtacttcagccccaagtgcagcaagcacttccacagactgtaccacaacaccagagactgcaccatccccgcctactacaagagatgcgccagactgctgaccagactggccgtgagccccgtgtgcatggaggacaagcagtag

SEQ ID NO: 4641 - DNA, 1125 bp, Artificial Sequence
  Description of Artificial Sequence: Synthetic coding sequence
tgaagagtgagaagaggccccctgcccgccgacagacccagagccctgggccccgccagaagatgcagcagacacccccaccccgcccccttcagagtgtgcagcgagggcgccgcccacagactgagaagacccgagagactgcccctgcccagcagagccctgagacccagacccgcccacacccccatcctgggccccgcccccagagcctgccccggcgcccccagagccagcgacagccccacctgcgccgccgccgccgccaccgcctggcccagaaccagagccgtggagagaaagggctgccaggtggccgccgccgccggcgtgagaggcaccggctgccccagcagagccgacctggagaaggacagctggaacgacaccaaggaggacgtgttcgtgcaccagaccgccatcaagaagaacaaccccagaaagtacctgagaagcgtgggcgacggcgagaccgtggagttcgacgtggtggagggcgagaagggcgccgaggccgccaacgtgaccggccccggcggcgtgcccgtgcagggcagcaagtacgccgccgacagaaaccactacagaagataccccagaagaagaggcccccccagaaactaccagcagaactaccagaacagcgagagcggcgagaagaacgagggcagcgagagcgcccccgagggccaggcccagcagagaagaccctacagaagaagaagattccccccctactacatgagaagaccctacggcagaagaccccagtacagcaacccccccgtgcagggcgaggtgatggagggcgccgacaaccagggcgccggcgagcagggcagacccgtgagacagaacatgtacagaggctacagacccagattcagaagaggcccccccagacagagacagcccagagaggacggcaacgaggaggacaaggagaaccagggcgacgagacccagggccagcagcccccccagagaagatacagaagaaacttcaactacagaagaagaagacccgagaaccccaagccccaggacggcaaggagaccaaggccgccgacccccccgccgagaacagcagcgcccccgaggccgagcagggcggcgccgagtag

SEQ ID NO: 4642 - DNA, 420 bp, Artificial Sequence
  Description of Artificial Sequence: Synthetic coding sequence
atggccctgagaatgctgtgggccggccaggccaagggcatcctgggcggctggggcatcatctgcctggtgatgagcctgctgctgcagcaccccggcgtgtacagcaagtgctacttccaggcccaggccccctgccactacgagggcaagtacttcaccctgggcgagagctggctgagaaaggactgcttccactgcacctgcctgcaccccgtgggcgtgggctgctgcgacaccagccagcaccccatcgacttccccgccggctgcgaggtgagacaggaggccggcacctgccagttcagcctggtgcagaagagcgaccccagactgccctgcaagggcggcggccccgaccccgagtggggcagcgccaacacccccgtgcccggcgcccccgccccccacagcagctag

SEQ ID NO: 4643 - DNA, 462 bp, Artificial Sequence
  Description of Artificial Sequence: Synthetic coding sequence
cactactgcaaggagggctactacagagacatgggcaagcccatcacccacagaaaggcctgcaaggcctgcgactgccaccccgtgggcgccgccggcaagacctgcaaccagaccaccggccagtgcccctgcaaggacggcgtgaccggcatcacctgcaacagatgcgccaagggctaccagcagagcagaagccccatcgccccctgcatcaagatccccgtggccccccccaccaccgccgccagcagcgtggaggagcccgaggccgccagacagcccaacaccttccaggccgagggcctgagcctgctgcccggcgccgccgagaaggagggcgccagatgctggggctacagaagaagactgggccacagagtggcccaggccgagtgcagaggccccagaagctgggcctggggcagaatcaccagcagcttcagcttcgccagcaactag

SEQ ID NO: 4644 - DNA, 213 bp, Artificial Sequence
  Description of Artificial Sequence: Synthetic coding sequence
atgctggtgctgttcctgctgggcaccgtgttcctgctgtgcccctactggggcgagctgcacgaccccatcaagggccagagcatgtaccactacagcaagctgagctgcatgaccagctgcgaggacatcaacttcctgggcttcaccaagagagtggagctgatctgctgcgaccacagcaactactgcaacctgcccgagggcgtgtag

SEQ ID NO: 4645 - DNA, 567 bp, Artificial Sequence; identical to SEQ ID NO: 4160
  Description of Artificial Sequence: Synthetic coding sequence

SEQ ID NO: 4646 - DNA, 2316 bp, Artificial Sequence; identical to SEQ ID NO: 3607
  Description of Artificial Sequence: Synthetic coding sequence

SEQ ID NO: 4647 - DNA, 1014 bp, Artificial Sequence
  Description of Artificial Sequence: Synthetic coding sequence
atggccagacccatgatcaaggaggccagaatggccagcctgctgctggagaacccctactacggctgcagaaagcccaaggaccaggtgagaagcagcctgaagaacgtgagcgacctgttcgtgatgggcggcgccctggtgctggagagcgccgccctgctgcactggctggagagagagggctacggccccctgggcatgaccggcatcagcatgggcggccacatggccagcctggccgtgagcaactggcccaagcccatgcccctgatcccctgcctgagctggagcaccgccagcggcgtgttcaccaccggcgtgctgagcaagagcatcaactggagagagctggagaagcagtactacacccagaccgtgtacgaggaggagatcatccacatgctggagtactgcggcaccgacagcttcaagatgggccaggagttcgtgaagcacttcaccagcagcgccgacaagctgaccaacctgaacctggtgagcagaaccctgaacctggacatcagcaaccaggtggtgagccagaagcccgccgactgccacaacagcagcaagaccagcgtgagcgccaccagcgagggcctgctgctgcaggacaccagcaagatgaagagattcaaccagaccctgagcaccaacaagagcggctacaccagcagaaacccccagagctaccacctgctgagcaaggagcagagcagaaacagcctgagaaaggagagcctgatcttcatgaagggcgtgatggacgagtgcacccacgtggccaacttcagcgtgcccgtggaccccagcctgatcatcgtggtgcaggccaaggaggacgcctacatccccagaaccggcgtgagaagcctgcaggagatctggcccggctgcgagatcagatacctggagggcggccacatcagcgcctacctgttcaagcagggcctgttcagacaggccatctacgacgccttcgacagattcctgcacaagtacgccaactag

SEQ ID NO: 4648 - DNA, 462 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaagtag

SEQ ID NO: 4649 - DNA, 345 bp, Artificial Sequence
  Description of Artificial Sequence: Synthetic coding sequence
atggacaagagcctgctgctggagctgcccatcctgctgtgctgcttcagagccctgagcggcagcctgagcatgagaaacgacgccgtgatcgagatcgtgcagtgcagaatgtgccacctgcagttccccggcgagaagtgcagcagaggcagaggcatctgcaccgccaccaccgaggaggcctgcatggtgggcagaatgttcaagagagacggcaacccctggctgaccttcatgggctgcctgaagaactgcgccgacgtgaagggcatcagatggagcgtgtacctggtgaacttcagatgctgcagaagccacgacctgtgcaacgaggacctgtag

SEQ ID NO: 4650 - DNA, 630 bp, Artificial Sequence; identical to SEQ ID NO: 4517
  Description of Artificial Sequence: Synthetic coding sequence

SEQ ID NO: 4651 - DNA, 639 bp, Artificial Sequence
  Description of Artificial Sequence: Synthetic coding sequence
gacttcggctactgccccagagtgtactgcgagaaccagcccatgctgcccatcggcgtgctggtgatggtgggcttcaccgtgggcaaggtgcccgtgcccgacatcagaacctgccacttctgcctggtggaggaccccagcgtgggctgcatcagcggcagcgagaagtgcaccatcagcagcagcagcctgtgcatggtgatcaccatctactacgacgtgaaggtgagattcatcgtgagaggctgcggccagtacatcagctacagatgccaggagaagagaaacacctacttcgccgagtactggtaccaggcccagtgctgccagtacgactactgcaacagctggagcagcccccagctgcagagcagcctgcccgagccccacgacagacccctggccctgcccctgagcgacagccagatccagtggttctaccaggccctgaacctgagcctgcccctgcccaacttccacgccggcaccgagcccgacggcctggaccccatggtgaccctgagcctgaacctgggcctgagcttcgccgagctgagaagaatgtacctgttcctgaacagcagcggcctgctggtgctgccccaggccggcctgctgaccccccaccccagctag

SEQ ID NO: 4652 - DNA, 240 bp, Artificial Sequence; identical to SEQ ID NO: 4408
  Description of Artificial Sequence: Synthetic coding sequence

SEQ ID NO: 4653 - DNA, 1620 bp, Artificial Sequence
  Description of Artificial Sequence: Synthetic coding sequence
atgagcgagccccaggagaagaagctgagcgagaacaccgacttcctggcccccggcgtgagcagcttcaccgacagcaaccagcaggagagcatcaccaagagagaggagaaccaggagcagcccagaaactacagccaccaccagctgaacagaagcagcaagcacagccagggcctgagagaccagggcaaccaggagcaggaccccaacatcagcaacggcgaggaggaggaggagaaggagcccggcgaggtgggcacccacaacgacaaccaggagagaaagaccgagctgcccagagagcacgccaacagcaagcaggaggaggacaacacccagagcgacgacatcctggaggagagcgaccagcccacccaggtgagcaagatgcaggaggacgagttcgaccagggcaaccaggagcaggaggacaacagcaacgccgagatggaggaggagaacgccagcaacgtgaacaagcacatccaggagaccgagtggcagagccaggagggcaagaccggcctggaggccatcagcaaccacaaggagaccgaggagaagaccgtgagcgaggccctgctgatggagcccaccgacgacggcaacaccacccccagaaaccacggcgtggacgacgacggcgacgacgacggcgacgacggcggcaccgacggccccagacacagcgccagcgacgactacttcatccccagccaggccttcctggaggccgagagagcccagagcatcgcctaccacctgaagatcgaggagcagagagagaaggtgcacgagaacgagaacatcggcaccaccgagcccggcgagcaccaggaggccaagaaggccgagaacagcagcaacgaggaggagaccagcagcgagggcaacatgagagtgcacgccgtggacagctgcatgagcttccagtgcaagagaggccacatctgcaaggccgaccagcagggcaagccccactgcgtgtgccaggaccccgtgacctgcccccccaccaagcccctggaccaggtgtgcggcaccgacaaccagacctacgccagcagctgccacctgttcgccaccaagtgcagactggagggcaccaagaagggccaccagctgcagctggactacttcggcgcctgcaagagcatccccacctgcaccgacttcgaggtgatccagttccccctgagaatgagagactggctgaagaacatcctgatgcagctgtacgaggccaacagcgagcacgccggctacctgaacgagaagcagagaaacaaggtgaagaagatctacctggacgagaagagactgctggccggcgaccaccccatcgacctgctgctgagagacttcaagaagaactaccacatgtacgtgtaccccgtgcactggcagttcagcgagctggaccagcaccccatggacagagtgctgacccacagcgagctggcccccctgagagccagcctggtgcccatggagcactgcatcaccagattcttcgaggagtgcgaccccaacaaggacaagcacatcaccctgaaggagtggggccactgcttcggcatcaaggaggaggacatcgacgagaacctgctgttctag

SEQ ID NO: 4654 - DNA, 2535 bp, Artificial Sequence; identical to SEQ ID NO: 3960
  Description of Artificial Sequence: Synthetic coding sequence

SEQ ID NO: 4655 - DNA, 993 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgctgggcaacgccctgttcaccgacctggtggtggacctgcaggacaccttcgtgagcgccatgaagaccctgtacctggccgacaccttccccaccaacttcagagacagcgccggcgccatgaagcagatcaacgactacgtggccaagcagaccaagggcaagatcgtggacctgctgaagaacctggacagcaacgccgtggtgatcatggtgaactacatcttcttcaaggccaagtgggagaccagcttcaaccacaagggcacccaggagcaggacttctacgtgaccagcgagaccgtggtgagagtgcccatgatgagcagagaggaccagtaccactacctgctggacagaaacctgagctgcagagtggtgggcgtgccctaccagggcaacgccaccgccctgttcatcctgcccagcgagggcaagatgcagcaggtggagaacggcctgagcgagaagaccctgagaaagtggctgaagatgttcaagaagagacagctggagctgtacctgcccaagttcagcatcgagggcagctaccagctggagaaggtgctgcccagcctgggcatcagcaacgtgttcaccagccacgccgacctgagcggcatcagcaaccacagcaacatccaggtgagcgagatggtgcacaaggccgtggtggaggtggacgagagcggcaccagagccgccgccgccaccggcaccatcttcaccttcagaagcgccagactgaacagccagagactggtgttcaacagacccttcctgatgttcatcgtggacaacaacatcctgttcctgggcaaggtgaacagaccctag

SEQ ID NO: 4656 - DNA, 2676 bp, Artificial Sequence; identical to SEQ ID NO: 4153
  Description of Artificial Sequence: Synthetic coding sequence

SEQ ID NO: 4657 - DNA, 708 bp, Artificial Sequence; identical to SEQ ID NO: 3939
  Description of Artificial Sequence: Synthetic coding sequence

SEQ ID NO: 4658 - DNA, 1386 bp, Artificial Sequence; identical to SEQ ID NO: 3950
  Description of Artificial Sequence: Synthetic coding sequence

SEQ ID NO: 4659 - DNA, 2676 bp, Artificial Sequence; identical to SEQ ID NO: 4153
  Description of Artificial Sequence: Synthetic coding sequence

SEQ ID NO: 4660 - DNA, 501 bp, Artificial Sequence; identical to SEQ ID NO: 4634
  Description of Artificial Sequence: Synthetic coding sequence

SEQ ID NO: 4661 - DNA, 420 bp, Artificial Sequence
  Description of Artificial Sequence: Synthetic coding sequence
atgcaggccgcctgctggtacgtgctgttcctgctgcagcccaccgtgtacctggtgacctgcgccaacctgaccaacggcggcaagagcgagctgctgaagagcggcagcagcaagagcaccctgaagcacatctggaccgagagcagcaaggacctgagcatcagcagactgctgagccagaccttcagaggcaaggagaacgacaccgacctggacctgagatacgacacccccgagccctacagcgagcaggacctgtgggactggctgagaaacagcaccgacctgcaggagcccagacccagagccaagagaagacccatcgtgaagaccggcaagttcaagaagatgttcggctggggcgacttccacagcaacatcaagaccgtgaagctgaacctgctgatcaccggctag

SEQ ID NO: 4662 - DNA, 2412 bp, Artificial Sequence
  Description of Artificial Sequence: Synthetic coding sequence
atggccgccgccggcctggtggccgtggccgccgccgccgagtacagcggcaccgtggccagcggcggcaacctgcccggcgtgcactgcggccccagcagcggcgccggccccggcttcggccccggcagctggagcagaagcctggacagagccctggaggaggccgccgtgaccggcgtgctgagcctgagcggcagaaagctgagagagttccccagaggcgccgccaaccacgacctgaccgacaccaccagagccgacctgagcagaaacagactgagcgagatccccatcgaggcctgccacttcgtgagcctggagaacctgaacctgtaccagaactgcatcagatacatccccgaggccatcctgaacctgcaggccctgaccttcctgaacatcagcagaaaccagctgagcaccctgcccgtgcacctgtgcaacctgcccctgaaggtgctgatcgccagcaacaacaagctggtgagcctgcccgaggagatcggccacctgagacacctgatggagctggacgtgagctgcaacgagatccagaccatccccagccagatcggcaacctggaggccctgagagacctgaacgtgagaagaaaccacctggtgcacctgcccgaggagctggccgagctgcccctgatcagactggacttcagctgcaacaagatcaccaccatccccgtgtgctacagaaacctgagacacctgcagaccatcaccctggacaacaaccccctgcagagcccccccgcccagatctgcatcaagggcaaggtgcacatcttcaagtacctgaacatccaggcctgcaagatcgcccccgacctgcccgactacgacagaagacccctgggcttcggcagctgccacgaggagctgtacagcagcagaccctacggcgccctggacagcggcttcaacagcgtggacagcggcgacaagagatggagcggcaacgagcccaccgacgagttcagcgacctgcccctgagagtggccgagatcaccaaggagcagagactgagaagagagagccagtaccaggagaacagaggcagcctggtggtgaccaacggcggcgtggagcacgacctggaccagatcgactacatcgacagctgcaccgccgaggaggaggaggccgaggtgagacagcccaagggccccgaccccgacagcctgagcagccagttcatggcctacatcgagcagagaagaatcagccacgagggcagccccgtgaagcccgtggccatcagagagttccagaagaccgaggacatgagaagatacctgcaccagaacagagtgcccgccgagcccagcagcctgctgagcctgagcgccagccacaaccagctgagccacaccgacctggagctgcaccagagaagagagcagctggtggagagaaccagaagagaggcccagctggccgccctgcagtacgaggaggagaagatcagaaccaagcagatccagagagacgccgtgctggacttcgtgaagcagaaggccagccagagcccccagaagcagcaccccctgctggacggcgtggacggcgagtgccccttccccagcagaagaagccagcacaccgacgacagcgccctgtgcatgagcctgagcggcctgaaccaggtgggctgcgccgccaccctgccccacagcagcgccttcacccccctgaagagcgacgacagacccaacgccctgctgagcagccccgccaccgagaccgtgcaccacagccccgcctacagcttccccgccgccatccagagaaaccagccccagagacccgagagcttcctgttcagagccggcgtgagagccgagaccaacaagggccacgccagccccctgccccccagcgccgcccccaccaccgacagcaccgacagcatcaccggccagaacagcagacagagagaggaggagctggagctgatcgaccagctgagaaagcacatcgagtacagactgaaggtgagcctgccctgcgacctgggcgccgccctgaccgacggcgtggtgctgtgccacctggccaaccacgtgagacccagaagcgtgcccagcatccacgtgcccagccccgccgtgcccaagctgaccatggccaagtgcagaagaaacgtggagaacttcctggaggcctgcagaaagatcggcgtgccccaggacaacctgtgcagccccagcgacatcctgcagctgaacctgagcgtgaagagaaccgtggagaccctgctgagcctgggcgcccacagcgaggagagcagcttcgtgtgcctgagcctgcagctgctgggcttcgtggccttctactgcaccgtgatgctgaccctgtgcgtgctgtactactggctgttccccgccagatag

SEQ ID NO: 4663 - DNA, 633 bp, Artificial Sequence
  Description of Artificial Sequence: Synthetic coding sequence
atgtacaaggccagaccccccgccggcagcggcggccccggcgccgagccccccgccatggccgcccccagaggcagagccgccccctggaccaccgccctgctgctgctgctggccagccaggtgctgagccccggcagctgcgccgacgaggaggaggtgcccgaggagtgggtgctgctgcacgtggtgcagggccagatcggcgccggcaactacagctacctgagactgaaccacgagggcaagatcgtgctgagaatgagaagcctgaagggcgacgccgacctgtacgtgagcgccagcagcctgcaccccagcttcgacgactacgagctgcagagcgccacctgcggccccgacgccgtgagcatccccgcccacttcagaagacccgtgggcatcggcgtgtacggccaccccagccacctggagagcgagttcgagatgaaggtgtactacgacggcaccgtggagcagcaccccttcggcgaggccgcctaccccgccgacggcgccgacgccggccagaagcacgccggcgcccccgaggacgccagccaggaggaggagagcgtgctgtggaccatcctgatcagcatcctgaagctggtgctggagatcctgttctag

SEQ ID NO: 4664 - DNA, 486 bp, Artificial Sequence
  Description of Artificial Sequence: Synthetic coding sequence
tgatgccccaccgagatcatcgccttcggcgacagactggaggagttcagaagcatcaacaccgaggtggtggcctgcagcgtggacagccagttcacccacctggcctggatcaacacccccagaagacagggcggcctgggccccatcagaatccccctgctgagcgacctgacccaccagatcagcaaggactacggcgtgtacctggaggacagcggccacaccctgagaggcctgttcatcatcgacgacaagggcatcctgagacagatcaccctgaacgacctgcccgtgggcagaagcgtggacgagaccctgagactggtgcaggccttccagtacaccgacaagcacggcgaggtgtgccccgccggctggaagcccggcagcgagaccatcaagcccgaggacaccatgaaggcctggtggcccagagagagctacaaccccagaagcagctggaaggccgaggtgttcagatag

SEQ ID NO: 4665 - DNA, 2886 bp, Artificial Sequence; identical to SEQ ID NO: 4184
  Description of Artificial Sequence: Synthetic coding sequence

SEQ ID NO: 4666 - DNA, 2853 bp, Artificial Sequence
  Description of Artificial Sequence: Synthetic coding sequence
atgacctggagaatgggccccagattcaccatgctgctggccatgtggctggtgtgcggcagcgagccccacccccacgccaccatcagaggcagccacggcggcagaaaggtgcccctggtgagccccgacagcagcagacccgccagattcctgagacacaccggcagaagcagaggcatcgagagaagcaccctggaggagcccaacctgcagcccctgcagagaagaagaagcgtgcccgtgctgagactggccagacccaccgagccccccgccagaagcgacatcaacggcgccgccgtgagacccgagcagagacccgccgccagaggcagccccagagagatgatcagagacgagggcagcagcgccagaagcagaatgctgagattccccagcggcagcagcagccccaacatcctggccagcttcgccggcaagaacagagtgtgggtgatcagcgccccccacgccagcgagggctactacagactgatgatgagcctgctgaaggacgacgtgtactgcgagctggccgagagacacatccagcagatcgtgctgttccaccaggccggcgaggagggcggcaaggtgagaagaatcaccagcgagggccagatcctggagcagcccctggaccccagcctgatccccaagctgatgagcttcctgaagctggagaagggcaagttcggcatggtgctgctgaagaagaccctgcaggtggaggagagatacccctaccccgtgagactggaggccatgtacgaggtgatcgaccagggccccatcagaagaatcgagaagatcagacagaagggcttcgtgcagaagtgcaaggccagcggcgtggagggccaggtggtggccgagggcaacgacggcggcggcggcgccggcagacccagcctgggcagcgagaagaagaaggaggaccccagaagagcccaggtgccccccaccagagagagcagagtgaaggtgctgagaaagctggccgccaccgcccccgccctgccccagccccccagcacccccagagccaccaccctgccccccgcccccgccaccaccgtgaccagaagcaccagcagagccgtgaccgtggccgccagacccatgaccaccaccgccttccccaccacccagagaccctggacccccagccccagccacagaccccccaccaccaccgaggtgatcaccgccagaagacccagcgtgagcgagaacctgtacccccccagcagaaaggaccagcacagagagagaccccagaccaccagaagacccagcaaggccaccagcctggagagcttcaccaacgccccccccaccaccatcagcgagcccagcaccagagccgccggccccggcagattcagagacaacagaatggacagaagagagcacggccacagagaccccaacgtggtgcccggcccccccaagcccgccaaggagaagccccccaagaagaaggcccaggacaagatcctgagcaacgagtacgaggagaagtacgacctgagcagacccaccgccagccagctggaggacgagctgcaggtgggcaacgtgcccctgaagaaggccaaggagagcaagaagcacgagaagctggagaagcccgagaaggagaagaagaagaagatgaagaacgagaacgccgacaagctgctgaagagcgagaagcagatgaagaagagcgagaagaagagcaagcaggagaaggagaagagcaagaagaagaagggcggcaagaccgagcaggacggctaccagaagcccaccaacaagcacttcacccagagccccaagaagagcgtggccgacctgctgggcagcttcgagggcaagagaagactgctgctgatcaccgcccccaaggccgagaacaacatgtacgtgcagcagagagacgagtacctggagagcttctgcaagatggccaccagaaagatcagcgtgatcaccatcttcggccccgtgaacaacagcaccatgaagatcgaccacttccagctggacaacgagaagcccatgagagtggtggacgacgaggacctggtggaccagagactgatcagcgagctgagaaaggagtacggcatgacctacaacgacttcttcatggtgctgaccgacgtggacctgagagtgaagcagtactacgaggtgcccatcaccatgaagagcgtgttcgacctgatcgacaccttccagagcagaatcaaggacatggagaagcagaagaaggagggcatcgtgtgcaaggaggacaagaagcagagcctggagaacttcctgagcagattcagatggagaagaagactgctggtgatcagcgcccccaacgacgaggactgggcctacagccagcagctgagcgccctgagcggccaggcctgcaacttcggcctgagacacatcaccatcctgaagctgctgggcgtgggcgaggaggtgggcggcgtgctggagctgttccccatcaacggcagcagcgtggtggagagagaggacgtgcccgcccacctggtgaaggacatcagaaactacttccaggtgagccccgagtacttcagcatgctgctggtgggcaaggacggcaacgtgaagagctggtaccccagccccatgtggagcatggtgatcgtgtacgacctgatcgacagcatgcagctgagaagacaggagatggccatccagcagagcctgggcatgagatgccccgaggacgagtacgccggctacggctaccacagctaccaccagggctaccaggacggctaccaggacgactacagacaccacgagagctaccaccacggctacccctactag

SEQ ID NO: 4667 - DNA, 351 bp, Artificial Sequence; identical to SEQ ID NO: 4162
  Description of Artificial Sequence: Synthetic coding sequence

SEQ ID NO: 4668 - DNA, 1251 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcggcagcggcagccagagcggcagcagcggcagcggcagcaacggcgacaacaacaacggcagcagcagcggcggcagcagcagcggcagcagcagcggcggcagcagcggcggcagcagcggcggcagcagcggcaacagcggcggcagcagaggcgacagcggcagcgagagcagctggggcagcagcaccggcagcagcagcggcaaccacggcggcagcggcggcggcaacggccacaagcccggctgcgagaagcccggcaacgaggccagaggcagcggcgagagcggcatccagggcttcagaggccagggcgtgagcagcaacatgagagagatcagcaaggagggcaacagactgctgggcggcagcggcgacaactacagaaacagcgagaccagccccggcatgttcaacttcgacaccttctggaagaacttcaagagcaagctgggcttcatcaactgggacgccatcaacaaggaccagagaagcagcagaatcccctag

SEQ ID NO: 4669 - DNA, 933 bp, Artificial Sequence
  Description of Artificial Sequence: Synthetic coding sequence
atggtggacaaggacaccgagagagacatcgagatgaagagacagctgagaagactgagagagctgcacctgtacagcacctggaagaagtaccaggaggccatgaagaccagcctgggcgtgccccagtgcgagagagacgagggcagcctgggcaagcccctgtgcccccccgagatcctgagcgagaccctgcccggcagcgtgaagaagagagtgtgcttccccagcgaggaccacctggaggagttcatcgccgagcacctgcccgaggccagcaaccagagcctgctgaccgtggcccacgccgacgccggcacccagaccaacggcgacctggaggacctggaggagcacggccccggccagaccgtgagcgaggaggccaccgaggtgcacaccatggagggcgaccccgacaccctggccgagttcctgatcagagacgtgctgcaggagctgagcagctacaacggcgaggaggaggaccccgaggaggtgaagaccagcctgggcgtgccccagagaggcgacctggaggacctggaggagcacgtgcccggccagaccgtgagcgaggaggccaccggcgtgcacatgatgcaggtggaccccgccaccctggccaagagcgacctggaggacctggaggagcacgtgcccgagcagaccgtgagcgaggaggccaccggcgtgcacatgatgcaggtggaccccgccaccctggccaagcagctggaggacagcaccatcaccggcagccaccagcagatgagcgccagccccagcagcgcccccgccgaggaggccaccgagaagaccaaggtggaggaggaggtgaagaccagaaagcccaagaagaagaccagaaagcccagcaagaagagcagatggaacgtgctgaagtgctgggacatcttcaacatcttctag

SEQ ID NO: 4670 - DNA, 150 bp, Artificial Sequence
  Description of Artificial Sequence: Synthetic coding sequence
atggccccccccagcgtgcccctggtgctgctgctggtgctgctgctgagcctggccgagacccccgccagcgcccccgcccacagaagcagcaccttccccaagtgggtgaccaagaccgagagaggcagacagcccctgagaagctag

SEQ ID NO: 4671 - DNA, 978 bp, Artificial Sequence; identical to SEQ ID NO: 3582
  Description of Artificial Sequence: Synthetic coding sequence

SEQ ID NO: 4672 - DNA, 390 bp, Artificial Sequence; identical to SEQ ID NO: 4161
  Description of Artificial Sequence: Synthetic coding sequence

SEQ ID NO: 4673 - DNA, 1056 bp, Artificial Sequence
  Description of Artificial Sequence: Synthetic coding sequence
atggccggcatccccggcctgctgttcctgctgttcttcctgctgtgcgccgtgggccaggtgagcccctacagcgccccctggaagcccacctggcccgcctacagactgcccgtggtgctgccccagagcaccctgaacctggccaagcagtacctgagctacgagaccctgtacgccaacggcagcagaaccgagacccaggtgggcatctacatcctgagcagcagcggcgacggcgcccagcacagagacagcggcagcagcggcaagagcagaagaaagagacagatctacggctacgacagcagattcagcatcttcggcaaggacttcctgctgaactaccccttcagcaccagcgtgaagctgagcaccggctgcaccggcaccctggtggccgagaagcacgtgctgaccgccgcccactgcatccacgacggcaagacctacgtgaagggcacccagaagctgagagtgggcttcctgaagcccaagttcaaggacggcggcagaggcgccaacgacagcaccagcgccatgcccgagcagatgaagttccagtggatcagagtgaagagaacccacgtgcccaagggctggatcaagggcaacgccaacgacatcggcatggactacgactacgccctgctggagctgaagaagccccacaagagaaagttcatgaagatcggcgtgagcccccccgccaagcagctgcccggcggcagaatccacttcagcggctacgacaacgacagacccggcaacctggtgtacagattctgcgacgtgaaggacgagacctacgacctgctgtaccagcagtgcgacgcccagcccggcgccagcggcagcggcgtgtacgtgagaatgtggaagagacagcagcagaagtgggagagaaagatcatcggcatcttcagcggccaccagtgggtggacatgaacggcagcccccaggacttcaacgtggccgtgagaatcacccccctgaagtacgcccagatctgctactggatcaagggcaactacctggactgcagagagggctag

SEQ ID NO: 4674 - DNA, 345 bp, Artificial Sequence
  Description of Artificial Sequence: Synthetic coding sequence
atggagagaggcgccggcgccaagctgctgcccctgctgctgctgctgagagccaccggcttcacctgcgcccagaccgacggcagaaacggctacaccgccgtgatcgaggtgaccagcggcggcccctggggcgactgggcctggcccgagatgtgccccgacggcttcttcgccagcggcttcagcctgaaggtggagcccccccagggcatccccggcgacgacaccgccctgaacggcatcagactgcactgcgccagaggcaacgtgctgggcaacacccacgtggtggagagccagagcggcagatggggcgccggcgtggaggaccccctgggctag

SEQ ID NO: 4675 - DNA, 825 bp, Artificial Sequence
  Description of Artificial Sequence: Synthetic coding sequence
atgtggagatgccccctgggcctgctgctgctgctgcccctggccggccacctggccctgggcgcccagcagggcagaggcagaagagagctggcccccggcctgcacctgagaggcatcagagacgccggcggcagatactgccaggagcaggacctgtgctgcagaggcagagccgacgactgcgccctgccctacctgggcgccatctgctactgcgacctgttctgcaacagaaccgtgagcgactgctgccccgacttctgggacttctgcctgggcgtgcccccccccttcccccccatccagggctgcatgcacggcggcagaatctaccccgtgctgggcacctactgggacaactgcaacagatggccccccctggagtgctgggacctgctgccccccgccctgcccggccccgtgtgggccgccctgggcgccaaggaggagatggccggcaaggacagaaccgtgtactgccccctgctgatgaaggccctgggcgccagagtgggcgagtgccccggctgccagagcccccagagaatgctgcccgagagcagcagagtgctgctgcccagatgcgccgagggcgagcagcccggcgtgcagagaggcaagggcagaatgagaaaggccttccccgccctgcagacccccctggccctgcccagcagcgcccccgccagccccggcgccggcaagcccagccacaccggcagctggctgcccctgagactgctgaagagacagcactggagatgggagccctggaccgcctgcaaggaggccgtgcagcacctggtgatcaccgagctgtag

SEQ ID NO: 4676 - DNA, 438 bp, Artificial Sequence
  Description of Artificial Sequence: Synthetic coding sequence
atggcccagctgttcctgcccctgctggccgccctggtgctggcccaggcccccgccgccctggccgacgtgctggagggcgacagcagcgaggacagagccttcagagtgagaatcgccggcgacgcccccctgcagggcgtgctgggcggcgccctgaccatcccctgccacgtgcactacctgagacccccccccagcagaagagccgtgctgggcagccccagagtgaagtggaccttcctgagcagaggcagagaggccgaggtgctggtggccagaggcgtgagagtgaaggtgaacgaggcctacagattcagagtggccctgcccgcctaccccgccagcctgaccgacgtgagcctggccctgagcgagctgagacccaacgacagcggcatctacagatgcgaggtgcagcacggcatcgacgactag

SEQ ID NO: 4677 - DNA, 567 bp, Artificial Sequence; identical to SEQ ID NO: 4160
  Description of Artificial Sequence: Synthetic coding sequence

SEQ ID NO: 4678 - DNA, 558 bp, Artificial Sequence
  Description of Artificial Sequence: Synthetic coding sequence
atgggccccgccggctgcgccttcaccctgctgctgctgctgggcatcagcgacagagactaccacagcgccctgcaggaggccgaggtgcccatcatcgacagacaggcctgcgagcagctgtacaaccccatcggcatcttcctgcccgccctggagcccgtgatcaaggaggacaagatctgcgccggcgacacccagaacatgaaggacagctgcaagggcgacagcggcggccccctgagctgccacatcgacggcgtgtggatccagaccggcgtggtgagctggggcctggagtgcggcaagagcctgcccggcgtgtacaccaacgtgatctactaccagaagtggatcaacgccaccatcagcagagccaacaacctggacttcagcgacttcctgttccccatcgtgctgctgagcctggccctgctgagacccagctgcgccttcggccccaacaccatccacagagtgggcaccgtggccgaggccgtggcctgcatccagggctgggaggagaacgcctggagattcagccccagaggcagatag

SEQ ID NO: 4679 - DNA, 1653 bp, Artificial Sequence
  Description of Artificial Sequence: Synthetic coding sequence
cccgcccccgccagcagaaagctgctgcccagaagacacctgagcgagaagagccaccacatcagcatccccagccccgacatcagccacaagggcctgagaagcaagagaacccagcccagcgaccccgagacctgggagagcctgcccagactggacagccagagacacggcggccccgagttcagcttcgacctgctgcccgaggccagagccatcagagtgaccatcagcagcggccccgaggtgagcgtgagactgtgccaccagtgggccctggagtgcgaggagctgagcagcccctacgacgtgcagaagatcgtgagcggcggccacaccgtggagctgccctacgagttcctgctgccctgcctgtgcatcgaggccagctacctgcaggaggacaccgtgagaagaaagaagtgccccttccagagctggcccgaggcctacggcagcgacttctggaagagcgtgcacttcaccgactacagccagcacacccagatggtgatggccctgaccctgagatgccccctgaagctggaggccgccctgtgccagagacacgactggcacaccctgtgcaaggacctgcccaacgccaccgccagagagagcgacggctggtacgtgctggagaaggtggacctgcacccccagctgtgcttcaagttcagcttcggcaacagcagccacgtggagtgcccccaccagaccggcagcctgaccagctggaacgtgagcatggacacccaggcccagcagctgatcctgcacttcagcagcagaatgcacgccaccttcagcgccgcctggagcctgcccggcctgggccaggacaccctggtgccccccgtgtacaccgtgagccaggccagaggcagcagccccgtgagcctggacctgatcatccccttcctgagacccggctgctgcgtgctggtgtggagaagcgacgtgcagttcgcctggaagcacctgctgtgccccgacgtgagctacagacacctgggcctgctgatcctggccctgctggccctgctgaccctgctgggcgtggtgctggccctgacctgcagaagaccccagagcggccccggccccgccagacccgtgctgctgctgcacgccgccgacagcgaggcccagagaagactggtgggcgccctggccgagctgctgagagccgccctgggcggcggcagagacgtgatcgtggacctgtgggagggcagacacgtggccagagtgggccccctgccctggctgtgggccgccagaaccagagtggccagagagcagggcaccgtgctgctgctgtggagcggcgccgacctgagacccgtgagcggccccgaccccagagccgcccccctgctggccctgctgcacgccgcccccagacccctgctgctgctggcctacttcagcagactgtgcgccaagggcgacatccccccccccctgagagccctgcccagatacagactgctgagagacctgcccagactgctgagagccctggacgccagacccttcgccgaggccaccagctggggcagactgggcgccagacagagaagacagagcagactggagctgtgcagcagactggagagagaggccgccagactggccgacctgggctag

SEQ ID NO: 4680 - DNA, 816 bp, Artificial Sequence
  Description of Artificial Sequence: Synthetic coding sequence
atgggcatcgtgtgcgcccagtgcagcttcatcctgctgctgagcatcatcagagccagacccccccccttcctgttctgccccctgagcagccagagaaccgagagcccctacaagcccgtgcacctgggcctgggccccaccgacaaggtggccgccatcgccatggccagaatcatcgacctggtgccctgggacgacggcagcacccacgtgtacgccagccccgccatcctgctgcccatggagagacagagaaaccagctggccggcgtgaagcagcagctgtaccaccccgccctgcccaccctgagacacatggacagagacaccgtgaaggcctgcctgcccgacgagcactgccagagcaccacctactgcagaaaggacgagttcgacaacgcccacttcaccctgctgggcgtgcccaacaagcccctgcagtgcctggacatcaccgccaccggccagaagctgagaaacagataccacgagggcaagctggcccccatcgcccccggcatcaacagagtggactggccctgcttcaccagagccatcgaggactggagccacttcgtgagcagcgccggcgagttcaagctgccctgcctgagaaagagagccgagggcctgagcggctacgccgtgagatacctgaagcccgacgtgacccagacctggagatactgcctgagccagaaccccagcctggacagatacggccagaagcccctgcccttcgacagcctgaacaccttcagaagcttcggcagcagctacagcagagtgaactacctgaccccctggcactag

SEQ ID NO: 4681 - DNA, 1743 bp, Artificial Sequence; identical to SEQ ID NO: 3924
  Description of Artificial Sequence: Synthetic coding sequence

SEQ ID NO: 4682 - DNA, 513 bp, Artificial Sequence
  Description of Artificial Sequence: Synthetic coding sequence
atggagttcgtggacgtgaccgagagcaacgccagatgggtgcaggacttcagactgaaggcctacgccagccccgccaagctggagagcatcgacggcgccagataccacgccctgctgatccccagctgccccggcgccctgaccgacctggccagcagcggcagcctggccagaatcctgcagcacttccacagcgagagcaagcccatctgcgccgtgggccacggcgtggccgccctgtgctgcgccaccaacgaggacagaagctgggtgttcgacagctacagcctgaccggccccagcgtgtgcgagctggtgagagcccccggcttcgccagactgcccctggtggtggaggacttcgtgaaggacagcggcgcctgcttcagcgccagcgagcccgacgccgtgcacgtggtgctggacagacacctggtgaccggccagaacgccagcagcaccgtgcccgccgtgcagaacctgctgttcctgtgcggcagcagaaagtag

SEQ ID NO: 4683 - DNA, 1041 bp, Artificial Sequence
  Description of Artificial Sequence: Synthetic coding sequence
atgagactgctgttcctggccgtgctgagaccccacaccggcaacgccgtgaccgcccagagagtgagagcccacctggaggccgccggccacgtgtgcgtgctgaaggacgccttcgacttcgagagcagaagcgagatcgccaacctgatcctggccgagaactgcgaggccgccctggccctgcacctgtacagaggcggcagactgctgcagggccacagaatccccttcggcgtgatcttcggcggcaccgacgtgaacgaggacgccaaccaggccgagaagaacaccgtgatgggcagagtgctggaggaggccagattcgccgtggccttcaccgagagcatgaaggagatggcccaggcccagtggccccacgccaagggcaaggtgtacgtgcagagccagggcatcgccaccacccccaacgccgccttcaactggaacaccttcctgcagagaagcgagatcaaccagagcgccgacaacctgcacatcttcctgctgatctgcggcctgagacaggtgaaggaccccctgtacctggtggacgccttcagcgcctggcaccaggaggagcccaacgtgcacctggtgatcgtgggccccgaggtggaccccgtgttcaccagagaggtgaaggccaaggtgaagagagccgccggcgtgagactgatcggcgagatgccccaggaggacctgcacgccgtggtgaagaactgcttcgccgtggtgaacagcagcgtgagcgagggcatgagcgccgccatcctggaggccatggacctggaggtgcccgtgctggccagaaacatccccggcaacgccgccgtggtgaagcacgaggtgaccggcctgctgttcagcaacccccaggagttcgtgcacctggccaagagactggtgagcgaccccgccctggagaaggagatcgtggtgaacggcagagagtacgtgagaatgtaccacagctggcaggtggagagagacacctaccagcagctgatcagaaagctggagggcagcaccgaggactag

SEQ ID NO: 4684 - DNA, 1482 bp, Artificial Sequence; identical to SEQ ID NO: 4484
  Description of Artificial Sequence: Synthetic coding sequence

SEQ ID NO: 4685 - DNA, 354 bp, Artificial Sequence
  Description of Artificial Sequence: Synthetic coding sequence
atgctgatcttctggaccatcaccctgttcctgctgggcgccgccaagggcaaggaggtgtgctacgaggacctgggctgcttcagcgacaccgagccctggggcggcaccgccatcagacccctgaagatcctgccctggagccccgagaagatcggcaccagattcctgctgtacaccaacgagaaccccaacaacttccagatcctgctgctgagcgaccccagcaccatcgaggccagcaacttccagatggacagaaagaccagattcatcatccacggcttcatcgacaagggcgacgagagctgggtgaccgacatgtgcaagcccggcgccagccccagagcctag

SEQ ID NO: 4686 - DNA, 1581 bp, Artificial Sequence
  Description of Artificial Sequence: Synthetic coding sequence
atgcagggccccctgctgctgcccggcctgtgcttcctgctgagcctgttcggcgccgtgacccagaagaccaagaccagctgcgccaagtgcccccccaacgccagctgcgtgaacaacacccactgcacctgcaaccacggctacaccagcggcagcggccagaagctgttcaccttccccctggagacctgcaacgccatcgagacccaggccatcaccgacaactgcagcgaggagagaaagaccttcaacctgaacgtgcagatgaacagcatggacatcagatgcagcgacatcatccagggcgacacccagggccccagcgccatcgccttcatcagctacagcagcctgggcaacatcatcaacgccaccttcttcgaggagatggacaagaaggaccaggtgtacctgaacagccaggtggtgagcgccgccatcggccccaagagaaacgtgagcctgagcaagagcgtgaccctgaccttccagcacgtgaagatgacccccagcaccaagaaggtgttctgcgtgtactggaagagcaccggccagggcagccagtggagcagagacggctgcttcctgatccacgtgaacaagagccacaccatgtgcaactgcagccacctgagcagcttcgccgtgctgatggccctgaccagccaggaggaggaccccgtgctgaccgtgatcacctacgtgggcctgagcgtgagcctgctgtgcctgctgctggccgccctgaccttcctgctgtgcaaggccatcagaaacaccagcaccagcctgcacctgcagctgagcctgtgcctgttcctggcccacctgctgttcctggtgggcatcgacagaaccgagcccaaggtgctgtgcagcatcatcgccggcgccctgcactacctgtacctggccgccttcacctggatgctgctggagggcgtgcacctgttcctgaccgccagaaacctgaccgtggtgaactacagcagcatcaacagactgatgaagtggatcatgttccccgtgggctacggcgtgcccgccgtgaccgtggccatcagcgccgccagctggccccacctgtacggcaccgccgacagatgctggctgcacctggaccagggcttcatgtggagcttcctgggccccgtgtgcgccatcttcagcgccaacctggtgctgttcatcctggtgttctggatcctgaagagaaagctgagcagcctgaacagcgaggtgagcaccatccagaacaccagaatgctggccttcaaggccaccgcccagctgttcatcctgggctgcacctggtgcctgggcctgctgcaggtgggccccgccgcccaggtgatggcctacctgttcaccatcatcaacagcctgcagggcttcttcatcttcctggtgtactgcctgctgagccagcaggtgcagaagcagtaccagaagtggttcagagagatcgtgaagagcaagagcgagagcgagacctacaccctgagcagcaagatgggccccgacagcaagcccagcgagggcgacgtgttccccggccaggtgaagagaaagtactag

SEQ ID NO: 4687 - DNA, 5832 bp, Artificial Sequence
  Description of Artificial Sequence: Synthetic coding sequence
tgacccagcctggccggcagaggcgccggcagaatggcccccggcgccctgagaggcggctgcgagcagagagcccccggcggcggcgccagaaccgccgccctgggcccctggccctggcccagccccggccccgcccccagccccggcgccgccccccccagaagcagaaagatgagcggcgccctgctgtggcccctgctgcccctgctgctgctgctgctgagcgccagagacggcgtgagagccgcccagccccaggcccccggctacctgatcgccgcccccagcgtgttcagagccggcgtggaggaggtgatcagcgtgaccatcttcaacagccccagagaggtgaccgtgcaggcccagctggtggcccagggcgagcccgtggtgcagagccagggcgccatcctggacaagggcaccatcaagctgaaggtgcccaccggcctgagaggccaggccctgctgaaggtgtggggcagaggctggcaggccgaggagggccccctgttccacaaccagaccagcgtgaccgtggacggcagaggcgccagcgtgttcatccagaccgacaagcccgtgtacagaccccagcacagagtgctgatcagcatcttcaccgtgagccccaacctgagacccgtgaacgagaagctggaggcctacatcctggaccccagaggcagcagaatgatcgagtggagacacctgaagcccttctgctgcggcatcaccaacatgagcttccccctgagcgaccagcccgtgctgggcgagtggttcatcttcgtggagatgcagggccacgcctacaacaagagcttcgaggtgcagaagtacgtgctgcccaagttcgagctgctgatcgacccccccagatacatccaggacctggacgcctgcgagaccggcaccgtgagagccagatacaccttcggcaagcccgtggccggcgccctgatgatcaacatgaccgtgaacggcgtgggctactacagccacgaggtgggcagacccgtgctgagaaccaccaagatcctgggcagcagagacttcgacatctgcgtgagagacatgatccccgccgacgtgcccgagcacttcagaggcagagtgagcatctgggccatggtgaccagcgtggacggcagccagcaggtggccttcgacgacagcacccccgtgcagagacagctggtggacatcagatacagcaaggacaccagaaagcagttcaagcccggcctggcctacgtgggcaaggtggagctgagctaccccgacggcagccccgccgagggcgtgaccgtgcagatcaaggccgagctgacccccaaggacaacatctacaccagcgaggtggtgagccagagaggcctggtgggcttcgagatccccagcatccccaccagcgcccagcacgtgtggctggagaccaaggtgatggccctgaacggcaagcccgtgggcgcccagtacctgcccagctacctgagcctgggcagctggtacagccccagccagtgctacctgcagctgcagccccccagccaccccctgcaggtgggcgaggaggcctacttcagcgtgaagagcacctgcccctgcaacttcaccctgtactacgaggtggccgccagaggcaacatcgtgctgagcggccagcagcccgcccacaccacccagcagagaagcaagagagccgcccccgccctggagaagcccatcagactgacccacctgagcgagaccgagcccccccccgcccccgaggccgaggtggacgtgtgcgtgaccagcctgcacctggccgtgacccccagcatggtgcccctgggcagactgctggtgttctacgtgagagagaacggcgagggcgtggccgacagcctgcagttcgccgtggagaccttcttcgagaaccaggtgagcgtgacctacagcgccaacgagacccagcccggcgaggtggtggacctgagaatcagagccgccagaggcagctgcgtgtgcgtggccgccgtggacaagagcgtgtacctgctgagaagcggcttcagactgacccccgcccaggtgttccaggagctggaggactacgacgtgagcgacagcttcggcgtgagcagagaggacggccccttctggtgggccggcctgaccgcccagagaagaagaagaagcagcgtgttcccctggccctggggcatcaccaaggacagcggcttcgccttcaccgagaccggcctggtggtgatgaccgacagagtgagcctgaaccacagacaggacggcggcctgtacaccgacgaggccgtgcccgccttccagccccacaccggcagcctggtggccgtggcccccagcagacacccccccagaaccgagaagagaaagagaaccttcttccccgagacctggatctggcactgcctgaacatcagcgaccccagcggcgagggcaccctgagcgtgaaggtgcccgacagcatcaccagctgggtgggcgaggccgtggccctgagcaccagccagggcctgggcatcgccgagcccagcctgctgaagaccttcaagcccttcttcgtggacttcatgctgcccgccctgatcatcagaggcgagcaggtgaagatccccctgagcgtgtacaactacatgggcacctgcgccgaggtgtacatgaagctgagcgtgcccaagggcatccagttcgtgggccaccccggcaagagacacgtgaccaagaagatgtgcgtggcccccggcgaggccgagcccatctgggtggtgctgagcttcagcgacctgggcctgaacaacatcaccgccaaggccctggcctacggcgacaccaactgctgcagagacggcagaagcagcaagcaccccgaggagaaccacgccgacagaagagtgcccatcggcgtggaccacgtgagaagaagcgtgatggtggaggccgagggcgtgcccagagcctacacctacagcgccttcttctgccccagcgagagagtgcacatcagcacccccaacaagtacgagttccagtacgtgcagagacccctgagactgaccagattcgacgtggccgtgagagcccacaacgacgccagagtggccctgagcagcggcccccaggacaccgccggcatgatcgagatcgtgctgggcggccaccagaacaccagaagctggatcagcaccagcaagatgggcgagcccgtggccagcgcccacaccgccaagatcctgagctgggacgagttcagaaccttctggatcagctggagaggcggcctgatccaggtgggccacggccccgagcccagcaacgagagcgtgatcgtggcctggaccctgcccagaccccccgaggtgcagttcatcggcttcagcaccggctggggcagcatgggcgagttcagaatctggagaaagatggaggtggacgagagctacagcgaggccttcaccctgggcgtgccccacggcgccatccccggcagcgagagagccaccgccagcatcatcggcgacgtgatgggccccaccctgaaccacctgaacaacctgctgagactgcccttcggctgcggcgagcagaacatgatccacttcgcccccaacgtgttcgtgctgaagtacctgcagaagacccagcagctgagccccgaggtggagagagagaccaccgactacctggtgcagggctaccagagacagctgacctacaagagacaggacggcagctacagcgccttcggcgagagagacgccagcggcagcatgtggctgaccgccttcgtgctgaagagcttcgcccaggccagaagcttcatcttcgtggaccccagagagctggccgccgccaagagctggatcatccagcagcagcaggccgacggcagcttcctggccgtgggcagagtgctgaacaaggacatccagggcggcatccacggcaccgtgcccctgaccgcctacgtggtggtggccctgctggagaccggcaccgccagcgaggaggagagaggcagcaccgacaaggccagacacttcctggagagcgccgcccccctggccatggacccctacagctgcgccctgaccacctacgccctgaccctgctgagaagccccgccgcccccgaggccctgagaaagctgagaagcctggccatcatgagagacggcgtgacccactggagcctgagcaacagctgggacgtggacaagggcaccttcctgagcttcagcgacagagtgagccagagcgtggtgagcgccgaggtggagatgaccgcctacgccctgctgacctacaccctgctgggcgacgtggccgccgccctgcccgtggtgaagtggctgagccagcagagaaacgccctgggcggcttcagcagcacccaggacacctgcgtggccctgcaggccctggccgagtacgccatcctgagctacgccggcggcatcaacctgaccgtgagcctggccagcaccaacctggactaccaggagaccttcgagctgcacagaaccaaccagaaggtgctgcagaccgccgccatccccagcctgcccaccggcctgttcgtgagcgccaagggcgacggctgctgcctgatgcagatcgacgtgacctacaacgtgcccgaccccgtggccaagcccgccttccagctgctggtgagcctgcaggagcccgaggcccagggcagacccccccccatgcccgccagcgccgccgagggcagcagaggcgactggccccccgccgacgacgacgaccccgccgccgaccagcaccaccaggagtacaaggtgatgctggaggtgtgcaccagatggctgcacgccggcagcagcaacatggccgtgctggaggtgcccctgctgagcggcttcagagccgacatcgagagcctggagcagctgctgctggacaagcacatgggcatgaagagatacgaggtggccggcagaagagtgctgttctacttcgacgagatccccagcagatgcctgacctgcgtgagattcagagccctgagagagtgcgtggtgggcagaaccagcgccctgcccgtgagcgtgtacgactactacgagcccgccttcgaggccaccagattctacaacgtgagcacccacagccccctggccagagagctgtgcgccggccccgcctgcaacgaggtggagagagcccccgccagaggccccggctggttccccggcgagagcggccccgccgtggcccccgaggagggcgccgccatcgccagatgcggctgcgaccacgactgcggcgcccagggcaaccccgtgtgcggcagcgacggcgtggtgtacgccagcgcctgcagactgagagaggccgcctgcagacaggccgcccccctggagcccgccccccccagctgctgcgccctggagcagagactgcccgccagcagcagcagcacctacggcgacgacctggccagcgtggcccccggccccctgcagcaggacgtgaagctgaacggcgccggcctggaggtggaggacagcgaccccgagcccgagggcgaggccgaggacagagtgaccgccggccccagaccccccgtgagcagcggcaacctggagagcagcacccagagcgccagccccttccacagatggggccagacccccgccccccagagacacagcggcagagtggtgggcgcccacagacccggcctgctgagccccgtgttcgtgtacagccccgccttccagagcggcggcgaggagggcctgtggatgagcaacacctgcaccctgagatag

SEQ ID NO: 4688 - DNA, 456 bp, Artificial Sequence
  Description of Artificial Sequence: Synthetic coding sequence
atggaggccaccggcaccgacgaggtggacaagctgaagaccaagttcatcagcgcctggaacaacatgaagtacagctgggtgctgaagaccaagacctacttcagcagaaacagccccgtgctgctgctgggcaagtgctaccacttcaagtacgaggacgaggacaagaccctgcccgccgagagcggctgcaccatcgaggaccacgtgatcgccggcaacgtggaggagttcagaaaggacttcatcagcagaatctggctgacctacagagaggagttcccccagatcgagggcagcgccctgaccaccgactgcggctggggctgcaccctgagaaccggccagatgctgctggcccagggcctgatcctgcacttcctgggcagagcctggacctggcccgacgccctgaacatcgagaacagcgacagcgagagctggaccagctag

SEQ ID NO: 4689 - DNA, 2616 bp, Artificial Sequence
  Description of Artificial Sequence: Synthetic coding sequence
atgagaaagcccagaagaaagagcagacagaacgccgagggcagaagaagccccagcccctacagcctgaagtgcagccccaccagagagaccctgacctacgcccaggcccagagaatcgtggaggtggacatcgacggcagactgcacagaatcagcatctacgaccccctgaagatcatcaccgaggacgagctgaccgcccaggacatcaccgagtgcaacagcaacaaggagaacagcgagcagccccagttccccggcaagagcaagaagcccagcagcaagggcaagaagaaggagagctgcagcaagcacgccagcggcaccagcttccacctgccccagcccagcttcagaatggtggacagcggcatccagcccgaggccccccccctgcccgccgcctactacagatacatcgagaagccccccgaggacctggacgccgaggtggagtacgacatggacgaggaggacctggcctggctggacatggtgaacgagaagagaagagtggacggccacagcctggtgagcgccgacaccttcgagctgctggtggacagactggagaaggagagctacctggagagcagaagcagcggcgcccagcagagcctgatcgacgaggacgccttctgctgcgtgtgcctggacgacgagtgccacaacagcaacgtgatcctgttctgcgacatctgcaacctggccgtgcaccaggagtgctacggcgtgccctacatccccgagggccagtggctgtgcagatgctgcctgcagagccccagcagacccgtggactgcatcctgtgccccaacaagggcggcgccttcaagcagaccagcgacggccactgggcccacgtggtgtgcgccatctggatccccgaggtgtgcttcgccaacaccgtgttcctggagcccatcgagggcatcgacaacatcccccccgccagatggaagctgacctgctacatctgcaagcagaagggcctgggcgccgccatccagtgccacaaggtgaactgctacaccgccttccacgtgacctgcgcccagagagccggcctgttcatgaagatcgagcccatgagagagaccagcctgaacggcaccatcttcaccgtgagaaagaccgcctactgcgaggcccacagcccccccggcgccgccaccgccagaagaaagggcgacagccccagaagcatcagcgagaccggcgacgaggagggcctgaaggagggcgacggcgaggaggaggaggaggaggaggtggaggaggaggagcaggaggcccagggcggcgtgagcggcagcctgaagggcgtgcccaagaagagcaagatgagcctgaagcagaagatcaagaaggagcccgaggaggccggccaggacacccccagcaccctgcccatgctggccgtgccccagatccccagctacagactgaacaagatctgcagcggcctgagcttccagagaaagaaccagttcatgcagagactgcacaactactggctgctgaagagacaggccagaaacggcgtgcccctgatcagaagactgcacagccacctgcagagccagagaaacgccgagcagagagagcaggacgagaagaccagcgccgtgaaggaggagctgaagtactggcagaagctgagacacgacctggagagagccagactgctgatcgagctgatcagaaagagagagaagctgaagagagagcaggtgaaggtgcagcaggccgccatggagctggagctgatgcccttcaacgtgctgctgagaaccaccctggacctgctgcaggagaaggaccccgcccacatcttcgccgagcccgtgaacctgagcgaggtgcccgactacctggagttcatcagcaagcccatggacttcagcaccatgagaagaaagctggagagccacctgtacagaaccctggaggagttcgaggaggacttcaacctgatcgtgaccaactgcatgaagtacaacgccaaggacaccatcttccacagagccgccgtgagactgagagacctgggcggcgccatcctgagacacgccagaagacaggccgagaacatcggctacgaccccgagagaggcacccacctgcccgagagccccaagctggaggacttctacagattcagctgggaggacggcagaagcctgctgctgcccttcgaggacagaggcgacctggagcccctggagctggtgtgggccaagtgcagaggctaccccagctaccccgccctgatcatcgaccccaagatgcccagagagggcctgctgcacaacggcgtgcccatccccgtgccccccctggacgtgctgaagctgggcgagcagaagcaggccgaggccggcgagaagctgttcctggtgctgttcttcgacaacaagagaacctggcagtggctgcccagagacaaggtgctgcccctgggcgtggaggacaccgtggacaagctgaagatgctggagggcagaaagaccagcatcagaaagagcgtgcaggtggcctacgacagagccatgatccacctgagcagagtgagaggcccccacagcttcgtgaccagcagctacctgtag

SEQ ID NO: 4690 - DNA, 2700 bp, Artificial Sequence; identical to SEQ ID NO: 4183
  Description of Artificial Sequence: Synthetic coding sequence

SEQ ID NO: 4691 - DNA, 537 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcaccgacgaggagatgcagtacgacatggccaagagcggccaggagaagcagaccatcgagatcctgatgaaccccatcctgctggtgaagaacaccagcctgagcatgagcaaggacgacatgagcagcaccctgctgaccttcagaagcctgcactacaacgaccccaagggcaacagcagcggcaacgacaaggagtgctgcaacgacatgaccgtgtggagaaaggtgagcgaggccaacggcagctgcaagtggagcaacaacttcatcagaagcagcaccgaggtgatgagaagagtgcacagagcccccagctgcaagttcgtgcagaaccccggcatcagctgctgcgagagcctggagctggagaacaccgtgtgccagttcaccaccggcaagcagttccccagatgccagtaccacagcgtgaccagcctggagtag

SEQ ID NO: 4692 - DNA, 2184 bp, Artificial Sequence
  Description of Artificial Sequence: Synthetic coding sequence
atgatcctgagcctgctgttcagcctgggcggccccctgggctggggcctgctgggcgcctgggcccaggccagcagcaccagcctgagcgacctgcagagcagcagaacccccggcgtgtggaaggccgaggccgaggacaccggcaaggaccccgtgggcagaaactggtgcccctaccccatgagcaagctggtgaccctgctggccctgtgcaagaccgagaagttcctgatccacagccagcagccctgcccccagggcgcccccgactgccagaaggtgaaggtgatgtacagaatggcccacaagcccgtgtaccaggtgaagcagaaggtgctgaccagcctggcctggagatgctgccccggctacaccggccccaactgcgagcaccacggccccatggccgtgtggtgctggcccgagcccgacagcctgcaggccagactgggccagctgcagagaaacctgagcgagctgcacatgaccaccgccagaagagaggaggagctgcagtacaccctggaggacatgagagccaccctgaccagacacgtggacgagatcaaggagctgtacagcgagagcgacgagaccttcgaccagatcagcaaggtggagagacaggtggaggagctgcaggtgaaccacaccgccctgagagagctgagagtgatcctgatggagaagagcctgatcatggaggagaacaaggaggaggtggagagacagctgctggagctgaacctgaccctgcagcacctgcagggcggccacgccgacctgatcaagtacgtgaaggactgcaactgccagaagctgtacctggacctggacgtgatcagagagggccagagagacgccaccagagccctggaggagacccaggtgagcctggacgagagaagacagctggacggcagcagcctgcaggccctgcagaacgccgtggacgccgtgagcctggccgtggacgcccacaaggccgagggcgagagagccagagccgccaccagcagactgagaagccaggtgcaggccctggacgacgaggtgggcgccctgaaggccgccgccgccgaggccagacacgaggtgagacagctgcacagcgccttcgccgccctgctggaggacgccctgagacacgaggccgtgctggccgccctgttcggcgaggaggtgctggaggagatgagcgagcagacccccggccccctgcccctgagctacgagcagatcagagtggccctgcaggacgccgccagcggcctgcaggagcaggccctgggctgggacgagctggccgccagagtgaccgccctggagcaggccagcgagccccccagacccgccgagcacctggagcccagccacgacgccggcagagaggaggccgccaccaccgccctggccggcctggccagagagctgcagagcctgagcaacgacgtgaagaacgtgggcagatgctgcgaggccgaggccggcgccggcgccgccagcctgaacgccagcctgcacggcctgcacaacgccctgttcgccacccagagaagcctggagcagcaccagagactgttccacagcctgttcggcaacttccagggcctgatggaggccaacgtgagcctggacctgggcaagctgcagaccatgctgagcagaaagggcaagaagcagcagaaggacctggaggcccccagaaagagagacaagaaggaggccgagcccctggtggacatcagagtgaccggccccgtgcccggcgccctgggcgccgccctgtgggaggccggcagccccgtggccttctacgccagcttcagcgagggcaccgccgccctgcagaccgtgaagttcaacaccacctacatcaacatcggcagcagctacttccccgagcacggctacttcagagcccccgagagaggcgtgtacctgttcgccgtgagcgtggagttcggccccggccccggcaccggccagctggtgttcggcggccaccacagaacccccgtgtgcaccaccggccagggcagcggcagcaccgccaccgtgttcgccatggccgagctgcagaagggcgagagagtgtggttcgagctgacccagggcagcatcaccaagagaagcctgagcggcaccgccttcggcggcttcctgatgttcaagacctag

SEQ ID NO: 4693 - DNA, 828 bp, Artificial Sequence
  Description of Artificial Sequence: Synthetic coding sequence
atgggcagcgccccctgggcccccgtgctgctgctggccctgggcctgagaggcctgcaggccggcggcgagtggagaagaccccccgcccacagccccgtgcccgccccccccctgagattcgccagcccccacagcccccagggccccggccccagactgcccggcgccctgctgcccgccgccagcggccccctgcagctgagagccctgagacagcaggacctgcccagcgccctgcccggcgtgggccaggtgctgggccccggcagaggcgcccacctgctgctgcactgggagagaggcagaagagtgggcctgagacagcagctgggcctgagaagaggcgccggcggcagagccggcggcagcaccggcctgagaggcgcccccctgctgagagaggtggccgccgtgagatgcgccgtgcacgccgccagagcccacggcgccgccgacggcggcgccggccccggcagactgagaagagccgcccccagagccaccaccagacccagaggccccggctgccccagacacagactgagatggaagctgtggggcgacgcccagtgcctgcccgaggacgaggtgagcccccccggcggcggcggcgccggcggccagagagccagaagcagctgcggcagacccagaagactgcagcccgtgctgcccggcagacacggcggcagcctgagacacggccccctgggcgtgagacacctgcccgccgccgtgagaagagagggccccgaccccgccctgcacgtgagacccgagtgcctgcacagagccggccacgacggcctgcccctgccccactag

SEQ ID NO: 4694 - DNA, 351 bp, Artificial Sequence; identical to SEQ ID NO: 4162
  Description of Artificial Sequence: Synthetic coding sequence

SEQ ID NO: 4695 - DNA, 522 bp, Artificial Sequence; identical to SEQ ID NO: 3879
  Description of Artificial Sequence: Synthetic coding sequence

SEQ ID NO: 4696 - DNA, 1482 bp, Artificial Sequence
  Description of Artificial Sequence: Synthetic coding sequence
agcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctacgtggagatggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggtgctggagagccaccccagaaccagaagccccggcctggtgggcatcagacccaccctgctgcccgtgagccccatggccctgagatgctgcagccccatccagcccaccgccagcttctggcccctgacccccgtgcccctggaggccagagcccccccccacccccccggccccaacccccccacccccagaggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaactag

SEQ ID NO: 4697 - DNA, 639 bp, Artificial Sequence
  Description of Artificial Sequence: Synthetic coding sequence
atgggcctgcacctgagaccctacagagtgggcctgctgcccgacggcctgctgttcctgctgctgctgctgatgctgctggccgaccccgccctgcccgccggcagacacccccccgtggtgctgggcgacaacaacagaatccccgtgatcggccccctgaagatcagagagcagcagagaagcgccgtgagcaccagctggctgctgccctacaactacacctggagccccgagaaggtgttcgtgcagacccccaccatcaactacaccctgagagactacagaaagttcttccaggacatcggcttcgaggacggctggctgatgagacaggacaccgagggcctggtggaggccaccatgccccccggcgtgcagctgcactgcctgtacggcaccggcgtgcccacccccgacagcttctactacgagagcttccccgacagagaccccaagatctgcttcggcgacggcgacggcaccgtgaacctgaagagcgccctgcagtgccaggcctggcagagcagacaggagcaccaggtgctgctgcaggagctgcccggcagcgagcacatcgagatgctggccaacgccaccaccctggcctacctgaagagagtgctgctgggcccctag

SEQ ID NO: 4698 - DNA, 654 bp, Artificial Sequence
  Description of Artificial Sequence: Synthetic coding sequence
atgagcgacctgctgctgctgggcctgatcggcggcctgaccctgctgctgctgctgaccctgctggccttcgccggctacagcggcctgctggccggcgtggaggtgagcgccggcagcccccccatcagaaacgtgaccgtggcctacaagttccacatgggcctgtacggcgagaccggcagactgttcaccgagagctgcagcatcagccccaagctgagaagcatcgccgtgtactacgacaacccccacatggtgccccccgacaagtgcagatgcgccgtgggcagcatcctgagcgagggcgaggagagccccagccccgagctgatcgacctgtaccagaagttcggcttcaaggtgttcagcttccccgcccccagccacgtggtgaccgccaccttcccctacaccaccatcctgagcatctggctggccaccagaagagtgcaccccgccctggacacctacatcaaggagagaaagctgtgcgcctaccccagactggagatctaccaggaggaccagatccacttcatgtgccccctggccagacagggcgacttctacgtgcccgagatgaaggagaccgagtggaagtggagaggcctggtggaggccatcgacacccaggtggacggcaccggctag

SEQ ID NO: 4699 - DNA, 345 bp, Artificial Sequence
  Description of Artificial Sequence: Synthetic coding sequence
atgaagaccttcacctggaccctgggcgtgctgttcttcctgctggtggacaccggccactgcagaggcggccagttcaagatcaagaagatcaaccagagaagataccccagagccaccgacggcaaggaggaggccaagaagtgcgcctacaccttcctggtgcccgagcagagaatcaccggccccatctgcgtgaacaccaagggccaggacgccagcaccatcaaggacatgatcaccagaatggacctggagaacctgaaggacgtgctgagcagacagaagagagagatcgacgtgctgcagctggtggtggacgtggacggcaacatcgtgaactag

SEQ ID NO: 4700 - DNA, 870 bp, Artificial Sequence; identical to SEQ ID NO: 4594
  Description of Artificial Sequence: Synthetic coding sequence

SEQ ID NO: 4701 - DNA, 1002 bp, Artificial Sequence; identical to SEQ ID NO: 4312
  Description of Artificial Sequence: Synthetic coding sequence

SEQ ID NO: 4702 - DNA, 531 bp, Artificial Sequence
  Description of Artificial Sequence: Synthetic coding sequence
atgagactgctgatcctgacctgcctggtggccgtggccctggccagacccaagctgcccctgagataccccgagagactgcagaaccccagcgagagcagcgagcccatccccctggagagcagagaggagtacatgaacggcatgaacagaagaaacatcctgagagagaagcagaccgacgagatcaaggacaccagaaacgagagcacccagaactgcgtggtggccgagcccgagaagatggagagcagcatcagcagcagcagcgaggagcagttctgcagactgaacgagtacaaccagctgcagctgcaggccgcccacgcccaggagcagatcagaagaatgaacgagaacagccacgtgcaggtgcccttccagcagctgaaccagctggccgcctacccctacgccgtgtggtactacccccagatcatgcagtacgtgcccttcccccccttcagcgacatcagcaaccccaccgcccacgagaactacgagaagaacaacgtgatgctgcagtggtag

SEQ ID NO: 4703 - DNA, 279 bp, Artificial Sequence
  Description of Artificial Sequence: Synthetic coding sequence
atgaagctgtgcgtgaccgtgctgagcctgctggtgctggtggccgccttctgcagcctggccctgagcgcccccatgggcagcgacccccccaccgcctgctgcttcagctacaccgccagaaagctgcccagaaacttcgtggtggactactacgagaccagcagcctgtgcagccagcccgccgtggtgttccagaccaagagaggcaagcaggtgtgcgccgaccccagcgagagctgggtgcaggagtacgtgtacgacctggagctgaactag

SEQ ID NO: 4704 - DNA, 1656 bp, Artificial Sequence
  Description of Artificial Sequence: Synthetic coding sequence
atgacctggagaatgggccccagattcaccatgctgctggccatgtggctggtgtgcggcagcgagccccacccccacgccaccatcagaggcagccacggcggcagaaaggtgcccctggtgagccccgacagcagcagacccgccagattcctgagacacaccggcagaagcagaggcatcgagagaagcaccctggaggagcccaacctgcagcccctgcagagaagaagaagcgtgcccgtgctgagactggccagacccagcagattcagagacaacagaatggacagaagagagcacggccacagagaccccaacgtggtgcccggcccccccaagcccgccaaggagaagccccccaagaagaaggcccaggacaagatcctgagcaacgagtacgaggagaagtacgacctgagcagacccaccgccagccagctggaggacgagctgcaggtgggcaacgtgcccctgaagaaggccaaggagagcaagaagcacgagaagctggagaagcccgagaaggagaagaagaagaagatgaagaacgagaacgccgacaagctgctgaagagcgagaagcagatgaagaagagcgagaagaagagcaagcaggagaaggagaagagcaagaagaagaagggcggcaagaccgagcaggacggctaccagaagcccaccaacaagcacttcacccagagccccaagaagagcgtggccgacctgctgggcagcttcgagggcaagagaagactgctgctgatcaccgcccccaaggccgagaacaacatgtacgtgcagcagagagacgagtacctggagagcttctgcaagatggccaccagaaagatcagcgtgatcaccatcttcggccccgtgaacaacagcaccatgaagatcgaccacttccagctggacaacgagaagcccatgagagtggtggacgacgaggacctggtggaccagagactgatcagcgagctgagaaaggagtacggcatgacctacaacgacttcttcatggtgctgaccgacgtggacctgagagtgaagcagtactacgaggtgcccatcaccatgaagagcgtgttcgacctgatcgacaccttccagagcagaatcaaggacatggagaagcagaagaaggagggcatcgtgtgcaaggaggacaagaagcagagcctggagaacttcctgagcagattcagatggagaagaagactgctggtgatcagcgcccccaacgacgaggactgggcctacagccagcagctgagcgccctgagcggccaggcctgcaacttcggcagcagcgtggtggagagagaggacgtgcccgcccacctggtgaaggacatcagaaactacttccaggtgagccccgagtacttcagcatgctgctggtgggcaaggacggcaacgtgaagagctggtaccccagccccatgtggagcatggtgatcgtgtacgacctgatcgacagcatgcagctgagaagacaggagatggccatccagcagagcctgggcatgagatgccccgaggacgagtacgccggctacggctaccacagctaccaccagggctaccaggacggctaccaggacgactacagacaccacgagagctaccaccacggctacccctactag

SEQ ID NO: 4705 - DNA, 1245 bp, Artificial Sequence; identical to SEQ ID NO: 4403
  Description of Artificial Sequence: Synthetic coding sequence

SEQ ID NO: 4706 - DNA, 300 bp, Artificial Sequence; identical to SEQ ID NO: 4544
  Description of Artificial Sequence: Synthetic coding sequence

SEQ ID NO: 4707 - DNA, 912 bp, Artificial Sequence; identical to SEQ ID NO: 3693
  Description of Artificial Sequence: Synthetic coding sequence

SEQ ID NO: 4708 - DNA, 444 bp, Artificial Sequence; identical to SEQ ID NO: 4359
  Description of Artificial Sequence: Synthetic coding sequence

SEQ ID NO: 4709 - DNA, 1173 bp, Artificial Sequence; identical to SEQ ID NO: 4072
  Description of Artificial Sequence: Synthetic coding sequence

SEQ ID NO: 4710 - DNA, 297 bp, Artificial Sequence
  Description of Artificial Sequence: Synthetic coding sequence
atgaacaagcacttcctgttcctgttcctgctgtactgcctgatcgtggccgtgaccagcctgcagtgcatcacctgccacctgagaaccagaaccgacagatgcagaagaggcttcggcgtgtgcaccgcccagaagggcgaggcctgcatgctgctgagaatctaccagagaaacaccctgcagatcagctacatggtgtgccagaagttctgcagagacatgaccttcgacctgagaaacagaacctacgtgcacacctgctgcaactacaactactgcaacttcaagctgtag

SEQ ID NO: 4711 - DNA, 600 bp, Artificial Sequence
  Description of Artificial Sequence: Synthetic coding sequence
atggcctggggcggcgtgcacacctgctgcttccacctgtgctgctgctgcagctggccccagggcgccgtgcccgaggagctgcacaagcaccccggccagaccctgctgctgcagtgccagtacagccccaagagaggcccctaccagcccaagagctggtgccagcagaccagccccagcagatgcaccctgctggtgaccagcagcaagccctggaccgccgtgcagaagagccactacaccatctgggacaagcccaacgccggcttcttcaacatcaccatgatccagctgacccagaacgacagcggcttctactggtgcggcatctacaacgccagcgagaacatcatcaccgtgctgagaaacatcagcctggtggtgagccccgcccccaccaccagccccatgtggaccctgccctggctgcccaccagcaccgcctgggagccccagatccaggagatcaagttcagagcccccaccgacagcaccctgtggaagagcagagcccccgcctgcctgggcagcggcggccccagattcctggtgctggtgctgtgcggcctgctgctggccaagggcctgatgctgtag

SEQ ID NO: 4712 - DNA, 2025 bp, Artificial Sequence
  Description of Artificial Sequence: Synthetic coding sequence
atgaccaccgacgacaccgaggtgcccgccatgaccctggcccccggccacgccgccctggagacccagaccctgagcgccgagaccagcagcagagccagcacccccgccggccccatccccgaggccgagaccagaggcgccaagagaatcagccccgccagagagaccagaagcttcaccaagaccagccccaacttcatggtgctgatcgccaccagcgtggagaccagcgccgccagcggcagccccgagggcgccggcatgaccaccgtgcagaccatcaccggcagcgaccccagagaggccatcttcgacaccctgtgcaccgacgacagcagcgaggaggccaagaccctgaccatggacatcctgaccctggcccacaccagcaccgaggccaagggcctgagcagcgagagcagcgccagcagcgacagcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcctgcaccccgtgatcacccccagcagagccagcgagagcagcgccagcagcgacggcccccaccccgtgatcacccccagcagagccagcgagagcagcgccagcagcgacggcccccaccccgtgatcacccccagctggagccccggcagcgacgtgaccctgctggccgaggccctggtgaccgtgaccaacatcgaggtgatcaactgcagcatcaccgagatcgagaccaccaccagcagcatccccggcgccagcgacaccgacctgatccccaccgagggcgtgaaggccagcagcaccagcgacccccccgccctgcccgacagcaccgaggccaagccccacatcaccgaggtgaccgccagcgccgagaccctgagcaccgccggcaccaccgagagcgccgcccccgacgccaccgtgggcacccccctgcccaccaacagcgccaccgagagagaggtgaccgcccccggcgccaccaccctgagcggcgccctggtgaccgtgagcagaaaccccctggaggagaccagcgccctgagcgtggagacccccagctacgtgaaggtgagcggcgccgcccccgtgagcatcgaggccggcagcgccgtgggcaagaccaccagcttcgccggcagcagcgccagcagctacagccccagcgaggccgccctgaagaacttcacccccagcgagacccccaccatggacatcgccaccaagggccccttccccaccagcagagaccccctgcccagcgtgccccccaccaccaccaacagcagcagaggcaccaacagcaccctggccaagatcaccaccagcgccaagaccaccatgaagccccccaccgccacccccaccaccgccagaaccagacccaccaccgacgtgagcgccggcgagaacggcggcttcctgctgctgagactgagcgtggccagccccgaggacctgaccgaccccagagtggccgagagactgatgcagcagctgcacagagagctgcacgcccacgccccccacttccaggtgagcctgctgagagtgagaagaggctag

SEQ ID NO: 4713 - DNA, 738 bp, Artificial Sequence
  Description of Artificial Sequence: Synthetic coding sequence
atgcaggccgcctggctgctgggcgccctggtggtgccccagctgctgggcttcggccacggcgccagaggcgccgagagagagtgggagggcggctggggcggcgcccaggaggaggagagagagagagaggccctgatgctgaagcacctgcaggaggccctgggcctgcccgccggcagaggcgacgagaaccccgccggcaccgtggagggcaaggaggactgggagatggaggaggaccagggcgaggaggaggaggaggaggccacccccacccccagcagcggccccagccccagccccacccccgaggacatcgtgacctacatcctgggcagactggccggcctggacgccggcctgcaccagctgcacgtgagactgcacgccctggacaccagagtggtggagctgacccagggcctgagacagctgagaaacgccgccggcgacaccagagacgccgtgcaggccctgcaggaggcccagggcagagccgagagagagcacggcagactggagggctgcctgaagggcctgagactgggccacaagtgcttcctgctgagcagagacttcgaggcccagcccagcgccagcccccaccccctgagccccgaccagcccaacggcggcaccctggagaactgcgtggcccaggccagcgacgacggcagctggtgggaccacgactgccagagaagactgtactacgtgtgcgagttccccttctag

SEQ ID NO: 4714 - DNA, 279 bp, Artificial Sequence
  Description of Artificial Sequence: Synthetic coding sequence
atgatctggagaagcagagccggcgccgagctgttcagcctgatggccctgtgggagtggatcgccctgagcctgcactgctgggtgctggccgtggccgccgtgagcgaccagcacgccaccagccccttcgactggctgctgagcgacaagggccccttccacagaagccaggagtacaccgacttcgtggacagaagcagacagggcttcagcaccagatacaagatctacagaaacatgggccacatcagctgctacctgctgctgtgggagtag

SEQ ID NO: 4715 - DNA, 177 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtactag

SEQ ID NO: 4716 - DNA, 732 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagactgcagcatgggcgtgtgggccagctggcagatggtgtggtggggctggatgaccctgggcagagtgagaagctgcggcagcggccaggccatgaccatgtgggacggcgccaccaccgccagccccgtggccatgtggagatggagcctgagcctgaccggctag

SEQ ID NO: 4717 - DNA, 2535 bp, Artificial Sequence; identical to SEQ ID NO: 3960
  Description of Artificial Sequence: Synthetic coding sequence

SEQ ID NO: 4718 - DNA, 921 bp, Artificial Sequence
  Description of Artificial Sequence: Synthetic coding sequence
agaagaacctgcgccggccccggcagagccggcggcgccagaagcgccagctggatgagcagactgagagccctgctgggcctgggcctgctggtggccggcagcagagtgcccagaatcaagagccagaccatcgcctgcagaagcggccccacctggtggggcccccagagactgaacagcggcggcagatgggacagcgaggtgatggccagcaccgtggtgaagtacctgagccaggaggaggcccaggccgtggaccaggagctgttcaacgagtaccagttcagcgtggaccagctgatggagctggccggcctgagctgcgccaccgccatcgccaaggcctacccccccaccagcatgagcagaagcccccccaccgtgctggtgatctgcggccccggcaacaacggcggcgacggcctggtgtgcgccagacacctgaagctgttcggctacgagcccaccatctactaccccaagagacccaacaagcccctgttcaccgccctggtgacccagtgccagaagatggacatccccttcctgggcgagatgcccgccgagcccatgaccatcgacgagctgtacgagctggtggtggacgccatcttcggcttcagcttcaagggcgacgtgagagagcccttccacagcatcctgagcgtgctgaagggcctgaccgtgcccatcgccagcatcgacatccccagcggctgggacgtggagaagggcaacgccggcggcatccagcccgacctgctgatcagcctgaccgcccccaagaagagcgccacccagttcaccggcagataccactacctgggcggcagattcgtgccccccgccctggagaagaagtaccagctgaacctgcccccctaccccgacaccgagtgcgtgtacagactgcagtag

SEQ ID NO: 4719 - DNA, 1137 bp, Artificial Sequence; identical to SEQ ID NO: 4499
  Description of Artificial Sequence: Synthetic coding sequence

SEQ ID NO: 4720 - DNA, 762 bp, Artificial Sequence
  Description of Artificial Sequence: Synthetic coding sequence
atggccccctggagccaccccagcgcccagctgcagcccgtgggcggcgacgccgtgagccccgccctgatggtgctgctgtgcctgggcaacctgagcaaggccaccctgtgggccgagcccggcagcgtgatcagcagaggcaacagcgtgaccatcagatgccagggcaccctggaggcccaggagtacagactggtgaaggagggcagccccgagccctgggacacccagaaccccctggagcccaagaacaaggccagattcagcatccccagcatgaccgagcaccacgccggcagatacagatgctactactacagccccgccggctggagcgagcccagcgaccccctggagctggtggtgaccggcttctacaacaagcccaccctgagcgccctgcccagccccgtggtgaccagcggcgagaacgtgaccctgcagtgcggcagcagactgagattcgacagattcatcctgaccgaggagggcgaccacaagctgagctggaccctggacagccagctgacccccagcggccagttccaggccctgttccccgtgggccccgtgacccccagccacagatggatgctgagatgctacggcagcagaagacacatcctgcaggtgtggagcgagcccagcgacctgctggagatccccgtgagcggcgaggaggccaccgtgttcagcagcaccatccagggcagccagaccggctgcggcgagctgtacagacagggcagcccctgctag

SEQ ID NO: 4721 - DNA, 288 bp, Artificial Sequence
  Description of Artificial Sequence: Synthetic coding sequence
atgagaaagcccagaagaaagagcagacagaacgccgagggcagaagaagccccagcccctacagcctgaagtgcagccccaccagagagaccctgacctacgcccaggcccagagaatcgtggaggtggacatcgacggcagactgcacagaatcagcatctacgaccccctgaagatcatcaccgaggacgagctgaccgcccaggacatcaccgagtgcaacagcaacaaggagaacagcgagcagccccagttccccggcaagagcaagaagcccagcagctag

SEQ ID NO: 4722 - DNA, 1311 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcggcagcggcagccagagcggcagcagcggcagcggcagcaacggcgacaacaacaacggcagcagcagcggcggcagcagcagcggcagcagcagcggcggcagcagcggcggcagcagcggcggcagcagcggcaacagcggcggcagcagaggcgacagcggcagcgagagcagctggggcagcagcaccggcagcagcagcggcaaccacggcggcagcggcggcggcaacggccacaagcccggctgcgagaagcccggcaacgaggccagaggcagcggcgagagcggcatccagggcttcagaggccagggcgtgagcagcaacatgagagagatcagcaaggagggcaacagactgctgggcggcagcggcgacaactacagaggccagggcagcagctggggcagcggcggcggcgacgccgtgggcggcgtgaacaccgtgaacagcgagaccagccccggcatgttcaacttcgacaccttctggaagaacttcaagagcaagctgggcttcatcaactgggacgccatcaacaaggaccagagaagcagcagaatcccctag

SEQ ID NO: 4723 - DNA, 240 bp, Artificial Sequence
  Description of Artificial Sequence: Synthetic coding sequence
atgcccgcctgcagactgggccccctggccgccgccctgctgctgagcctgctgctgttcggcttcaccctggtgagcggcaccggcgccgagaagaccggcgtgtgccccgagctgcaggccgaccagaactgcacccaggagtgcgtgagcgacagcgagtgcgccgacaacctgaagtgctgcagcgccggctgcgccaccttctgcagcctgcccaacggccagctggccgagtag

SEQ ID NO: 4724 - DNA, 2130 bp, Artificial Sequence
  Description of Artificial Sequence: Synthetic coding sequence
atgggctgcctgtggggcctggccctgcccctgttcttcttctgctgggaggtgggcgtgagcggcagcagcgccggccccagcaccagaagagccgacaccgccatgaccaccgacgacaccgaggtgcccgccatgaccctggcccccggccacgccgccctggagacccagaccctgagcgccgagaccagcagcagagccagcacccccgccggccccatccccgaggccgagaccagaggcgccaagagaatcagccccgccagagagaccagaagcttcaccaagaccagccccaacttcatggtgctgatcgccaccagcgtggagaccagcgccgccagcggcagccccgagggcgccggcatgaccaccgtgcagaccatcaccggcagcgaccccagagaggccatcttcgacaccctgtgcaccgacgacagcagcgaggaggccaagaccctgaccatggacatcctgaccctggcccacaccagcaccgaggccaagggcctgagcagcgagagcagcgccagcagcgacagcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcccccaccccgtgatcacccccagcagagccagcgagagcagcgccagcagcgacggcctgcaccccgtgatcacccccagcagagccagcgagagcagcgccagcagcgacggcccccaccccgtgatcacccccagcagagccagcgagagcagcgccagcagcgacggcccccaccccgtgatcacccccagctggagccccggcagcgacgtgaccctgctggccgaggccctggtgaccgtgaccaacatcgaggtgatcaactgcagcatcaccgagatcgagaccaccaccagcagcatccccggcgccagcgacaccgacctgatccccaccgagggcgtgaaggccagcagcaccagcgacccccccgccctgcccgacagcaccgaggccaagccccacatcaccgaggtgaccgccagcgccgagaccctgagcaccgccggcaccaccgagagcgccgcccccgacgccaccgtgggcacccccctgcccaccaacagcgccaccgagagagaggtgaccgcccccggcgccaccaccctgagcggcgccctggtgaccgtgagcagaaaccccctggaggagaccagcgccctgagcgtggagacccccagctacgtgaaggtgagcggcgccgcccccgtgagcatcgaggccggcagcgccgtgggcaagaccaccagcttcgccggcagcagcgccagcagctacagccccagcgaggccgccctgaagaacttcacccccagcgagacccccaccatggacatcgccaccaagggccccttccccaccagcagagaccccctgcccagcgtgccccccaccaccaccaacagcagcagaggcaccaacagcaccctggccaagatcaccaccagcgccaagaccaccatgaagccccccaccgccacccccaccaccgccagaaccagacccaccaccgacgtgagcgccggcgagaacggcggcttcctgctgctgagactgagcgtggccagccccgaggacctgaccgaccccagagtggccgagagactgatgcagcagctgcacagagagctgcacgcccacgccccccacttccaggtgagcctgctgagagtgagaagaggctag

SEQ ID NO: 4725 - DNA, 2067 bp, Artificial Sequence
  Description of Artificial Sequence: Synthetic coding sequence
atgctgcccaccgaggtgccccagagccaccccggccccagcgccctgctgctgctgcagctgctgctgccccccaccagcgccttcttccccaacatctggagcctgctggccgcccccggcagcatcacccaccaggacctgaccgaggaggccgccctgaacgtgaccctgcagctgttcctggagcagcccccccccggcagaccccccctgagactggaggacttcctgggcagaaccctgctggccgacgacctgttcgccgcctacttcggccccggcagcagcagaagattcagagccgccctgggcgaggtgagcagagccaacgccgcccaggacttcctgcccaccagcagaaacgaccccgacctgcacttcgacgccgagagactgggccagggcagagccagactggtgggcgccctgagagagaccgtggtggccgccagagccctggaccacaccctggccagacagagactgggcgccgccctgcacgccctgcaggacttctacagccacagcaactgggtggagctgggcgagcagcagccccacccccacctgctgtggcccagacaggagctgcagaacctggcccaggtggccgaccccacctgcagcgactgcgaggagctgagctgccccagaaactggctgggcttcaccctgctgaccagcggctacttcggcacccacccccccaagccccccggcaagtgcagccacggcggccacttcgacagaagcagcagccagccccccagaggcggcatcaacaaggacagcaccagccccggcttcagcccccaccacatgctgcacctgcaggccgccaagctggccctgctggccagcatccaggccttcagcctgctgagaagcagactgggcgacagagacttcagcagactgctggacatcacccccgccagcagcctgagcttcgtgctggacaccaccggcagcatgggcgaggagatcaacgccgccaagatccaggccagacacctggtggagcagagaagaggcagccccatggagcccgtgcactacgtgctggtgcccttccacgaccccggcttcggccccgtgttcaccaccagcgaccccgacagcttctggcagcagctgaacgagatccacgccctgggcggcggcgacgagcccgagatgtgcctgagcgccctgcagctggccctgctgcacaccccccccctgagcgacatcttcgtgttcaccgacgccagccccaaggacgccttcctgaccaaccaggtggagagcctgacccaggagagaagatgcagagtgaccttcctggtgaccgaggacaccagcagagtgcagggcagagccagaagagagatcctgagccccctgagattcgagccctacaaggccgtggccctggccagcggcggcgaggtgatcttcaccaaggaccagcacatcagagacgtggccgccatcgtgggcgagagcatggccgccctggtgaccctgcccctggacccccccgtggtggtgcccggccagcccctggtgttcagcgtggacggcctgctgcagaagatcaccgtgagaatccacggcgacatcagcagcttctggatcaagaaccccgccggcgtgagccagggccaggaggagggcggcggccccctgggccacaccagaagattcggccagttctggatggtgaccatggacgaccccccccagaccggcacctgggagatccaggtgaccgccgaggacacccccggcgtgagagtgcaggcccagaccagcctggacttcctgttccacttcggcatccccatggaggacggcccccaccccggcctgtaccccctgacccagcccgtggccggcctgcagacccagctgctggtggagagccagagctggggcagcagcgccgccttcctgcccagacaccccagcagaggccccagaggctgcagaaccagacccggcgccctgggcgccagaggcaccagcggcgccagaagccccagaagcctggccgtggcccacgccgccgtgcacccctag

SEQ ID NO: 4726 - DNA, 1257 bp, Artificial Sequence
  Description of Artificial Sequence: Synthetic coding sequence
aacaacctgaacgtgggcagcgacaccaccagcgagaccagcttcagcctgagcaaggaggcccccagagagcacctggaccaccaggccgcccaccagcccttccccagacccagattcagacaggagaccggccaccccagcctgcagagagacttccccagaagcttcctgctggacctgcccaacttccccgacctgagcaaggccgacatcaacggccagaaccccaacatccaggtgaccatcgaggtggtggacggccccgacagcgaggccgacaaggaccagcaccccgagaacaagcccagctggagcgtgcccagccccgactggagagcctggtggcagagaagcctgagcctggccagagccaacagcggcgaccaggactacaagtacgacagcaccagcgacgacagcaacttcctgaacccccccagaggctgggaccacaccgcccccggccacagaaccttcgagaccaaggaccagcccgagtacgacagcaccgacggcgagggcgactggagcctgtggagcgtgtgcagcgtgacctgcggcaacggcaaccagaagagaaccagaagctgcggctacgcctgcaccgccaccgagagcagaacctgcgacagacccaactgccccggcatcgaggacaccttcagaaccgccgccaccgaggtgagcctgctggccggcagcgaggagttcaacgccaccaagctgttcgaggtggacaccgacagctgcgagagatggatgagctgcaagagcgagttcctgaagaagtacatgcacaaggtgatgaacgacctgcccagctgcccctgcagctaccccaccgaggtggcctacagcaccgccgacatcttcgacagaatcaagagaaaggacttcagatggaaggacgccagcggccccaaggagaagctggagatctacaagcccaccgccagatactgcatcagaagcatgctgagcctggagagcaccaccctggccgcccagcactgctgctacggcgacaacatgcagctgatcaccagaggcaagggcgccggcacccccaacctgatcagcaccgagttcagcgccgagctgcactacaaggtggacgtgctgccctggatcatctgcaagggcgactggagcagatacaacgaggccagaccccccaacaacggccagaagtgcaccgagagccccagcgacgaggactacatcaagcagttccaggaggccagagagtactag

SEQ ID NO: 4727 - DNA, 693 bp, Artificial Sequence; identical to SEQ ID NO: 3999
  Description of Artificial Sequence: Synthetic coding sequence

SEQ ID NO: 4728 - DNA, 192 bp, Artificial Sequence; identical to SEQ ID NO: 4605
  Description of Artificial Sequence: Synthetic coding sequence

SEQ ID NO: 4729 - DNA, 1014 bp, Artificial Sequence
  Description of Artificial Sequence: Synthetic coding sequence
atgctgagcctgggcgcccacagcgtgaccaagacccagatcctgcagggcctgggcttcaacctgacccacacccccgagagcgccatccaccagggcttccagcacctggtgcacagcctgaccgtgcccagcaaggacctgaccctgaagatgggcagcgccctgttcgtgaagaaggagctgcagctgcaggccaacttcctgggcaacgtgaagagactgtacgaggccgaggtgttcagcaccgacttcagcaaccccagcatcgcccaggccagaatcaacagccacgtgaagaagaagacccagggcaaggtggtggacatcatccagggcctggacctgctgaccgccatggtgctggtgaaccacatcttcttcaaggccaagtgggagaagcccttccaccccgagtacaccagaaagaacttccccttcctggtgggcgagcaggtgaccgtgcacgtgcccatgatgcaccagaaggagcagttcgccttcggcgtggacaccgagctgaactgcttcgtgctgcagatggactacaagggcgacgccgtggccttcttcgtgctgcccagcaagggcaagatgagacagctggagcaggccctgagcgccagaaccctgagaaagtggagccacagcctgcagaagagatggatcgaggtgttcatccccagattcagcatcagcgccagctacaacctggagaccatcctgcccaagatgggcatccagaacgtgttcgacaagaacgccgacttcagcggcatcgccaagagagacagcctgcaggtgagcaaggccacccacaaggccgtgctggacgtgagcgaggagggcaccgaggccaccgccgccaccaccaccaagttcatcgtgagaagcaaggacggccccagctacttcaccgtgagcttcaacagaaccttcctgatgatgatcaccaacaaggccaccgacggcatcctgttcctgggcaaggtggagaaccccaccaagagctag

SEQ ID NO: 4730 - DNA, 336 bp, Artificial Sequence
  Description of Artificial Sequence: Synthetic coding sequence
atgttcttcaccatcagcagaaagaacatgagccagaagctgagcctgctgctgctggtgttcggcctgatctggggcctgatgctgctgcactacaccttccagcagcccagacaccagagcagcgtgaagctgagagagcagatcctggacctgagcaagagatacgtgaaggccctggccgaggagaacaagaacaccgtggacgtggagaacggcgccagcatggccggctacgccgacctgaagagaaccatcgccgtgctgctggacgacatcctgcagagactggtgaagctggagaacaaggtggactacatcgtggtgaacggctag

SEQ ID NO: 4731 - DNA, 498 bp, Artificial Sequence; identical to SEQ ID NO: 3716
  Description of Artificial Sequence: Synthetic coding sequence

SEQ ID NO: 4732 - DNA, 699 bp, Artificial Sequence
  Description of Artificial Sequence: Synthetic coding sequence
atggtgctgctgctggtgatcctgatccccgtgctggtgagcagcgccggcaccagcgcccactacgagatgctgggcacctgcagaatggtgtgcgacccctacggcggcaccaaggcccccagcaccgccgccacccccgacagaggcctgatgcagagcctgcccaccttcatccagggcccccccatgggcccccccggcgagaagggcgagcccggcagacagggcctgcccggcccccccggcgcccccggcctgaacgccgccggcgccatcagcgccgccacctacagcaccgtgcccaagatcgccttctacgccggcctgaagagacagcacgagggctacgaggtgctgaagttcgacgacgtggtgaccaacctgggcaaccactacgaccccaccaccggcaagttcacctgcagcatccccggcatctacttcttcacctaccacgtgctgatgagaggcggcgacggcaccagcatgtgggccgacctgtgcaagaacaaccaggtgagagccagcgccatcgcccaggacgccgaccagaactacgactacgccagcaacagcgtggtgctgcacctggagcccggcgacgaggtgtacatcaagctggacggcggcaaggcccacggcggcaacaacaacaagtacagcaccttcagcggcttcatcatctacgccgactag

SEQ ID NO: 4733 - DNA, 501 bp, Artificial Sequence; identical to SEQ ID NO: 4634
  Description of Artificial Sequence: Synthetic coding sequence

SEQ ID NO: 4734 - DNA, 627 bp, Artificial Sequence
  Description of Artificial Sequence: Synthetic coding sequence
atgatcatcaagcacttcttcggcaccgtgctggtgctgctggccagcaccaccatcttcagcctggacctgaagctgatcatcttccagcagagacaggtgaaccaggagagcctgaagctgctgaacaagctgcagaccctgagcatccagcagtgcctgccccacagaaagaacttcctgctgccccagaagagcctgagcccccagcagtaccagaagggccacaccctggccatcctgcacgagatgctgcagcagatcttcagcctgttcagagccaacatcagcctggacggctgggaggagaaccacaccgagaagttcctgatccagctgcaccagcagctggagtacctggaggccctgatgggcctggaggccgagaagctgagcggcaccctgggcagcgacaacctgagactgcaggtgaagatgtacttcagaagaatccacgactacctggagaaccaggactacagcacctgcgcctgggccatcgtgcaggtggagatcagcagatgcctgttcttcgtgttcagcctgaccgagaagctgagcaagcagggcagacccctgaacgacatgaagcaggagctgaccaccgagttcagaagccccagatag

SEQ ID NO: 4735 - DNA, 2241 bp, Artificial Sequence
  Description of Artificial Sequence: Synthetic coding sequence
atgcccttcagacacaagcccggcagcgtgttcagcgtggagggcgagaacctggacctggccatgagcaaggaggaggtggtggccatgatcggcgacggcccctgcgtggtgaagaccctgaccagacaccacctgtactgcgagccccccgtggagcagcccctgcccagacaccacgccctgagagaggcccccgacagcctgcccgagttcaccgtgcagatgggcaacctgagattcagcctgggccacgtgcagtacgacggcgagagccccggcgccttccccgtggccgcccaggtgggcctgggcgtgggcaccagcctgctggccctgggcgtgatcatcatcgtgctgatgtacagaagaaagagcaagcaggccctgagagactacaagaaggtgcagatccagctggagaacctggagagcagcgtgagagacagatgcaagaaggagttcaccgacctgatgaccgagatgaccgacctgaccagcgacctgctgggcagcggcatccccttcctggactacaaggtgtacgccgagagaatcttcttccccggccacagagagagccccctgcacagagacctgggcgtgcccgagagcagaagacccaccgtggagcagggcctgggccagctgagcaacctgctgaacagcaagctgttcctgaccaagttcatccacaccctggagagccagagaaccttcagcgccagagacagagcctacgtggccagcctgctgaccgtggccctgcacggcaagctggagtacttcaccgacatcctgagaaccctgctgagcgacctggtggcccagtacgtggccaagaaccccaagctgatgctgagaagaaccgagaccgtggtggagaagctgctgaccaactggatgagcatctgcctgtacaccttcgtgagagacagcgtgggcgagcccctgtacatgctgttcagaggcatcaagcaccaggtggacaagggccccgtggacagcgtgaccggcaaggccaagtacaccctgaacgacaacagactgctgagagaggacgtggagtacagacccctgaccctgaacgccctgctggccgtgggccccggcgccggcgaggcccagggcgtgcccgtgaaggtgctggactgcgacaccatcagccaggccaaggagaagatgctggaccagctgtacaagggcgtgcccctgacccagagacccgaccccagaaccctggacgtggagtggagaagcggcgtggccggccacctgatcctgagcgacgaggacgtgaccagcgaggtgcagggcctgtggagaagactgaacaccctgcagcactacaaggtgcccgacggcgccaccgtggccctggtgccctgcctgaccaagcacgtgctgagagagaaccaggactacgtgcccggcgagagaacccccatgctggaggacgtggacgagggcggcatcagaccctggcacctggtgaagcccagcgacgagcccgagccccccagacccagaagaggcagcctgagaggcggcgagagagagagagccaaggccatccccgagatctacctgaccagactgctgagcatgaagggcaccctgcagaagttcgtggacgacctgttccaggtgatcctgagcaccagcagacccgtgcccctggccgtgaagtacttcttcgacctgctggacgagcaggcccagcagcacggcatcagcgaccaggacaccatccacatctggaagaccaacagcctgcccctgagattctggatcaacatcatcaagaacccccagttcgtgttcgacgtgcagaccagcgacaacatggacgccgtgctgctggtgatcgcccagaccttcatggacgcctgcaccctggccgaccacaagctgggcagagacagccccatcaacaagctgctgtacgccagagacatccccagatacaagagaatggtggagagatactacgccgacatcagacagaccgtgcccgccagcgaccaggagatgaacagcgtgctggccgagctgagctggaactacagcggcgacctgggcgccagagtggccctgcacgagctgtacaagtacatcaacaagtactacgaccagatcatcaccgccctggaggaggacggcaccgcccagaagatgcagctgggctacagactgcagcagatcgccgccgccgtggagaacaaggtgaccgacctgtag

SEQ ID NO: 4736 - DNA, 603 bp, Artificial Sequence; identical to SEQ ID NO: 3907
  Description of Artificial Sequence: Synthetic coding sequence

SEQ ID NO: 4737 - DNA, 114 bp, Artificial Sequence
  Description of Artificial Sequence: Synthetic coding sequence
atgggctggctgaccagaatcgtgtgcctgttctggggcgtgctgctgaccgccagagccaactaccagaacggcaagaacaacgtgcccagactgaagctgagctacaagtag

SEQ ID NO: 4738 - DNA, 525 bp, Artificial Sequence
  Description of Artificial Sequence: Synthetic coding sequence
atgagactgctggccttcctgagcctgctggccctggtgctgcaggagaccggcaccgccagcctgcccagaaaggagagaaagagaagagaggagcagatgcccagagagggcgacagcttcgaggtgctgcccctgagaaacgacgtgctgaaccccgacaactacggcgaggtgatcgacctgagcaactacgaggagctgaccgactacggcgaccagctgcccgaggtgaaggtgaccagcctggcccccgccaccagcatcagccccgccaagagcaccaccgcccccggcacccccagcagcaaccccaccatgaccagacccaccaccgccggcctgctgctgagcagccagcccaaccacgaggacatcccccccctgcccagaagaaccgcctacctgtacgccagattcaacagaatcagcagaatcagagccgaggacttcaagggcctgaccaagctgaagagaatcgacctgagcaacaacctgatcagcagcatcgacaacgacgcctag

SEQ ID NO: 4739 - DNA, 657 bp, Artificial Sequence; identical to SEQ ID NO: 4208
  Description of Artificial Sequence: Synthetic coding sequence

SEQ ID NO: 4740 - DNA, 2535 bp, Artificial Sequence; identical to SEQ ID NO: 3960
  Description of Artificial Sequence: Synthetic coding sequence

SEQ ID NO: 4741 - DNA, 2007 bp, Artificial Sequence
  Description of Artificial Sequence: Synthetic coding sequence
atggacctggtgctgaagagatgcctgctgcacctggccgtgatcggcgccctgctggccgtgggcgccaccaaggtgcccagaaaccaggactggctgggcgtgagcagacagctgagaaccaaggcctggaacagacagctgtaccccgagtggaccgaggcccagagactggactgctggagaggcggccaggtgagcctgaaggtgagcaacgacggccccaccctgatcggcgccaacgccagcttcagcatcgccctgaacttccccggcagccagaaggtgctgcccgacggccaggtgatctgggtgaacaacaccatcatcaacggcagccaggtgtggggcggccagcccgtgtacccccaggagaccgacgacgcctgcatcttccccgacggcggcccctgccccagcggcagctggagccagaagagaagcttcgtgtacgtgtggaagacctggggccagtactggcaggtgctgggcggccccgtgagcggcctgagcatcggcaccggcagagccatgctgggcacccacaccatggaggtgaccgtgtaccacagaagaggcagcagaagctacgtgcccctggcccacagcagcagcgccttcaccatcaccgaccaggtgcccttcagcgtgagcgtgagccagctgagagccctggacggcggcaacaagcacttcctgagaaaccagcccctgaccttcgccctgcagctgcacgaccccagcggctacctggccgaggccgacctgagctacacctgggacttcggcgacagcagcggcaccctgatcagcagagccctggtggtgacccacacctacctggagcccggccccgtgaccgcccaggtggtgctgcaggccgccatccccctgaccagctgcggcagcagccccgtgcccggcaccaccgacggccacagacccaccgccgaggcccccaacaccaccgccggccaggtgcccaccaccgaggtggtgggcaccacccccggccaggcccccaccgccgagcccagcggcaccaccagcgtgcaggtgcccaccaccgaggtgatcagcaccgcccccgtgcagatgcccaccgccgagagcaccggcatgacccccgagaaggtgcccgtgagcgaggtgatgggcaccaccctggccgagatgagcacccccgaggccaccggcatgacccccgccgaggtgagcatcgtggtgctgagcggcaccaccgccgcccaggtgaccaccaccgagtgggtggagaccaccgccagagagctgcccatccccgagcccgagggccccgacgccagcagcatcatgagcaccgagagcatcaccggcagcctgggccccctgctggacggcaccgccaccctgagactggtgaagagacaggtgcccctggactgcgtgctgtacagatacggcagcttcagcgtgaccctggacatcgtgcagggcatcgagagcgccgagatcctgcaggccgtgcccagcggcgagggcgacgccttcgagctgaccgtgagctgccagggcggcctgcccaaggaggcctgcatggagatcagcagccccggctgccagccccccgcccagagactgtgccagcccgtgctgcccagccccgcctgccagctggtgctgcaccagatcctgaagggcggcagcggcacctactgcctgaacgtgagcctggccgacaccaacagcctggccgtggtgagcacccagctgatcatgcccgtgcccggcatcctgctgaccggccaggaggccggcctgggccaggtgcccctgatcgtgggcatcctgctggtgctgatggccgtggtgctggccagcctgatctacagaagaagactgatgaagcaggacttcagcgtgccccagctgccccacagcagcagccactggctgagactgcccagaatcttctgcagctgccccatcggcgagaacagccccctgctgagcggccagcaggtgtag

SEQ ID NO: 4742 - DNA, 525 bp, Artificial Sequence
  Description of Artificial Sequence: Synthetic coding sequence
atggccgacatgcagaacctggtggagagactggagagagccgtgggcagactggaggccgtgagccacaccagcgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggactag

SEQ ID NO: 4743 - DNA, 1368 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcacccccacccccagcctggccagcggcctgtggagaaccctgcaggtgggctggaacatgcagctgctgcccgccggcctggtgagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcggcgcccagtgcgccaccaaggtgcacttccccttccacacctgcgacctgagaatcgacggcgactgcttcatggtgagcagcgaggccgacacctactacagagccagaatgaagtgccagagaaagggcggcgtgctggcccagatcaagagccagaaggtgcaggacatcctggccttctacctgggcagactggagaccaccaacgaggtgatcgacagcgacttcgagaccagaaacttctggatcggcctgacctacaagaccgccaaggacagcttcagatgggccaccggcgagcaccaggccttcaccagcttcgccttcggccagcccgacaaccacggcctggtgtggctgagcgccgccatgggcttcggcaactgcgtggagctgcaggccagcgccgccttcaactggaacgaccagagatgcaagaccagaaacagatacatctgccagttcgcccaggagcacatcagcagatggggccccggcagctag

SEQ ID NO: 4744 - DNA, 297 bp, Artificial Sequence
  Description of Artificial Sequence: Synthetic coding sequence
atggtgctggccatgctgggcgccctgcaccccagagccggcctgagcctgttcctgcacctgatcctggccgtggccctgctgagaagccagcccctgagaagccagagaagcgtgcccgaggccttcagcgcccccctggagctgagccagcccctgagcggcctggtggacgactacggcatcctgcccaagcaccccagacccagaggccccagacccctgctgagcagagcccagcagagaaagagagacggccccgacctggccgagtactactacgacgcccacctgtag

SEQ ID NO: 4745 - DNA, 2742 bp, Artificial Sequence; identical to SEQ ID NO: 3799
  Description of Artificial Sequence: Synthetic coding sequence

SEQ ID NO: 4746 - DNA, 678 bp, Artificial Sequence; identical to SEQ ID NO: 4468
  Description of Artificial Sequence: Synthetic coding sequence

SEQ ID NO: 4747 - DNA, 405 bp, Artificial Sequence
  Description of Artificial Sequence: Synthetic coding sequence
atgcccagatgcagatggctgagcctgatcctgctgaccatccccctggccctggtggccagaaaggaccccaagaagaacgagaccggcgtgctgagaaagctgaagcccgtgaacgccagcaacgccaacgtgaagcagtgcctgtggttcgccatgcaggagtacaacaaggagagcgaggacaagtacgtgttcctggtggtgaagaccctgcaggcccagctgcaggtgaccaacctgctggagtacctgatcgacgtggagatcgccagaagcgactgcagaaagcccctgagcaccaacgagatctgcgccatccaggagaacagcaagctgaagagaaagctgagctgcagcttcctggtgggcgccctgccctggaacggcgagttcaccgtgtag

SEQ ID NO: 4748 - DNA, 1182 bp, Artificial Sequence; identical to SEQ ID NO: 3793
  Description of Artificial Sequence: Synthetic coding sequence

SEQ ID NO: 4749 - DNA, 678 bp, Artificial Sequence; identical to SEQ ID NO: 4468
  Description of Artificial Sequence: Synthetic coding sequence

SEQ ID NO: 4750 - DNA, 1410 bp, Artificial Sequence
  Description of Artificial Sequence: Synthetic coding sequence
atgatgagactgggcggcagactggtgctgaacaccaaggaggagctggccaacgagagactgatgaccctgaagatcgccgagatgaaggaggccatgagaaccctgatcttcccccccagcatgcacttcttccaggccaagcacctgatcgagagaagccaggtgttcaacatcctgagaatgatgcccaagggcgccgccctgcacctgcacgacatcggcatcgtgaccatggactggctggtgagaaacgtgacctacagaccccactgccacatctgcttcacccccagaggcatcatgcagttcagattcgcccaccccacccccagacccagcgagaagtgcagcaagtggatcctgctggaggactacagaaagagagtgcagaacgtgaccgagttcgacgacagcctgctgagaaacttcaccctggtgacccagcaccccgaggtgatctacaccaaccagaacgtggtgtggagcaagttcgagaccatcttcttcaccatcagcggcctgatccactacgcccccgtgttcagagactacgtgttcagaagcatgcaggagttctacgaggacaacgtgctgtacatggagatcagagccagactgctgcccgtgtacgagctgagcggcgagcaccacgacgaggagtggagcgtgaagacctaccaggaggtggcccagaagttcgtggagacccaccccgagttcatcggcatcaagatcatctacagcgaccacagaagcaaggacgtggccgtgatcgccgagagcatcagaatggccatgggcctgagaatcaagttccccaccgtggtggccggcttcgacctggtgggccacgaggacaccggccacagcctgcacgactacaaggaggccctgatgatccccgccaaggacggcgtgaagctgccctacttcttccacgccggcgagaccgactggcagggcaccagcatcgacagaaacatcctggacgccctgatgctgaacaccaccagaatcggccacggcttcgccctgagcaagcaccccgccgtgagaacctacagctggaagaaggacatccccatcgaggtgtgccccatcagcaaccaggtgctgaagctggtgagcgacctgagaaaccaccccgtggccaccctgatggccaccggccaccccatggtgatcagcagcgacgaccccgccatgttcggcgccaagggcctgagctacgacttctacgaggtgttcatgggcatcggcggcatgaaggccgacctgagaaccctgaagcagctggccatgaacagcatcaagtacagcaccctgctggagagcgagaagaacaccttcatggagatctggaagaagagatgggacaagttcatcgccgacgtggccaccaagtag

SEQ ID NO: 4751 - DNA, 1137 bp, Artificial Sequence; identical to SEQ ID NO: 4499
  Description of Artificial Sequence: Synthetic coding sequence

SEQ ID NO: 4752 - DNA, 678 bp, Artificial Sequence; identical to SEQ ID NO: 4468
  Description of Artificial Sequence: Synthetic coding sequence

SEQ ID NO: 4753 - DNA, 846 bp, Artificial Sequence; identical to SEQ ID NO: 3902
  Description of Artificial Sequence: Synthetic coding sequence

SEQ ID NO: 4754 - DNA, 1110 bp, Artificial Sequence
  Description of Artificial Sequence: Synthetic coding sequence
atgaagttccagggccccctggcctgcctgctgctggccctgtgcctgggcagcggcgaggccggccccctgcagagcggcgaggagagcaccggcaccaacatcggcgaggccctgggccacggcctgggcgacgccctgagcgagggcgtgggcaaggccatcggcaaggaggccggcggcgccgccggcagcaaggtgagcgaggccctgggccagggcaccagagaggccgtgggcaccggcgtgagacaggtgcccggcttcggcgtggccgacgccctgggcaacagagtgggcgaggccgcccacgccctgggcaacaccggccacgagatcggcagacaggccgaggacgtgatcagacacggcgccgacgccgtgagaggcagctggcagggcgtgcccggccacaacggcgcctgggagaccagcggcggccacggcatcttcggcagccagggcggcctgggcggccagggccagggcaaccccggcggcctgggcaccccctgggtgcacggctaccccggcaacagcgccggcagcttcggcatgaacccccagggcgccccctggggccagggcggcaacggcggcccccccaacttcggcaccaacacccagggcgccgtggcccagcccggctacggcagcgtgagagccagcaaccagaacgagggctgcaccaaccccccccccagcggcagcggcggcggcagcagcaacagcggcggcggcagcggcagccagagcggcagcagcggcagcggcagcaacggcgacaacaacaacggcagcagcagcggcggcagcagcagcggcagcagcagcggcggcagcagcggcggcagcagcggcggcagcagcggcaacagcggcggcagcagaggcgacagcggcagcgagagcagctggggcagcagcaccggcagcagcagcggcaaccacggcggcagcggcggcggcaacggccacaagcccggcaacagcgagaccagccccggcatgttcaacttcgacaccttctggaagaacttcaagagcaagctgggcttcatcaactgggacgccatcaacaaggaccagagaagcagcagaatcccctag

SEQ ID NO: 4755 - DNA, 420 bp, Artificial Sequence; identical to SEQ ID NO: 4488
  Description of Artificial Sequence: Synthetic coding sequence

SEQ ID NO: 4756 - DNA, 516 bp, Artificial Sequence
  Description of Artificial Sequence: Synthetic coding sequence
atgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggtgctggagagccaccccagaaccagaagccccggcctggtgggcatcagacccacccccctgcccgtgagccccatggccctggtgcacctgtgcgaggtggacagcccccaggactag

SEQ ID NO: 4757 - DNA, 192 bp, Artificial Sequence; identical to SEQ ID NO: 4605
  Description of Artificial Sequence: Synthetic coding sequence

SEQ ID NO: 4758 - DNA, 1137 bp, Artificial Sequence; identical to SEQ ID NO: 4499
  Description of Artificial Sequence: Synthetic coding sequence

SEQ ID NO: 4759 - DNA, 2535 bp, Artificial Sequence; identical to SEQ ID NO: 3960
  Description of Artificial Sequence: Synthetic coding sequence

SEQ ID NO: 4760 - DNA, 339 bp, Artificial Sequence
  Description of Artificial Sequence: Synthetic coding sequence
atgctgaccgccgccctggcccccggcgccgccaacagccccaccaccaaccccgtgatcctgatcgtggacaaggtgctggagacccaggacctgaacggcgacggcctgatgacccccgccgagctgatcaacttccccggcgtggccctgagaccctaccccccctacatcggcgtgggccccaacagcaacatgtgcagcagaagcgacctgcccgaggacagcaacaccctgtaccccggcagccacctgtggctgagacacgccctgaacagcaagggcaacctggacgccagactggacggcggcgagaaggccatgcagccccagtggtag

SEQ ID NO: 4761 - DNA, 2676 bp, Artificial Sequence; identical to SEQ ID NO: 4153
  Description of Artificial Sequence: Synthetic coding sequence

SEQ ID NO: 4762 - DNA, 2742 bp, Artificial Sequence; identical to SEQ ID NO: 3799
  Description of Artificial Sequence: Synthetic coding sequence

SEQ ID NO: 4763 - DNA, 390 bp, Artificial Sequence; identical to SEQ ID NO: 4161
  Description of Artificial Sequence: Synthetic coding sequence

SEQ ID NO: 4764 - DNA, 846 bp, Artificial Sequence; identical to SEQ ID NO: 3902
  Description of Artificial Sequence: Synthetic coding sequence

SEQ ID NO: 4765 - DNA, 444 bp, Artificial Sequence; identical to SEQ ID NO: 4359
  Description of Artificial Sequence: Synthetic coding sequence

SEQ ID NO: 4766 - DNA, 2631 bp, Artificial Sequence; identical to SEQ ID NO: 3583
  Description of Artificial Sequence: Synthetic coding sequence

SEQ ID NO: 4767 - DNA, 1749 bp, Artificial Sequence
  Description of Artificial Sequence: Synthetic coding sequence
atggacttcctgctggccctggtgctggtgagcagcctgtacctgcaggccgccgccgagttcgacggcagatggcccagacagatcgtgagcagcatcggcctgtgcagatacggcggcagaatcgactgctgctggggctgggccagacagagctggggccagtgccagcccttctacgtgctgagacagagaatcgccagaatcagatgccagctgaaggccgtgtgccagcccagatgcaagcacggcgagtgcatcggccccaacaagtgcaagtgccaccccggctacgccggcaagacctgcaaccaggacctgaacgagtgcggcctgaagcccagaccctgcaagcacagatgcatgaacacctacggcagctacaagtgctactgcctgaacggctacatgctgatgcccgacggcagctgcagcagcgccctgacctgcagcatggccaactgccagtacggctgcgacgtggtgaagggccagatcagatgccagtgccccagccccggcctgcagctggcccccgacggcagaacctgcgtggacgtggacgagtgcgccaccggcagagccagctgccccagattcagacagtgcgtgaacaccttcggcagctacatctgcaagtgccacaagggcttcgacctgatgtacatcggcggcaagtaccagtgccacgacatcgacgagtgcagcctgggccagtaccagtgcagcagcttcgccagatgctacaacatcagaggcagctacaagtgcaagtgcaaggagggctaccagggcgacggcctgacctgcgtgtacatccccaaggtgatgatcgagcccagcggccccatccacgtgcccaagggcaacggcaccatcctgaagggcgacaccggcaacaacaactggatccccgacgtgggcagcacctggtggccccccaagaccccctacatcccccccatcatcaccaacagacccaccagcaagcccaccaccagacccacccccaagcccacccccatccccaccccccccccccccccccccctgcccaccgagctgagaacccccctgccccccaccacccccgagagacccaccaccggcctgaccaccatcgcccccgccgccagcaccccccccggcggcatcaccgtggacaacagagtgcagaccgacccccagaagcccagaggcgacgtgttcatccccagacagcccagcaacgacctgttcgagatcttcgagatcgagagaggcgtgagcgccgacgacgaggccaaggacgaccccggcgtgctggtgcacagctgcaacttcgaccacggcctgtgcggctggatcagagagaaggacaacgacctgcactgggagcccatcagagaccccgccggcggccagtacctgaccgtgagcgccgccaaggcccccggcggcaaggccgccagactggtgctgcccctgggcagactgatgcacagcggcgacctgtgcctgagcttcagacacaaggtgaccggcctgcacagcggcaccctgcaggtgttcgtgagaaagcacggcgcccacggcgccgccctgtggggcagaaacggcggccacggctggagacagacccagatcaccctgagaggcgccgacatcaagagcgtggtgttcaagggcgagaagagaagaggccacaccggcgagatcggcctggacgacgtgagcctgaagaagggccactgcagcgaggagagatag

SEQ ID NO: 4768 - DNA, 1602 bp, Artificial Sequence
  Description of Artificial Sequence: Synthetic coding sequence
atgggcagcagcagactggccgccctgctgctgcccctgctgctgatcgtgatcgacctgagcgacagcgccggcatcggcttcagacacctgccccactggaacaccagatgccccctggccagccacaccgacgacagcttcaccggcagcagcgcctacatcccctgcagaacctggtgggccctgttcagcaccaagccctggtgcgtgagagtgtggcactgcagcagatgcctgtgccagcacctgctgagcggcggcagcggcctgcagagaggcctgttccacctgctggtgcagaagagcaagaagagcagcaccttcaagttctacagaagacacaagatgcccgcccccgcccagagaaagctgctgcccagaagacacctgagcgagaagagccaccacatcagcatccccagccccgacatcagccacaagggcctgagaagcaagagaacccagcccagcgaccccgagacctgggagagcctgcccagactggacagccagagacacggcggccccgagttcagcttcgacctgctgcccgaggccagagccatcagagtgaccatcagcagcggccccgaggtgagcgtgagactgtgccaccagtgggccctggagtgcgaggagctgagcagcccctacgacgtgcagaagatcgtgagcggcggccacaccgtggagctgccctacgagttcctgctgccctgcctgtgcatcgaggccagctacctgcaggaggacaccgtgagaagaaagaagtgccccttccagagctggcccgaggcctacggcagcgacttctggaagagcgtgcacttcaccgactacagccagcacacccagatggtgatggccctgaccctgagatgccccctgaagctggaggccgccctgtgccagagacacgactggcacaccctgtgcaaggacctgcccaacgccaccgccagagagagcgacggctggtacgtgctggagaaggtggacctgcacccccagctgtgcttcaagttcagcttcggcaacagcagccacgtggagtgcccccaccagaccggcagcctgaccagctggaacgtgagcatggacacccaggcccagcagctgatcctgcacttcagcagcagaatgcacgccaccttcagcgccgcctggagcctgcccggcctgggccaggacaccctggtgccccccgtgtacaccgtgagccaggccagaggcagcagccccgtgagcctggacctgatcatccccttcctgagacccggctgctgcgtgctgctgcacgccagcctgagcagccccggcggcgaggacgcctggctgatcggcgtgggcggcagcgtgcccagcggcgtggccgtgagatgccccgtgtgcctggaggcccccctggtgagcggctgcctgctgcagacccccggcgccctggaccccggcaccgccggccccccccaccccaccggctgctgcagcggcccccacctgcccgcccccaccgtgagacccggccccagcgccgccagcgccccccccgccagaggcggcctgggcggcgccgccgcccccggcggcagcgccggctag

SEQ ID NO: 4769 - DNA, 1293 bp, Artificial Sequence
  Description of Artificial Sequence: Synthetic coding sequence
atgggcgtgagcaagctggacatcctgtacagaagactgctgctgaccaagctgttcatcagaggctggggcagacccgaggacctgaagagactgttcgagttcagaaagatgatcggcaacagagagagatgccagaacctggtgagcagcgactaccccgtgcacatcgacaagatcgaggagcagagcgactgcaagatcctggacggccacttcgtgagccccatggcccactacgtgcccgacatcatgcccatcgagagcgtgatcgccagattccagttcatcgtgcccaaggagtggaacagcaagtacagacccgtgtgcatccacctggccggcaccggcgaccaccactactggagaagaagaaccctgatggccagacccatgatcaaggaggccagaatggccagcctgctgctggagaacccctactacggctgcagaaagcccaaggaccaggtgagaagcagcctgaagaacgtgagcgacctgttcgtgatgggcggcgccctggtgctggagagcgccgccctgctgcactggctggagagagagggctacggccccctgggcatgaccggcatcagcatgggcggccacatggccagcctggccgtgagcaactggcccaagcccatgcccctgatcccctgcctgagctggagcaccgccagcggcgtgttcaccaccaccgacagcttcaagatgggccaggagttcgtgaagcacttcaccagcagcgccgacaagctgaccaacctgaacctggtgagcagaaccctgaacctggacatcagcaaccaggtggtgagccagaagcccgccgactgccacaacagcagcaagaccagcgtgagcgccaccagcgagggcctgctgctgcaggacaccagcaagatgaagagattcaaccagaccctgagcaccaacaagagcggctacaccagcagaaacccccagagctaccacctgctgagcaaggagcagagcagaaacagcctgagaaaggagagcctgatcttcatgaagggcgtgatggacgagtgcacccacgtggccaacttcagcgtgcccgtggaccccagcctgatcatcgtggtgcaggccaaggaggacgcctacatccccagaaccggcgtgagaagcctgcaggagatctggcccggctgcgagatcagatacctggagggcggccacatcagcgcctacctgttcaagcagggcctgttcagacaggccatctacgacgccttcgacagattcctgcacaagtacgccaactag

SEQ ID NO: 4770 - DNA, 2631 bp, Artificial Sequence; identical to SEQ ID NO: 3583
  Description of Artificial Sequence: Synthetic coding sequence

SEQ ID NO: 4771 - DNA, 237 bp, Artificial Sequence; identical to SEQ ID NO: 3991
  Description of Artificial Sequence: Synthetic coding sequence

SEQ ID NO: 4772 - DNA, 2631 bp, Artificial Sequence; identical to SEQ ID NO: 3583
  Description of Artificial Sequence: Synthetic coding sequence

SEQ ID NO: 4773 - DNA, 1257 bp, Artificial Sequence; identical to SEQ ID NO: 3870
  Description of Artificial Sequence: Synthetic coding sequence

SEQ ID NO: 4774 - DNA, 390 bp, Artificial Sequence
  Description of Artificial Sequence: Synthetic coding sequence
atgagaaagcccagaagaaagagcagacagaacgccgagggcagaagaagccccagcccctacagcctgaagtgcagccccaccagagagaccctgacctacgcccaggcccagagaatcgtggaggtggacatcgacggcagactgcacagaatcagcatctacgaccccctgaagatcatcaccgaggacgagctgaccgcccaggacatcaccgagtgcaacagcaacaaggagaacagcgagcagccccagttccccggcaagagcaagaagcccagcagcaagggcaagaagaaggagagctgcagcaagcacgccagcggcaccagcttccacctgccccagcccagcttcagaatggtggacagcggcatccagcccgagtag

SEQ ID NO: 4775 - DNA, 315 bp, Artificial Sequence
  Description of Artificial Sequence: Synthetic coding sequence
atgagagtggtgaccatcgtgatcctgctgtgcttctgcaaggccgccgagctgagaaaggccagccccggcagcgtgagaagcagagtgaaccacggcagagccggcggcggcagaagaggcagcaaccccgtgaagagatacgcccccggcctgccctgcgacgtgtacacctacctgcacgagaagtacctggactgccaggagagaaagctggtgtacgtgctgcccggctggccccaggacctgctgcacatgctgctggccagaaacaagatcagaaccctgaagaacaacatgttcagcaagttctag

SEQ ID NO: 4776 - DNA, 639 bp, Artificial Sequence; identical to SEQ ID NO: 4651
  Description of Artificial Sequence: Synthetic coding sequence

SEQ ID NO: 4777 - DNA, 1005 bp, Artificial Sequence
  Description of Artificial Sequence: Synthetic coding sequence
atgctggccctggccaagatcctgctgatcagcaccctgttctacagcctgctgagcggcagccacggcaaggagaaccaggacatcaacaccacccagaacatcgccgaggtgttcaagaccatggagaacaagcccatcagcctggagagcgaggccaacctgaacagcgacaaggagaacatcaccaccagcaacctgaaggccagccacagcccccccctgaacctgcccaacaacagccacggcatcaccgacttcagcagcaacagcagcgccgagcacagcctgggcagcctgaagcccaccagcaccatcagcaccagcccccccctgatccacagcttcgtgagcaaggtgccctggaacgcccccatcgccgacgaggacctgctgcccatcagcgcccaccccaacgccacccccgccctgagcagcgagaacttcacctggagcctggtgaacgacaccgtgaagacccccgacaacagcagcatcaccgtgagcatcctgagcagcgagcccaccagccccagcgtgacccccctgatcgtggagcccagcggctggctgaccaccaacagcgacagcttcaccggcttcaccccctaccaggagaagaccaccctgcagcccaccctgaagttcaccaacaacagcaagctgttccccaacaccagcgacccccagaaggagaacagaaacaccggcatcgtgttcggcgccatcctgggcgccatcctgggcgtgagcctgctgaccctggtgggctacctgctgtgcggcaagagaaagaccgacagcttcagccacagaagactgtacgacgacagaaacgagcccgtgctgagactggacaacgcccccgagccctacgacgtgagcttcggcaacagcagctactacaaccccaccctgaacgacagcgccatgcccgagagcgaggagaacgccagagacggcatccccatggacgacatcccccccctgagaaccagcgtgtag

SEQ ID NO: 4778 - DNA, 987 bp, Artificial Sequence
  Description of Artificial Sequence: Synthetic coding sequence
atgggccccgccggctgcgccttcaccctgctgctgctgctgggcatcagcgtgtgcggccagcccgtgtacagcagcagagtggtgggcggccaggacgccgccgccggcagatggccctggcaggtgagcctgcacttcgaccacaacttcatctgcggcggcagcctggtgagcgagagactgatcctgaccgccgcccactgcatccagcccacctggaccaccttcagctacaccgtgtggctgggcagcatcaccgtgggcgacagcagaaagagagtgaagtactacgtgagcaagatcgtgatccaccccaagtaccaggacaccaccgccgacgtggccctgctgaagctgagcagccaggtgaccttcaccagcgccatcctgcccatctgcctgcccagcgtgaccaagcagctggccatcccccccttctgctgggtgaccggctggggcaaggtgaaggagagcagcgacagagactaccacagcgccctgcaggaggccgaggtgcccatcatcgacagacaggcctgcgagcagctgtacaaccccatcggcatcttcctgcccgccctggagcccgtgatcaaggaggacaagatctgcgccggcgacacccagaacatgaaggacagctgcaagggcgacagcggcggccccctgagctgccacatcgacggcgtgtggatccagaccggcgtggtgagctggggcctggagtgcggcaagagcctgcccggcgtgtacaccaacgtgatctactaccagaagtggatcaacgccaccatcagcagagccaacaacctggacttcagcgacttcctgttccccatcgtgctgctgagcctggccctgctgagacccagctgcgccttcggccccaacaccatccacagagtgggcaccgtggccgaggccgtggcctgcatccagggctgggaggagaacgcctggagattcagccccagaggcagatag

SEQ ID NO: 4779 - DNA, 453 bp, Artificial Sequence; identical to SEQ ID NO: 3797
  Description of Artificial Sequence: Synthetic coding sequence

SEQ ID NO: 4780 - DNA, 234 bp, Artificial Sequence
  Description of Artificial Sequence: Synthetic coding sequence
atgagagtggccggcgccgccaagctggtggtggccgtggccgtgttcctgctgaccttctacgtgatcagccaggtgttcgagatcaagatggacgccagcctgggcaacctgttcgccagaagcgccctggacaccgccgccagaagcaccaagccccccagatacaagtgcggcatcagcaaggcctgccccgagaagcacttcgccttcaagatggccagcggcgcctag

SEQ ID NO: 4781 - DNA, 1143 bp, Artificial Sequence; identical to SEQ ID NO: 4084
  Description of Artificial Sequence: Synthetic coding sequence

SEQ ID NO: 4782 - DNA, 558 bp, Artificial Sequence
  Description of Artificial Sequence: Synthetic coding sequence
atgcccggctggctgaccctgcccaccctgtgcagattcctgctgtgggccttcaccatcttccacaaggcccagggcgaccccgccagccaccccggcccccactacctgctgccccccatccacgaggtgatccacagccacagaggcgccaccgccaccctgccctgcgtgctgggcaccaccccccccagctacaaggtgagatggagcaaggtggagcccggcgagctgagagagaccctgatcctgatcaccaacggcctgcacgccagaggctacggccccctgggcggcagagccagaatgagaagaggccacagactggacgccagcctggtgatcgccggcgtgagactggaggacgagggcagatacagatgcgagctgatcaacggcatcgaggacgagagcgtggccctgaccctgagcctggagggcgtggtgttcccctaccagcccagcagaggcagataccagttcaactactacgaggccaagcaggcctgcgaggagcaggacggcagactggccacctacagccagctgtaccagtag

SEQ ID NO: 4783 - DNA, 375 bp, Artificial Sequence
  Description of Artificial Sequence: Synthetic coding sequence
atgctgatgctgttcgtgttcggcgtgctgctgcacgaggtgagcctgagcggccagaacgaggccccccccaacacccacagcatccccggcgagcccctgtacaactacgccagcatcagactgcccgaggagcacatccccttcttcctgcacaacaacagacacatcgccaccgtgtgcagaaaggacagcctgtgcccctacaagaagcacctggagaagctgaagtactgctggggctacgagaagagctgcaagcccgagttcagattcggctaccccgtgtgcagctacgtggacatgggctggaccgacaccctggagagcgccgaggacatcttctggaagcaggccgacttcggctacgcctag

SEQ ID NO: 4784 - DNA, 5859 bp, Artificial Sequence; identical to SEQ ID NO: 3982
  Description of Artificial Sequence: Synthetic coding sequence

SEQ ID NO: 4785 - DNA, 612 bp, Artificial Sequence
  Description of Artificial Sequence: Synthetic coding sequence
atgagaaccgtggtgctgaccatgaaggccagcgtgatcgagatgttcctggtgctgctggtgaccggcgtgcacagcaacaaggagaccgccaagaagatcaagagacccaagttcaccgtgccccagatcaactgcgacgtgaaggccggcaagatcatcgaccccgagttcatcgtgaagtgccccgccggctgccaggaccccaagtaccacgtgtacggcaccgacgtgtacgccagctacagcagcgtgtgcggcgccgccgtgcacagcggcgtgctggacaacagcggcggcaagatcctggtgagaaaggtggccggccagagcggctacaagggcagctacagcaacggcgtgcagagcctgagcctgcccagatggagagagagcttcatcgtgctggagagcaagcccaagaagggcgtgacctaccccagcgccctgacctacagcagcagcaagagccccgccgcccaggccggcaagtgcagcagagtgatcgagagcaagcccagcgagagcatgaacaccagaagagtgctgggcgacagcggcgagatcaacatcctgaccggccaggcccccctggccctggccatcttctag

SEQ ID NO: 4786 - DNA, 2511 bp, Artificial Sequence
  Description of Artificial Sequence: Synthetic coding sequence
atggagacccaggagctgagaggcgccctggccctgctgctgctgtgcttcttcaccagcgccagccaggacctgcaggtgatcgacctgctgaccgtgggcgagagcagacagatggtggccgtggccgagaagatcagaaccgccctgctgaccgccggcgacatctacctgctgagcaccttcagactgccccccaagcagggcggcgtgctgttcggcctgtacagcagacaggacaacaccagatggctggaggccagcgtggtgggcaagatcaacaaggtgaccaacgccctgcacagcatcctgggcgagcagaccaaggccctggtgacccagctgaccctgttcaaccagatcctggtggagctgagagacgacatcagagaccaggtgaaggagatgagcctgatcagaaacaccatcatggagtgccaggtgtgcggcttccacgagcagagaagccactgcagccccaacccctgcttcagaggcgtggactgcatggaggtgtacgagtaccccggctacagatgcggcccctgcccccccggcctgcagggcaacggcacccactgcagcgacatcaacgagtgcgcccacgccgacccctgcttccccggcagcagctgcatcaacaccatgcccggcttccactgcgaggcctgccccagaggctacaagggcacccaggtgagcggcgtgggcatcgactacgccagagccagcaagcaggtgtgcaacgacatcgacgagtgcaacgacggcaacaacggcggctgcgaccccaacagcatctgcaccaacaccgtgggcagcttcaagtgcggcccctgcagactgggcttcctgggcaaccagagccagggctgcctgcccgccagaacctgccacagccccgcccacagcccctgccacatccacgcccactgcctgttcgagagaaacggcgccgtgagctgccagtgcaacgtgggctgggccggcaacggcaacgtgtgcggcaccgacaccgacatcgacggctaccccgaccaggccctgccctgcatggacaacaacaagcactgcaagcaggacaactgcctgctgacccccaacagcggccaggaggacgccgacaacgacggcgtgggcgaccagtgcgacgacgacgccgacggcgacggcatcaagaacgtggaggacaactgcagactgttccccaacaaggaccagcagaacagcgacaccgacagcttcggcgacgcctgcgacaactgccccaacgtgcccaacaacgaccagaaggacaccgacggcaacggcgagggcgacgcctgcgacaacgacgtggacggcgacggcatccccaacggcctggacaactgccccaaggtgcccaaccccctgcagaccgacagagacgaggacggcgtgggcgacgcctgcgacagctgccccgagatgagcaaccccacccagaccgacgccgacagcgacctggtgggcgacgtgtgcgacaccaacgaggacagcgacggcgacggccaccaggacaccaaggacaactgcccccagctgcccaacagcagccagctggacagcgacaacgacggcctgggcgacgagtgcgacggcgacgacgacaacgacggcatccccgactacgtgccccccggccccgacaactgcagactggtgcccaaccccaaccagaaggacagcgacggcaacggcgtgggcgacgtgtgcgaggacgacttcgacaacgacgccgtggtggaccccctggacgtgtgccccgagagcgccgaggtgaccctgaccgacttcagagcctaccagaccgtggtgctggaccccgagggcgacgcccagatcgaccccaactgggtggtgctgaaccagggcatggagatcgtgcagaccatgaacagcgaccccggcctggccgtgggctacaccgccttcaacggcgtggacttcgagggcaccttccacgtgaacaccgtgaccgacgacgactacgccggcttcctgttcagctaccaggacagcggcagattctacgtggtgatgtggaagcagaccgagcagacctactggcaggccacccccttcagagccgtggcccagcccggcctgcagctgaaggccgtgaccagcgtgagcggccccggcgagcacctgagaaacgccctgtggcacaccggccacacccccgaccaggtgagactgctgtggaccgaccccagaaacgtgggctggagagacaagaccagctacagatggcagctgctgcacagaccccaggtgggctacatcagagtgaagctgtacgagggcccccagctggtggccgacagcggcgtgatcatcgacaccagcatgagaggcggcagactgggcgtgttctgcttcagccaggagaacatcatctggagcaacctgcagtacagatgcaacgacaccgtgcccgaggacttcgagcccttcagaagacagctgctgcagggcagagtgtag

SEQ ID NO: 4787 - DNA, 1311 bp, Artificial Sequence
  Description of Artificial Sequence: Synthetic coding sequence
atgtggagatgccccctgggcctgctgctgctgctgcccctggccggccacctggccctgggcgcccagcagggcagaggcagaagagagctggcccccggcctgcacctgagaggcatcagagacgccggcggcagatactgccaggagcaggacctgtgctgcagaggcagagccgacgactgcgccctgccctacctgggcgccatctgctactgcgacctgttctgcaacagaaccgtgagcgactgctgccccgacttctgggacttctgcctgggcgtgcccccccccttcccccccatccagggctgcatgcacggcggcagaatctaccccgtgctgggcacctactgggacaactgcaacagatgctggcaggccggcaaccacagcgccttctggggcatgaccctggacgagggcatcagatacagactgggcaccatcagacccagcagcagcgtgatgaacatgcacgagatctacaccgtgctgaaccccggcgaggtgctgcccaccgccttcgaggccagcgagaagtggcccaacctgatccacgagcccctggaccagggcaactgcgccggcagctgggccttcagcaccgccgccgtggccagcgacagagtgagcatccacagcctgggccacatgacccccgtgctgagcccccagaacctgctgagctgcgacacccaccagcagcagggctgcagaggcggcagactggacggcgcctggtggttcctgagaagaagaggcgtggtgagcgaccactgctaccccttcagcggcagagagagagacgaggccggccccgcccccccctgcatgatgcacagcagagccatgggcagaggcaagagacaggccaccgcccactgccccaacagctacgtgaacaacaacgacatctaccaggtgacccccgtgtacagactgggcagcaacgacaaggagatcatgaaggagctgatggagaacggccccgtgcaggccctgatggaggtgcacgaggacttcttcctgtacaagggcggcatctacagccacacccccgtgagcctgggcagacccgagagatacagaagacacggcacccacagcgtgaagatcaccggctggggcgaggagaccctgcccgacggcagaaccctgaagtactggaccgccgccaacagctggggccccgcctggggcgagagaggccacttcagaatcgtgagaggcgtgaacgagtgcgacatcgagagcttcgtgctgggcgtgtggggcagagtgggcatggaggacatgggccaccactag

SEQ ID NO: 4788 - DNA, 942 bp, Artificial Sequence; identical to SEQ ID NO: 3906
  Description of Artificial Sequence: Synthetic coding sequence

SEQ ID NO: 4789 - DNA, 213 bp, Artificial Sequence
  Description of Artificial Sequence: Synthetic coding sequence
atggtggcccccgccgccagagtgttcctgagagccgtgagagccgccctgaccagcaccgtgcccgacctgctgtgcctgctggccagaggcagccccagaggcctggccagcggcagactgcccctggccgtgcacagcgcccagcacggccccggcagcggcgccccctggctgagaatcgccagaagagccctgagccagagaatctag

SEQ ID NO: 4790 - DNA, 642 bp, Artificial Sequence
  Description of Artificial Sequence: Synthetic coding sequence
atggcccagctgttcctgcccctgctggccgccctggtgctggcccaggcccccgccgccctggccgacgtgctggagggcgacagcagcgaggacagagccttcagagtgagaatcgccggcgacgcccccctgcagggcgtgctgggcggcgccctgaccatcccctgccacgtgcactacctgagacccccccccagcagaagagccgtgctgggcagccccagagtgaagtggaccttcctgagcagaggcagagaggccgaggtgctggtggccagaggcgtgagagtgaaggtgaacgaggcctacagattcagagtggccctgcccgcctaccccgccagcctgaccgacgtgagcctggccctgagcgagctgagacccaacgacagcggcatctacagatgcgaggtgcagcacggcatcgacgacagcagcgacgccgtggaggtgaaggtgaagggcgtggtgttcctgtacagagagggcagcgccagatacgccttcagcttcagcggcgcccaggaggcctgcgccagaatcggcgcccacatcgccacccccgagcagctgtacgccgcctacctgggcggctacgagcagtgcgacgccggctggctgagcgaccagaccgtgtag

SEQ ID NO: 4791 - DNA, 237 bp, Artificial Sequence; identical to SEQ ID NO: 3991
  Description of Artificial Sequence: Synthetic coding sequence

SEQ ID NO: 4792 - DNA, 651 bp, Artificial Sequence
  Description of Artificial Sequence: Synthetic coding sequence
atgagcgacctgctgctgctgggcctgatcggcggcctgaccctgctgctgctgctgaccctgctggccttcgccggctacagcggcctgctggccggcgtggaggtgagcgccggcagcccccccatcagaaacgtgaccgtggcctacaagttccacatgggcctgtacggcgagaccggcagactgttcaccgagagctgcagcatcagccccaagctgagaagcatcgccgtgtactacgacaacccccacatggtgccccccgacaagtgcagatgcgccgtgggcagcatcctgagcgagggcgaggagagccccagccccgagctgatcgacctgtaccagaagttcggcttcaaggtgttcagcttccccgcccccagccacgtggtgaccgccaccttcccctacaccaccatcctgagcatctggctggccaccagaagagtgcaccccgccctggacacctacatcaaggagagaaagctgtgcgcctaccccagactggagatctaccaggaggaccagatccacttcatgtgccccctggccagacagggcgacttctacgtgcccgagatgaaggagaccgagtggaagtggagaggcctggtggaggccatcgacacccaggtggacggcacctag

SEQ ID NO: 4793 - DNA, 453 bp, Artificial Sequence; identical to SEQ ID NO: 3797
  Description of Artificial Sequence: Synthetic coding sequence

SEQ ID NO: 4794 - DNA, 171 bp, Artificial Sequence
  Description of Artificial Sequence: Synthetic coding sequence
atgaagaccggcctgttcttcctgtgcctgctgggcaccgccgccgccatccccaccaacgccagactgctgagcgaccacagcaagcccaccgccgagaccgtggcccccgacaacaccgccatccccagcctgagagccgaggccgaggagaacgagaaggagacctag

SEQ ID NO: 4795 - DNA, 2346 bp, Artificial Sequence
  Description of Artificial Sequence: Synthetic coding sequence
atggccgtggccgaggtgagcagaacctgcctgctgaccgtgagagtgctgcaggcccacagactgcccagcaaggacctggtgacccccagcgactgctacgtgaccctgtggctgcccaccgcctgcagccacagactgcagaccagaaccgtgaagaacagcagcagccccgtgtggaaccagagcttccacttcagaatccacagacagctgaagaacgtgatggagctgaaggtgttcgaccaggacctggtgaccggcgacgaccccgtgctgagcgtgctgttcgacgccggcaccctgagagccggcgagttcagaagagagagcttcagcctgagcccccagggcgagggcagactggaggtggagttcagactgcagagcctggccgacagaggcgagtggctggtgagcaacggcgtgctggtggccagagagctgagctgcctgcacgtgcagctggaggagaccggcgaccagaagagcagcgagcacagagtgcagctggtggtgcccggcagctgcgagggcccccaggaggccagcgtgggcaccggcaccttcagattccactgccccgcctgctgggagcaggagctgagcatcagactgcaggacgcccccgaggagcagctgaaggcccccctgagcgccctgcccagcggccaggtggtgagactggtgttccccaccagccaggagcccctgatgagagtggagctgaagaaggaggccggcctgagagagctggccgtgagactgggcttcggcccctgcgccgaggagcaggccttcctgagcagaagaaagcaggtggtggccgccgccctgagacaggccctgcagctggacggcgacctgcaggaggacgagatccccgtggtggccatcatggccaccggcggcggcatcagagccatgaccagcctgtacggccagctggccggcctgaaggagctgggcctgctggactgcgtgagctacatcaccggcgccagcggcagcacctgggccctggccaacctgtacgaggaccccgagtggagccagaaggacctggccggccccaccgagctgctgaagacccaggtgaccaagaacaagctgggcgtgctggcccccagccagctgcagagatacagacaggagctggccgagagagccagactgggctaccccagctgcttcaccaacctgtgggccctgatcaacgaggccctgctgcacgacgagccccacgaccacaagctgagcgaccagagagaggccctgagccacggccagaaccccctgcccatctactgcgccctgaacaccaagggccagagcctgaccaccttcgagttcggcgagtggtgcgagttcagcccctacgaggtgggcttccccaagtacggcgccttcatccccagcgagctgttcggcagcgagttcttcatgggccagctgatgaagagactgcccgagagcagaatctgcttcctggagggcatctggagcaacctgtacgccgccaacctgcaggacagcctgtactgggccagcgagcccagccagttctgggacagatgggtgagaaaccaggccaacctggacaaggagcaggtgcccctgctgaagatcgaggagccccccagcaccgccggcagaatcgccgagttcttcaccgacctgctgacctggagacccctggcccaggccacccacaacttcctgagaggcctgcacttccacaaggactacttccagcacccccacttcagcacctggaaggccaccaccctggacggcctgcccaaccagctgacccccagcgagccccacctgtgcctgctggacgtgggctacctgatcaacaccagctgcctgcccctgctgcagcccaccagagacgtggacctgatcctgagcctggactacaacctgcacggcgccttccagcagctgcagctgctgggcagattctgccaggagcagggcatccccttcccccccatcagccccagccccgaggagcagctgcagcccagagagtgccacaccttcagcgaccccacctgccccggcgcccccgccgtgctgcacttccccctggtgagcgacagcttcagagagtacagcgcccccggcgtgagaagaacccccgaggaggccgccgccggcgaggtgaacctgagcagcagcgacagcccctaccactacaccaaggtgacctacagccaggaggacgtggacaagctgctgcacctgacccactacaacgtgtgcaacaaccaggagcagctgctggaggccctgagacaggccgtgcagagaagaagacagagaagaccccactag

SEQ ID NO: 4796 - DNA, 219 bp, Artificial Sequence
  Description of Artificial Sequence: Synthetic coding sequence
atggccgccgccaccagaggctgcagaccctggggcagcctgctgggcctgctgggcctggtgagcgccgccgccgccgcctgggacctggccagcctgagatgcaccctgggcgccttctgcgagtgcgacttcagacccgacctgcccgagggcagcgaggagctgggccccagagagccccactgcctgtggcccctgcccctgcccctgagatag

SEQ ID NO: 4797 - DNA, 243 bp, Artificial Sequence
  Description of Artificial Sequence: Synthetic coding sequence
atgaaggtgttcttcctgttcgccgtgctgttctgcctggtgcagaccaacagcggcgacgtgccccccggcatcagaaacaccatctgccacatgcagcagggcatctgcagactgttcttctgccacagcggcgagaagaagagagacatctgcagcgacccctggaacagatgctgcgtgagcaacaccgacgaggagggcaaggagaagcccgagatggacggcagaagcggcatctag

SEQ ID NO: 4798 - DNA, 861 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctacgtggagatggagttcgagttcgacagactgagagccttccaggccatgcaggtgcactag

SEQ ID NO: 4799 - DNA, 858 bp, Artificial Sequence
  Description of Artificial Sequence: Synthetic coding sequence
atgagaggccagggcagaaaggagagcctgagcgacagcagagacctggacggcagctacgaccagctgaccggccacccccccggccccaccaagaaggccctgaagcagagattcctgaagctgctgccctgctgcggcccccaggccctgcccagcgtgagcgagatcggcagagtgttcagattcctgggcgacagcagcctgcccagcgccctggccgcccccgccagcctgagaccccacagacccagactgctggaccccgacagcgtggacgacgagttcgagctgagcaccgtgtgccacagacccgagggcctggagcagctgcaggagcagaccaagttcaccagaaaggagctgcaggtgctgtacagaggcttcaagaacgagtgccccagcggcatcgtgaacgaggagaacttcaagcagatctacagccagttcttcccccagggcgacagcagcacctacgccaccttcctgttcaacgccttcgacaccaaccacgacggcagcgtgagcttcgaggacttcgtggccggcctgagcgtgatcctgagaggcaccgtggacgacagactgaactgggccttcaacctgtacgacctgaacaaggacggctgcatcaccaaggaggagatgctggacatcatgaagagcatctacgacatgatgggcaagtacacctaccccgccctgagagaggaggcccccagagagcacgtggagagcttcttccagaagatggacagaaacaaggacggcgtggtgaccatcgaggagttcatcgagagctgccagaaggacgagaacatcatgagaagcatgcagctgttcgacaacgtgatctag

SEQ ID NO: 4800 - DNA, 1311 bp, Artificial Sequence; identical to SEQ ID NO: 3956
  Description of Artificial Sequence: Synthetic coding sequence

SEQ ID NO: 4801 - DNA, 1218 bp, Artificial Sequence; identical to SEQ ID NO: 3601
  Description of Artificial Sequence: Synthetic coding sequence

SEQ ID NO: 4802 - DNA, 300 bp, Artificial Sequence
  Description of Artificial Sequence: Synthetic coding sequence
atgctggccctgctggtgctggtgaccgtggccctggccagcgcccaccacggcggcgagcacttcgagggcgagaaggtgttcagagtgaacgtggaggacgagaaccacatcaacatcatcagagagctggccagcaccacccagatcgacttctggaagcccgacagcgtgacccagatcaagccccacagcaccgtggacttcagagtgaaggccgaggacaccgtgaccgtggagaacgtgctgaagcagaacgagctgcagtacaaggtgctgatcagcaacctgagaaactag

SEQ ID NO: 4803 - DNA, 471 bp, Artificial Sequence
  Description of Artificial Sequence: Synthetic coding sequence
atgctgctgctgctgctgctggcccccctgttcctgagaccccccggcgccggcggcgcccagacccccaacgccaccagcgagggctgccagatcatccaccccccctgggagggcggcatcagatacagaggcctgaccagagaccaggtgaaggccatcaacttcctgcccgtggactacgagatcgagtacgtgtgcagaggcgagagagaggtggtgggccccaaggtgagaaagtgcctggccaacggcagctggaccgacatggacacccccagcagatgcgtgagaatctgcagcaagagctacctgaccctggagaacggcaaggtgttcctgaccggcggcgacctgcccgccctggacggcgccagagtggacttcagatgcgaccccgacttccacctggtgggcagcagcagaagcatctgcagccagggccagtggagcacccccaagccccactag

SEQ ID NO: 4804 - DNA, 249 bp, Artificial Sequence
  Description of Artificial Sequence: Synthetic coding sequence
atgggcagagtgttcctgaccggcgagaaggccaacagcatcctgaagagataccccagagccaacggcttcttcgaggagatcagacagggcaacatcgagagagagtgcaaggaggagttctgcaccttcgaggaggccagagaggccttcgagaacaacgagaagaccggcctggtgctgctgcccagactggagtgcagctgcgagcacggcagcctgcagccccagctgcccgtgcccaagtag

SEQ ID NO: 4805 - DNA, 372 bp, Artificial Sequence
  Description of Artificial Sequence: Synthetic coding sequence
atgcagggcacccccggcggcggcaccagacccggccccagccccgtggacagaagaaccctgctggtgttcagcttcatcctggccgccgccctgggccagatgaacttcaccggcgaccaggtgctgagagtgctggccaaggacgagaagcagctgagcctgctgggcgacctggagggcctgaagccccagaaggtggacttctggagaggccccgccagacccagcctgcccgtggacatgagagtgcccttcagcgagctgaaggacatcaaggcctacctggagagccacggcctggcctacagcatcatgatcaaggacatccaggtgctgctggacgaggagagacaggccatggccaagtag

SEQ ID NO: 4806 - DNA, 840 bp, Artificial Sequence
  Description of Artificial Sequence: Synthetic coding sequence
atgggcagagtgttcctgaccggcgagaaggccaacagcatcctgaagagataccccagagccaacggcttcttcgaggagatcagacagggcaacatcgagagagagtgcaaggaggagttctgcaccttcgaggaggccagagaggccttcgagaacaacgagaagaccatcaccggcgtgatcctgctggccgtgggcgtgtggggcaagctgaccctgggcacctacatcagcctgatcgccgagaacagcaccaacgccccctacgtgctgatcggcaccggcaccaccatcgtggtgttcggcctgttcggctgcttcgccacctgcagaggcagcccctggatgctgaagctgtacgccatgttcctgagcctggtgttcctggccgagctggtggccggcatcagcggcttcgtgttcagacacgagatcaaggacaccttcctgagaacctacaccgacgccatgcagacctacaacggcaacgacgagagaagcagagccgtggaccacgtgcagagaagcctgagctgctgcggcgtgcagaactacaccaactggagcaccagcccctacttcctggagcacggcatcccccccagctgctgcatgaacgagaccgactgcaacccccaggacctgcacaacctgaccgtggccgccaccaaggtgaaccagaagggctgctacgacctggtgaccagcttcatggagaccaacatgggcatcatcgccggcgtggccttcggcatcgccttcagccagctgatcggcatgctgctggcctgctgcctgagcagattcatcaccgccaaccagtacgagatggtgtag

SEQ ID NO: 4807 - DNA, 564 bp, Artificial Sequence
  Description of Artificial Sequence: Synthetic coding sequence
atgtggtgcgccagccccgtggccgtggtggccttctgcgccggcctgctggtgagccaccccgtgctgacccagggccaggaggccggcggcagacccggcgccgactgcgaggtgtgcaaggagttcctgaacagattctacaagagcctgatcgacagaggcgtgaacttcagcctggacaccatcgagaaggagctgatcagcttctgcctggacaccaagggcaaggagaacagactgtgctactacctgggcgccaccaaggacgccgccaccaagatcctgagcgaggtgaccagacccatgagcgtgcacatgcccgccatgaagatctgcgagaagctgaagaagctggacagccagatctgcgagctgaagtacgagaagaccctggacctggccagcgtggacctgagaaagatgagagtggccgagctgaagcagatcctgcacagctggggcgaggagtgcagagcctgcgccgagaagaccgactacgtgaacctgatccaggagctggcccccaagtacgccgccacccaccccaagaccgagctgtag

SEQ ID NO: 4808 - DNA, 1311 bp, Artificial Sequence; identical to SEQ ID NO: 3956
  Description of Artificial Sequence: Synthetic coding sequence

SEQ ID NO: 4809 - DNA, 450 bp, Artificial Sequence
  Description of Artificial Sequence: Synthetic coding sequence
atgggcagagtgttcctgaccggcgagaaggccaacagcatcctgaagagataccccagagccaacggcttcttcgaggagatcagacagggcaacatcgagagagagtgcaaggaggagttctgcaccttcgaggaggccagagaggccttcgagaacaacgagaagaccaaggagttctggagcacctacaccaaggcccagcagggcgagagcaacagaggcagcgactggttccagttctacctgaccttccccctgatcttcggcctgttcatcatcctgctggtgatcttcctgatctggagatgcttcctgagaaacaagaccagaagacagaccgtgaccgagggccacatccccttcccccagcacctgaacatcatcacccccccccccccccccgacgaggtgttcgacagcagcggcctgagccccggcttcctgtag

SEQ ID NO: 4810 - DNA, 936 bp, Artificial Sequence
  Description of Artificial Sequence: Synthetic coding sequence
atgctgtaccagaccatcaacagcctgaagaccaagaaccccaagctgaagatcctgctgagcatcggcggctacctgttcggcagcaagggcttccaccccatggtggacagcagcaccagcagactggagttcatcaacagcatcatcctgttcctgagaaaccacaacttcgacggcctggacgtgagctggatctaccccgaccagaaggagaacacccacttcaccgtgctgatccacgagctggccgaggccttccagaaggacttcaccaagagcaccaaggagagactgctgctgaccgccggcgtgagcgccggcagacagatgatcgacaacagctaccaggtggagaagctggccaaggacctggacttcatcaacctgctgagcttcgacttccacggcagctgggagaagcccctgatcaccggccacaacagccccctgagcaagggctggcaggacagaggccccagcagctactacaacgtggagtacgccgtgggctactggatccacaagggcatgcccagcgagaaggtggtgatgggcatccccacctacggccacagcttcaccctggccagcgccgagaccaccgtgggcgcccccgccagcggccccggcgccgccggccccatcaccgagagcagcggcttcctggcctactacgagatctgccagttcctgaagggcgccaagatcaccagactgcaggaccagcaggtgccctacgccgtgaagggcaaccagtgggtgggctacgacgacgtgaagagcatggagaccaaggtgcagttcctgaagaacctgaacctgggcggcgccatgatctggagcatcgacatggacgacttcaccggcaagagctgcaaccagggcccctaccccctggtgcaggccgtgaagagaagcctgggcagcctgtag

SEQ ID NO: 4811 - DNA, 621 bp, Artificial Sequence
  Description of Artificial Sequence: Synthetic coding sequence
atggacaccatcttcctgtggagcctgctgctgctgttcttcggcagccaggccagcagatgcagcgcccagaagaacaccgagttcgccgtggacctgtaccaggaggtgagcctgagccacaaggacaacatcatcttcagccccctgggcatcaccctggtgctggagatggtgcagctgggcgccaagggcaaggcccagcagcagatcagacagaccctgaagcagcaggagaccagcgccggcgaggagttcttcgtgctgaagagcttcttcagcgccatcagcgagaagaagcaggagttcaccttcaacctggccaacgccctgtacctgcaggagggcttcaccgtgaaggagcagtacctgcacggcaacaaggagttcttccagagcgccatcaagctggtggacttccaggacgccaaggcctgcgccgagatgatcagcacctgggtggagagaaagaccgacggcaagatcaaggacatgttcagcggcgaggagttcggccccctgaccagactggtgctggtgaacgccatctacttcaagggcgactggaagcagaagttcagaaaggaggacacccagctgatcaacttcaccaagaagtag

SEQ ID NO: 4812 - DNA, 1218 bp, Artificial Sequence; identical to SEQ ID NO: 3601
  Description of Artificial Sequence: Synthetic coding sequence

SEQ ID NO: 4813 - DNA, 399 bp, Artificial Sequence
  Description of Artificial Sequence: Synthetic coding sequence
atgctgatcttctggaccatcaccctgttcctgctgggcgccgccaagggcaaggaggtgtgctacgaggacctgggctgcttcagcgacaccgagccctggggcggcaccgccatcagacccctgaagatcctgccctggagccccgagaagatcggcaccagattcctgctgtacaccaacgagaaccccaacaacttccagatcctgctgctgagcgaccccagcaccatcgaggccagcaacttccagatggacagaaagaccagattcatcatccacggcttcatcgacaagggcgacgagagctgggtgaccgacatgtgcaagaagctgttcgaggtggaggaggtgaactgcatctgcgtggactggaagaagggcagccaggccacctag

SEQ ID NO: 4814 - DNA, 606 bp, Artificial Sequence; identical to SEQ ID NO: 4157
  Description of Artificial Sequence: Synthetic coding sequence

SEQ ID NO: 4815 - DNA, 1086 bp, Artificial Sequence
  Description of Artificial Sequence: Synthetic coding sequence
atggccagcctgggcctgctgctgctgctgctgctgaccgccctgccccccctgtggagcagcagcctgcccggcctggacaccgccgagagcaaggccaccatcgccgacctgatcctgagcgccctggagagagccaccgtgttcctggagcagagactgcccgagatcaacctggacggcatggtgggcgtgagagtgctggaggagcagctgaagagcgtgagagagaagtgggcccaggagcccctgctgcagcccctgagcctgagagtgggcatgctgggcgagaagctggaggccgccatccagagaagcctgcactacctgaagctgagcgaccccaagtacctgagagagttccagctgaccctgcagcccggcttctggaagctgccccacgcctggatccacaccgacgccagcctggtgtaccccaccttcggcccccaggacagcttcagcgaggagagaagcgacgtgtgcctggtgcagctgctgggcaccggcaccgacagcagcgagccctgcggcctgagcgacctgtgcagaagcctgatgaccaagcccggctgcagcggctactgcctgagccaccagctgctgttcttcctgtgggccagaatgagaggctgcacccagggccccctgcagcagagccaggactacatcaacctgttctgcgccaacatgatggacctgaacagaagagccgaggccatcggctacgcctaccccaccagagacatcttcatggagaacatcatgttctgcggcatgggcggcttcagcgacttctacaagctgagatggctggaggccatcctgagctggcagaagcagcaggagggctgcttcggcgagcccgacgccgaggacgaggagctgagcaaggccatccagtaccagcagcacttcagcagaagagtgaagagaagagagaagcagttccccgacggctgcagcagccacaacaccgccaccgccgtggccgccctgggcggcttcctgtacatcctggccgagtacccccccgccaacagagagccccaccccagcaccccccccccccccagcagcagatag

SEQ ID NO: 4816 - DNA, 162 bp, Artificial Sequence
  Description of Artificial Sequence: Synthetic coding sequence
atgtggaccaacttcttcaagctgagactgttctgctgcctgctggccgtgctgatggtggtggtgctggtgatcaacgtgacccaggtggagtacctggaccacgagaccgtgagcgccaccttcatcgacagcagcggccagttcgtgagcagccagtag

SEQ ID NO: 4817 - DNA, 1305 bp, Artificial Sequence
  Description of Artificial Sequence: Synthetic coding sequence
atggccagcctgggcctgctgctgctgctgctgctgaccgccctgccccccctgtggagcagcagcctgcccggcctggacaccgccgagagcaaggccaccatcgccgacctgatcctgagcgccctggagagagccaccgtgttcctggagcagagactgcccgagatcaacctggacggcatggtgggcgtgagagtgctggaggagcagctgaagagcgtgagagagaagtgggcccaggagcccctgctgcagcccctgagcctgagagtgggcatgctgggcgagaagctggaggccgccatccagagaagcctgcactacctgaagctgagcgaccccaagtacctgagagagttccagctgaccctgcagcccggcttctggaagctgccccacgcctggatccacaccgacgccagcctggtgtaccccaccttcggcccccaggacagcttcagcgaggagagaagcgacgtgtgcctggtgcagctgctgggcaccggcaccgacagcagcgagccctgcggcctgagcgacctgtgcagaagcctgatgaccaagcccggctgcagcggctactgcctgagccaccagctgctgttcttcctgtgggccagaatgagaggctgcacccagggccccctgcagcagagccaggactacatcaacctgttctgcgccaacatgatggacctgaacagaagagccgaggccatcggctacgcctaccccaccagagacatcttcatggagaacagcgtgaccggccaccccgtgttctacctgcccctgtgcgacagcttcctgccccccaaggccgcccccgtgaccgagctgtacaccgacggccccgtgatgttctgcggcatgggcggcttcagcgacttctacaagctgagatggctggaggccatcctgagctggcagaagcagcaggagggctgcttcggcgagcccgacgccgaggacgaggagctgagcaaggccatccagtaccagcagcacttcagcagaagagtgaagagaagagagaagcagttccccgacagcagaagcgtggcccaggccggcgtgcagtggagaaacctgggcagcctgcagcccctgccccccggcttcaagcagttcagctgcctgatcctgcccagcagctgggactacagaagcgtgcccccctacctggccaacttctacatcttcctggtggagaccggcttccaccacgtggcccacgccggcctggagctgctgatcagcagagacccccccaccagcggcagccagagcgtgggcctgtag

SEQ ID NO: 4818 - DNA, 1311 bp, Artificial Sequence; identical to SEQ ID NO: 3956
  Description of Artificial Sequence: Synthetic coding sequence

SEQ ID NO: 4819 - DNA, 1218 bp, Artificial Sequence; identical to SEQ ID NO: 3601
  Description of Artificial Sequence: Synthetic coding sequence

SEQ ID NO: 4820 - DNA, 510 bp, Artificial Sequence
  Description of Artificial Sequence: Synthetic coding sequence
atgctgtaccagaccatcaacagcctgaagaccaagaaccccaagctgaagatcctgctgagcatcggcggctacctgttcggcagcaagggcttccaccccatggtggacagcagcaccagcagactggagttcatcaacagcatcatcctgttcctgagaaaccacaacttcgacggcctggacgtgagctggatctaccccgaccagaaggagaacacccacttcaccgtgctgatccacgagctggccgaggccttccagaaggacttcaccaagagcaccaaggagagactgctgctgaccgccggcgtgagcgccggcagacagatgatcgacaacagctaccaggtggagaagctggccaaggacctggacttcatcaacctgctgagcttcgacttccacggcagctgggagaagcccctgatcaccggccacaacagccccctgagcaagggctggcaggacagaggccccagcagctactacaacgtggagtacgcctag

SEQ ID NO: 4821 - DNA, 1209 bp, Artificial Sequence
  Description of Artificial Sequence: Synthetic coding sequence
atggccagcctgggcctgctgctgctgctgctgctgaccgccctgccccccctgtggagcagcagcctgcccggcctggacaccgccgagagcaaggccaccatcgccgacctgatcctgagcgccctggagagagccaccgtgttcctggagcagagactgcccgagatcaacctggacggcatggtgggcgtgagagtgctggaggagcagctgaagagcgtgagagagaagtgggcccaggagcccctgctgcagcccctgagcctgagagtgggcatgctgggcgagaagctggaggccgccatccagagaagcctgcactacctgaagctgagcgaccccaagtacctgagagagttccagctgaccctgcagcccggcttctggaagctgccccacgcctggatccacaccgacgccagcctggtgtaccccaccttcggcccccaggacagcttcagcgaggagagaagcgacgtgtgcctggtgcagctgctgggcaccggcaccgacagcagcgagccctgcggcctgagcgacctgtgcagaagcctgatgaccaagcccggctgcagcggctactgcctgagccaccagctgctgttcttcctgtgggccagaatgagaggctgcacccagggccccctgcagcagagccaggactacatcaacctgttctgcgccaacatgatggacctgaacagaagagccgaggccatcggctacgcctaccccaccagagacatcttcatggagaacatcatgttctgcggcatgggcggcttcagcgacttctacaagctgagatggctggaggccatcctgagctggcagaagcagcaggagggctgcttcggcgagcccgacgccgaggacgaggagctgagcaaggccatccagtaccagcagcacttcagcagaagagtgaagagaagagagaagcagttccccgacagcagaagcgtggcccaggccggcgtgcagtggagaaacctgggcagcctgcagcccctgccccccggcttcaagcagttcagctgcctgatcctgcccagcagctgggactacagaagcgtgcccccctacctggccaacttctacatcttcctggtggagaccggcttccaccacgtggcccacgccggcctggagctgctgatcagcagagacccccccaccagcggcagccagagcgtgggcctgtag

SEQ ID NO: 4822 - DNA, 1680 bp, Artificial Sequence; identical to SEQ ID NO: 3622
  Description of Artificial Sequence: Synthetic coding sequence

SEQ ID NO: 4823 - DNA, 402 bp, Artificial Sequence
  Description of Artificial Sequence: Synthetic coding sequence
atggccatggtgagcgccatgagctgggtgctgtacctgtggatcagcgcctgcgccatgctgctgtgccacggcagcctgcagcacaccttccagcagcaccacctgcacagacccgagggcggcacctgcgaggtgatcgccgcccacagatgctgcaacaagaacagaatcgaggagagaagccagaccgtgaagtgcagctgcctgcccggcaaggtggccggcaccaccagaaacagacccagctgcgtggacgccagcatcgtgatcggcaagtggtggtgcgagatggagccctgcctggagggcgaggagtgcaagaccctgcccgacaacagcggctggatgtgcgccaccggcaacaagatcaagaccaccagaatccaccccagaacctag

SEQ ID NO: 4824 - DNA, 606 bp, Artificial Sequence; identical to SEQ ID NO: 4157
  Description of Artificial Sequence: Synthetic coding sequence

SEQ ID NO: 4825 - DNA, 606 bp, Artificial Sequence; identical to SEQ ID NO: 4157
  Description of Artificial Sequence: Synthetic coding sequence

SEQ ID NO: 4826 - DNA, 732 bp, Artificial Sequence; identical to SEQ ID NO: 4716
  Description of Artificial Sequence: Synthetic coding sequence

SEQ ID NO: 4827 - DNA, 258 bp, Artificial Sequence
  Description of Artificial Sequence: Synthetic coding sequence
atgaagatccccgtgctgcccgccgtggtgctgctgagcctgctggtgctgcacagcgcccagggcgccaccctgggcggccccgaggaggagagcaccatcgagaactacgccagcagacccgaggccttcaaggccgacgagttcctgaactggcacgccctgttcgagagcatcaagagaaagctgcccttcctgaactgggacgccttccccaagctgaagggcctgagaagcgccacccccgacgcccagtag

SEQ ID NO: 4828 - DNA, 348 bp, Artificial Sequence
  Description of Artificial Sequence: Synthetic coding sequence
atgggcagagtgttcctgaccggcgagaaggccaacagcatcctgaagagataccccagagccaacggcttcttcgaggagatcagacagggcaacatcgagagagagtgcaaggaggagttctgcaccttcgaggaggccagagaggccttcgagaacaacgagaagaccaaggagttctggagcacctacaccaaggcccagcagggcgagagcaacagaggcagcgactggttccagttctacctgaccttccccctgatcttcggcctgttcatcatcctgctggtgatcttcctgatctggagatgcttcctgagaaacaagaccagaagacagaccgtgtag

SEQ ID NO: 4829 - DNA, 606 bp, Artificial Sequence; identical to SEQ ID NO: 4157
  Description of Artificial Sequence: Synthetic coding sequence

SEQ ID NO: 4830 - DNA, 1311 bp, Artificial Sequence; identical to SEQ ID NO: 3956
  Description of Artificial Sequence: Synthetic coding sequence

SEQ ID NO: 4831 - DNA, 606 bp, Artificial Sequence
  Description of Artificial Sequence: Synthetic coding sequence
atgggcgccaccaccatggaccagaagagcctgtgggccggcgtggtggtgctgctgctgctgcagggcggcagcgcctacaagctggtgtgctacttcaccaactggagccaggacagacaggagcccggcaagttcacccccgagaacatcgaccccttcctgtgcagccacctgatctacagcttcgccagcatcgagaacaacaaggtgatcatcaaggacaagagcgaggtgatgctgtaccagaccatcaacagcctgaagaccaagaaccccaagctgaagatcctgctgagcatcggcggctacctgttcggcagcaagggcttccaccccatggtggacagcagcaccagcagactggagttcatcaacagcatcatcctgttcctgagaaaccacaacttcgacggcctggacgtgagctggatctaccccgaccagaaggagaacacccacttcaccgtgctgatccacgagctggccgaggccttccagaaggacttcaccaagagcaccaaggagagactgctgctgaccgccggcgtgagcgccggcagacagatgatcgacaacagctaccaggtggagaagctggcctag

SEQ ID NO: 4832 - DNA, 75 bp, Artificial Sequence; identical to SEQ ID NO: 4022
  Description of Artificial Sequence: Synthetic coding sequence

SEQ ID NO: 4833 - DNA, 252 bp, Artificial Sequence
  Description of Artificial Sequence: Synthetic coding sequence
atgagacccagaggcctgccccccctgctggtggtgctgctgggctgctgggccagcgtgagcgcccagaccgacgccacccccgccgtgaccaccgagggcctgaacagcaccgaggccgccctggccaccttcggcaccttccccagcaccagaccccccggcacccccagagcccccggccccagcagcggccccagacccacccccgtgaccgacggcagccacagcgtgacccaggccggcgtgtag

SEQ ID NO: 4834 - DNA, 1254 bp, Artificial Sequence; identical to SEQ ID NO: 3644
  Description of Artificial Sequence: Synthetic coding sequence

SEQ ID NO: 4835 - DNA, 1680 bp, Artificial Sequence; identical to SEQ ID NO: 3622
  Description of Artificial Sequence: Synthetic coding sequence

SEQ ID NO: 4836 - DNA, 99 bp, Artificial Sequence
  Description of Artificial Sequence: Synthetic coding sequence
atgcagggcacccccggcggcggcaccagacccggccccagccccgtggacagaagaaccctgctggtgttcagcttcatcctggccgccgccctgtag

SEQ ID NO: 4837 - DNA, 180 bp, Artificial Sequence
  Description of Artificial Sequence: Synthetic coding sequence
atgctggccctgctggtgctggtgaccgtggccctggccagcgcccaccacggcggcgagcacttcgagggcgagaaggtgttcagagtgaacgtggaggacgagaaccacatcaacatcatcagagagctggccagcaccacccagatcgacttctggaagcccgacagcgtgacctag

SEQ ID NO: 4838 - DNA, 303 bp, Artificial Sequence
  Description of Artificial Sequence: Synthetic coding sequence
atgagacccagaggcctgccccccctgctggtggtgctgctgggctgctgggccagcgtgagcgcccagaccgacgccacccccgccgtgaccaccgagggcctgaacagcaccgaggccgccctggccaccttcggcaccttccccagcaccagaccccccggcacccccagagcccccggccccagcagcggccccagacccacccccgtgaccgacggcggctaccacgtgcccgcccccggcgtgcacagcgaccccaccagcagaggccagcccagatgctgcagcctgtgcctgtag

SEQ ID NO: 4839 - DNA, 234 bp, Artificial Sequence
  Description of Artificial Sequence: Synthetic coding sequence
atgagaagccccagaatgagagtgtgcgccaagagcgtgctgctgagccactggctgttcctggcctacgtgctgatggtgtgctgcaagctgatgagcgccagcagccagcacctgagaggccacgccggccaccaccagatcaagcagggcacctgcgaggtggtggccgtgcacagatgctgcaacaagaacagaatcgaggagagaagccagaccgtgaagtgcagctag

SEQ ID NO: 4840 - DNA, 12 bp, Artificial Sequence
  Description of Artificial Sequence: Synthetic coding sequence
atgtggacctag

SEQ ID NO: 4841 - DNA, 402 bp, Artificial Sequence; identical to SEQ ID NO: 4823
  Description of Artificial Sequence: Synthetic coding sequence

SEQ ID NO: 4842 - DNA, 600 bp, Artificial Sequence
  Description of Artificial Sequence: Synthetic coding sequence
atgaccatgagacacaactggacccccgacctgagccccctgtgggtgctgctgctgtgcgcccacgtggtgaccctgctggtgagagccacccccgtgagccagaccaccaccgccgccaccgccagcgtgagaagcaccaaggacccctgccccagccagccccccgtgttccccgccgccaagcagtgccccgccctggaggtgacctggcccgaggtggaggtgcccctgaacggcaccctgagcctgagctgcgtggcctgcagcagattccccaacttcagcatcctgtactggctgggcaacggcagcttcatcgagcacctgcccggcagactgtgggagggcagcaccagcagagagagaggcagcaccggcacccagctgtgcaaggccctggtgctggagcagctgacccccgccctgcacagcaccaacttcagctgcgtgctggtggaccccgagcaggtggtgcagagacacgtggtgctggcccagctgtgggtgagaagccccagaagaggcctgcaggagcaggaggagctgtgcttccacatgtggggcggcaagggcggcctgtgccagagcagcctgtag

SEQ ID NO: 4843 - DNA, 1044 bp, Artificial Sequence
  Description of Artificial Sequence: Synthetic coding sequence
atgggcgtggtgcagtacggcgacaaccccgccacccacttcaacctgaagacccacaccaacagcagagacctgaagaccgccatcgagaagatcacccagagaggcggcctgagcaacgtgggcagagccatcagcttcgtgaccaagaacttcttcagcaaggccaacggcaacagaagcggcgcccccaacgtggtggtggtgatggtggacggctggcccaccgacaaggtggaggaggccagcagactggccagagagagcggcatcaacatcttcttcatcaccatcgagggcgccgccgagaacgagaagcagtacgtggtggagcccaacttcgccaacaaggccgtgtgcagaaccaacggcttctacagcctgcacgtgcagagctggttcggcctgcacaagaccctgcagcccctggtgaagagagtgtgcgacaccgacagactggcctgcagcaagacctgcctgaacagcgccgacatcggcttcgtgatcgacggcagcagcagcgtgggcaccggcaacttcagaaccgtgctgcagttcgtgaccaacctgaccaaggagttcgagatcagcgacaccgacaccagaatcggcgccgtgcagtacacctacgagcagagactggagttcggcttcgacaagtacagcagcaagcccgacatcctgaacgccatcaagagagtgggctactggagcggcggcaccagcaccggcgccgccatcaacttcgccctggagcagctgttcaagaagagcaagcccaacaagagaaagctgatgatcctgatcaccgacggcagaagctacgacgacgtgagaatccccgccatggccgcccacctgaagggcgtgatcacctacgccatcggcgtggcctgggccgcccaggaggagctggaggtgatcgccacccaccccgccagagaccacagcttcttcgtggacgagttcgacaacctgcaccagtacgtgcccagaatcatccagaacatctgcaccgagttcaacagccagcccagaaactag

SEQ ID NO: 4844 - DNA, 27 bp, Artificial Sequence
  Description of Artificial Sequence: Synthetic coding sequence
atgcagggcacccccggcggcggctag

SEQ ID NO: 4845 - DNA, 369 bp, Artificial Sequence
  Description of Artificial Sequence: Synthetic coding sequence
atgctgtaccagaccatcaacagcctgaagaccaagaaccccaagctgaagatcctgctgagcatcggcggctacctgttcggcagcaagggcttccaccccatggtggacagcagcaccagcagactggagttcatcaacagcatcatcctgttcctgagaaaccacaacttcgacggcctggacgtgagctggatctaccccgaccagaaggagaacacccacttcaccgtgctgatccacgagctggccgaggccttccagaaggacttcaccaagagcaccaaggagagactgctgctgaccgccggcgtgagcgccggcagacagatgatcgacaacagctaccaggtggagaagctggcctag

SEQ ID NO: 4846 - DNA, 309 bp, Artificial Sequence
  Description of Artificial Sequence: Synthetic coding sequence
atgagagtgagcggcgtgctgagactgctggccctgatcttcgccatcgtgaccacctggatgttcatcagaagctacatgagcttcagcatgaagaccatcagactgcccagatggctggccgccagccccaccaaggagatccaggtgaagaagtacaagtgcggcctgatcaagccctgccccgccaactacttcgccttcaagatctgcagcggcgccgccaacgtggtgggccccaccatgtgcttcgaggacagaatgatcatgagccccgtgaagaacaacgtgggcagaggcctgaactag

SEQ ID NO: 4847 - DNA, 660 bp, Artificial Sequence; identical to SEQ ID NO: 3923
  Description of Artificial Sequence: Synthetic coding sequence

SEQ ID NO: 4848 - DNA, 1869 bp, Artificial Sequence
  Description of Artificial Sequence: Synthetic coding sequence
atgggcaagagcgagggccccgtgggcatggtggagagcgccggcagagccggccagaagagacccggcttcctggagggcggcctgctgctgctgctgctgctggtgaccgccgccctggtggccctgggcgtgctgtacgccgacagaagaggcaagcagctgcccagactggccagcagactgtgcttcctgcaggaggagagaaccttcgtgaagagaaagcccagaggcatccccgaggcccaggaggtgagcgaggtgtgcaccacccccggctgcgtgatcgccgccgccagaatcctgcagaacatggaccccaccaccgagccctgcgacgacttctaccagttcgcctgcggcggctggctgagaagacacgtgatccccgagaccaacagcagatacagcatcttcgacgtgctgagagacgagctggaggtgatcctgaaggccgtgctggagaacagcaccgccaaggccaccgtgccccaggaggagagacacgacgtgatcgccctgtaccacagaatgggcctggaggagctgcagagccagttcggcctgaagggcttcaactggaccctgttcatccagaccgtgctgagcagcgtgaagatcaagctgctgcccgacgaggaggtggtggtgtacggcatcccctacctgcagaacctggagaacatcatcgacacctacagcgccagaaccatccagaactacctggtgtggagactggtgctggacagaatcggcagcctgagccagagattcaaggacaccagagtgaactacagaaaggccctgttcggcaccatggtggaggaggtgagatggagagagtgcgtgggctacgtgaacagcaacatggagaacgccgtgggcagcctgtacgtgagagaggccttccccggcgacagcaagagcatggtgagagagctgatcgacaaggtgagaaccgtgttcgtggagaccctggacgagctgggctggatggacgaggagagcaagaagaaggcccaggagaaggccatgagcatcagagagcagatcggccaccccgactacatcctggaggagatgaacagaagactggacgaggagtacagcaacctgaacttcagcgaggacctgtacttcgagaacagcctgcagaacctgaaggtgggcgcccagagaagcctgagaaagctgagagagaaggtggaccccaacctgtggatcatcggcgccgccgtggtgaacgccttctacagccccaacagaaaccagatcgtgttccccgccggcatcctgcagccccccttcttcagcaaggagcagccccaggccctgaacttcggcggcatcggcatggtgatcggccacgagatcacccacggcttcgacgacaacggcagaaacttcgacaagaacggcaacatgatggactggtggagcaacttcagcacccagcacttcagagagcagagcgagtgcatgatctaccagtacggcaactacagctgggacctggccgacgagcagaacgtgaacggcttcaacaccctgggcgagaacatcgccgacaacggcggcgtgagacaggcctacaaggcctacctgaagtggatggccgagggcggcaaggaccagcagctgcccggcctggacctgacccacgagcagctgttcttcatcaactacgcccaggtgtggtgcggcagctacagacccgagttcgccatccagagcatcaagaccgacgtgcacagccccctgaagtacagagtgctgggcagcctgcagaacctggccgccttcgccgacaccttccactgcgccagaggcacccccatgcaccccaaggagagatgcagagtgtggtag

SEQ ID NO: 4849 - DNA, 168 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgactag

SEQ ID NO: 4850 - DNA, 156 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagctag

SEQ ID NO: 4851 - DNA, 1620 bp, Artificial Sequence; identical to SEQ ID NO: 4653
  Description of Artificial Sequence: Synthetic coding sequence

SEQ ID NO: 4852 - DNA, 591 bp, Artificial Sequence
  Description of Artificial Sequence: Synthetic coding sequence
atgccccacctggccagcctgttcaccgccagcagcagatgctgcccccaccccctgagacccgagggcagcggcgccatgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagcctag

SEQ ID NO: 4853 - DNA, 162 bp, Artificial Sequence
  Description of Artificial Sequence: Synthetic coding sequence
atgctgccctgcctggccctgctgctgctgatggagctgagcgtgtgcaccgtggccggcgacggcggcgaggagcagaccctgagcaccgaggccgagacctgggtgatcgtggccctggaggtgctgctgggcagaggcagcgacgagggcagaggctag

SEQ ID NO: 4854 - DNA, 126 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaacctag

SEQ ID NO: 4855 - DNA, 222 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtag

SEQ ID NO: 4856 - DNA, 369 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatactag

SEQ ID NO: 4857 - DNA, 483 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtgtag

SEQ ID NO: 4858 - DNA, 540 bp, Artificial Sequence
  Description of Artificial Sequence: Synthetic coding sequence
atgggcagcagcggcctgctgagcctgctggtgctgttcgtgctgctggccaacgtgcagggccccggcctgaccgactggctgttccccagaagatgccccaagatcagagaggagtgcgagttccaggagagagacgtgtgcaccaaggacagacagtgccaggacaacaagaagtgctgcgtgttcagctgcggcaagaagtgcctggacctgaagcaggacgtgtgcgagatgcccaaggagaccggcccctgcctggcctacttcctgcactggtggtacgacaagaaggacaacacctgcagcatgttcgtgtacggcggctgccagggcaacaacaacaacttccagagcaaggccaactgcctgaacacctgcaagaacaagcagccctgccccaagatcaaggtggagtgcgaggtggaggagatcgaccagtgcaccaagcccagagactgccccgagaacatgaagtgctgccccttcagcagaggcaagaagtgcctggacttcagaaaggccagcctgagcacctag

SEQ ID NO: 4859 - DNA, 438 bp, Artificial Sequence
  Description of Artificial Sequence: Synthetic coding sequence
atgctgttcagaaacagattcctgctgctgctggccctggccgccctgctggccttcgtgagcctgagcctgcagttcttccacctgatccccgtgagcacccccaagaacggcatgagcagcaagagcagaaagagaatcatgcccgaccccgtgaccgagccccccgtgaccgaccccgtgtacgaggccctgctgtactgcaacatccccagcgtggccgagagaagcatggagggccacgccccccaccacttcaagctggtgagcgtgcacgtgttcatcagacacggcgacagataccccctgtacgtgatccccaagaccaagagacccgagatcgactgcaccctggtggccaacagaaagccctaccaccccaagctggaggccttcatcagccacatgagcaagggcagcggcgccagcttcgagtag

SEQ ID NO: 4860 - DNA, 399 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggtag

SEQ ID NO: 4861 - DNA, 306 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggctag

SEQ ID NO: 4862 - DNA, 393 bp, Artificial Sequence; identical to SEQ ID NO: 3753
  Description of Artificial Sequence: Synthetic coding sequence

SEQ ID NO: 4863 - DNA, 420 bp, Artificial Sequence
  Description of Artificial Sequence: Synthetic coding sequence
atgcccgccatcgccgtgctggccgccgccgccgccgcctggtgcttcctgcaggtggagagcagacacctggacgccctggccggcggcgccggccccaaccacggcaacttcctggacaacgaccagtggctgagcaccgtgagccagtacgacagagacaagtactggaacagattcagagacgacgactacttcagaaactggaaccccaacaagcccttcgaccaggccctggaccccagcaaggacccctgcctgaaggtgaagtgcagcccccacaaggtgtgcgtgacccaggactaccagaccgccctgtgcgtgagcagaaagcacctgctgcccagacagaagaagggcaacgtggcccagaagcactgggtgggccccagcaacctggtgaagtgcaagccctgctag

SEQ ID NO: 4864 - DNA, 510 bp, Artificial Sequence
  Description of Artificial Sequence: Synthetic coding sequence
atgagactgctgatcctgacctgcctggtggccgtggccctggccagacccaagctgcccctgagataccccgagagactgcagaaccccagcgagagcagcgagcccatccccctggagagcagagaggagtacatgaacggcatgaacagacagagaaacatcctgagagagaagcagaccgacgagatcaagaactgcgtggtggccgagcccgagaagatggagagcagcatcagcagcagcagcgaggagcagttctgcagactgaacgagtacaaccagctgcagctgcaggccgcccacgcccaggagcagatcagaagaatgaacgagaacagccacgtgcaggtgcccttccagcagctgaaccagctggccgcctacccctacgccgtgtggtactacccccagatcatgcagtacgtgcccttcccccccttcagcgacatcagcaaccccaccgcccacgagaactacgagaagaacaacgtgatgctgcagtggtag

SEQ ID NO: 4865 - DNA, 921 bp, Artificial Sequence
  Description of Artificial Sequence: Synthetic coding sequence
atgaagaaggacgagccccccctggacttccccgacaccctggagggcttcgagtacgccttcaacgagaagggccagctgagacacatcaagaccggcgagcccttcgtgttcaactacagagaggacctgcacagatggaaccagaagagatacgaggccctgggcgagatcatcaccaagtacgtgtacgagctgctggagaaggactgcaacctgaagaaggtgagcatccccgagggctacggcgtgatcgtgctgaaccccaacgagaactacatcgaggtggagaagcccaagatccacgtgcagagcagcagcgacagcagcgacgagcccgccgagaagagagagagaaaggacaaggtgagcaaggagaccaagaagagaagagacttctacgagaagtacagaaacccccagagagagaaggagatgatgcagctgtacatcagagagaacggcagccccgaggagcacgccatctacgtgtgggaccacttcatcgcccaggccgccgccgagaacgtgttcttcgtggcccacagctacggcggcctggccttcgtggagctgatgatccagagagaggccgacgtgaagaacaaggtgaccgccgtggccctgaccgacagcgtgcacaacgtgtggcaccaggaggccggcaagaccatcagagagtggatgagagagaactgctgcaactgggtgagcagcagcgagcccctggacaccagcgtggagagcatgctgcccgactgccccagagtgagcgccggcaccgacagacacgagctgaccagctggaagagcttccccagcatcttcaagttcttcaccgaggccagcgaggccaagaccagcagcctgaagcccgccgtgaccagaagaagccacagaatcaagcacgaggagctgtag

SEQ ID NO: 4866 - DNA, 2862 bp, Artificial Sequence
  Description of Artificial Sequence: Synthetic coding sequence
tgacagctgtgctggctgcccctgctggcccccctgctgctgctgagaccccccggcgtgcagagcgccggccccatcagagccttcgtggtgccccacagccacatggacgtgggctgggtgtacaccgtgcaggagagcatgagagcctacgccgccaacgtgtacaccagcgtggtggaggagctggccagaggccagcagagaagattcatcgccgtggagcaggagttcttcagactgtggtgggacggcgtggccagcgaccagcagaagtaccaggtgagacagctgctggaggagggcagactggagttcgtgatcggcggccaggtgatgcacgacgaggccgtgacccacctggacgaccagatcctgcagctgaccgagggccacggcttcctgtacgagaccttcggcatcagaccccagttcagctggcacgtggaccccttcggcgccagcgccaccacccccaccctgttcgccctggccggcttcaacgcccacctgggcagcagaatcgactacgacctgaaggccgccatgcaggaggccagaggcctgcagttcgtgtggagaggcagccccagcctgagcgagagacaggagatcttcacccacatcatggaccagtacagctactgcacccccagccacatccccttcagcaacagaagcggcttctactggaacggcgtggccgtgttccccaagcccccccaggacggcgtgtaccccaacatgagcgagcccgtgacccccgccaacatcaacctgtacgccgaggccctggtggccaacgtgaagcagagagccgcctggttcagaaccccccacgtgctgtggccctggggctgcgacaagcagttcttcaacgccagcgtgcagttcgccaacatggaccccctgctggaccacatcaacagccacgccgccgagctgggcgtgagcgtgcagtacgccaccctgggcgactacttcagagccctgcacgccctgaacgtgacctggagagtgagagaccaccacgacttcctgccctacagcaccgagcccttccaggcctggaccggcttctacaccagcagaagcagcctgaagggcctggccagaagagccagcgccctgctgtacgccggcgagagcatgttcaccagatacctgtggcccgcccccagaggccacctggaccccacctgggccctgcagcagctgcagcagctgagatgggccgtgagcgaggtgcagcaccacgacgccatcaccggcaccgagagccccaaggtgagagacatgtacgccacccacctggccagcggcatgctgggcatgagaaagctgatggccagcatcgtgctggacgagctgcagccccaggcccccatggccgccagcagcgacgccggccccgccggccacttcgccagcgtgtacaaccccctggcctggaccgtgaccaccatcgtgaccctgaccgtgggcttccccggcgtgagagtgaccgacgaggccggccaccccgtgcccagccagatccagaacagcaccgagacccccagcgcctacgacctgctgatcctgaccaccatccccggcctgagctacagacactacaacatcagacccaccgccggcgcccaggagggcacccaggagcccgccgccaccgtggccagcaccctgcagttcggcagaagactgagaagaagaaccagccacgccggcagatacctggtgcccgtggccaacgactgctacatcgtgctgctggaccaggacaccaacctgatgcacagcatctgggagagacagagcaacagaaccgtgagagtgacccaggagttcctggagtaccacgtgaacggcgacgtgaagcagggccccatcagcgacaactacctgttcacccccggcaaggccgccgtgcccgcctgggaggccgtggagatggagatcgtggccggccagctggtgaccgagatcagacagtacttctacagaaacatgaccgcccagaactacacctacgccatcagaagcagactgacccacgtgccccagggccacgacggcgagctgctgtgccacagaatcgagcaggagtaccaggccggccccctggagctgaacagagaggccgtgctgagaaccagcaccaacctgaacagccagcaggtgatctacagcgacaacaacggctaccagatgcagagaagaccctacgtgagctacgtgaacaacagcatcgccagaaactactaccccatggtgcagagcgccttcatggaggacggcaagagcagactggtgctgctgagcgagagagcccacggcatcagcagccagggcaacggccaggtggaggtgatgctgcacagaagactgtggaacaacttcgactgggacctgggctacaacctgaccctgaacgacaccagcgtggtgcaccccgtgctgtggctgctgctgggcagctggagcctgaccaccgccctgagacagagaagcgccctggccctgcagcacagacccgtggtgctgttcggcgacctggccggcaccgcccccaagctgcccggcccccagcagcaggaggccgtgaccctgccccccaacctgcacctgcagatcctgagcatccccggctggagatacagcagcaaccacaccgagcacagccagaacctgagaaagggccacagaggcgaggcccaggccgacctgagaagagtgctgctgagactgtaccacctgtacgaggtgggcgaggaccccgtgctgagccagcccgtgaccgtgaacctggaggtgaacttccccacccccatccagaccatcagccagggcagcaagccctag

SEQ ID NO: 4867 - DNA, 459 bp, Artificial Sequence; identical to SEQ ID NO: 4367
  Description of Artificial Sequence: Synthetic coding sequence

SEQ ID NO: 4868 - DNA, 1701 bp, Artificial Sequence
  Description of Artificial Sequence: Synthetic coding sequence
atggacttcctgctggccctggtgctggtgagcagcctgtacctgcaggccgccgccgagttcgacggcagatggcccagacagatcgtgagcagcatcggcctgtgcagatacggcggcagaatcgactgctgctggggctgggccagacagagctggggccagtgccagcccgtgtgccagcccagatgcaagcacggcgagtgcatcggccccaacaagtgcaagtgccaccccggctacgccggcaagacctgcaaccaggacgagcacatccccgcccccctggaccagggcagcgagcagcccctgttccagcccctggaccaccaggccaccagcctgcccagcagagacctgaacgagtgcggcctgaagcccagaccctgcaagcacagatgcatgaacacctacggcagctacaagtgctactgcctgaacggctacatgctgatgcccgacggcagctgcagcagcgccctgacctgcagcatggccaactgccagtacggctgcgacgtggtgaagggccagatcagatgccagtgccccagccccggcctgcagctggcccccgacggcagaacctgcgtggacgtggacgagtgcgccaccggcagagccagctgccccagattcagacagtgcgtgaacaccttcggcagctacatctgcaagtgccacaagggcttcgacctgatgtacatcggcggcaagtaccagtgccacgacatcgacgagtgcagcctgggccagtaccagtgcagcagcttcgccagatgctacaacatcagaggcagctacaagtgcaagtgcaaggagggctaccagggcgacggcctgacctgcgtgtacatccccaaggtgatgatcgagcccagcggccccatccacgtgcccaagggcaacggcaccatcctgaagggcgacaccggcaacaacaactggatccccgacgtgggcagcacctggtggccccccaagaccccctacatcccccccatcatcaccaacagacccaccagcaagcccaccaccagacccacccccaagcccacccccatccccaccccccccccccccccccccctgcccaccgagctgagaacccccctgccccccaccacccccgagagacccaccaccggcctgaccaccatcgcccccgccgccagcaccccccccggcggcatcaccgtggacaacagagtgcagaccgacccccagaagcccagaggcgacgtgttcagcgtgctggtgcacagctgcaacttcgaccacggcctgtgcggctggatcagagagaaggacaacgacctgcactgggagcccatcagagaccccgccggcggccagtacctgaccgtgagcgccgccaaggcccccggcggcaaggccgccagactggtgctgcccctgggcagactgatgcacagcggcgacctgtgcctgagcttcagacacaaggtgaccggcctgcacagcggcaccctgcaggtgttcgtgagaaagcacggcgcccacggcgccgccctgtggggcagaaacggcggccacggctggagacagacccagatcaccctgagaggcgccgacatcaagagcgtggtgttcaagggcgagaagagaagaggccacaccggcgagatcggcctggacgacgtgagcctgaagaagggccactgcagcgaggagagatag

SEQ ID NO: 4869 - DNA, 213 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgactag

SEQ ID NO: 4870 - DNA, 237 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagctag

SEQ ID NO: 4871 - DNA, 339 bp, Artificial Sequence
  Description of Artificial Sequence: Synthetic coding sequence
atgagattcaagaccaccgccaaggacggcctgctgctgtggagaggcgacagccccatgagacccaacagcgacttcatcagcctgggcctgagagacggcgccctggtgttcagctacaacctgggcagcggcgtggccagcatcatggtgaacggcagcttcaacgacggcagatggcacagagtgaaggccgtgagagacggccagagcggcaagatcaccgtggacgactacggcgccagaaccggcaagagccccggcatgatgagacagctgaacatcaacggcgccctgtacgtgggcggcatgaaggagatcgccctgcacaccaactag

SEQ ID NO: 4872 - DNA, 2685 bp, Artificial Sequence
  Description of Artificial Sequence: Synthetic coding sequence
atgagcctgcccagatgctgcccccaccccctgagacccgagggcagcggcgccatgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtacctgaacgacagcacctacgacggccacaccgtgggcggcctgcagtacggcggcctgggccagctggccgacggcgtggtgggcctggacgacttcagaaagagccaggagctgagagtgtggcccggctacgactacgtgggctggagcaaccacagcttcagcagcggctacgtggagatggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggccgagagaagagtgctggaggaggagctgaccgtgcacctgagcgtgcccggcgacaccatcctgatcaacaacagacccggccccagagagccccccccctaccaggagcccagacccagaggcaaccccccccacagcgccccctgcgtgcccaacggcagcgcctacagcggcgactacatggagcccgagaagcccggcgcccccctgctgcccccccccccccagaacagcgtgccccactacgccgaggccgacatcgtgaccctgcagggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaacttcgtgcacagagacctggccaccagaaactgcctggtgggcgagaacttcaccatcaagatcgccgacttcggcatgagcagaaacctgtacgccggcgactactacagagtgcagggcagagccgtgctgcccatcagatggatggcctgggagtgcatcctgatgggcaagttcaccaccgccagcgacgtgtgggccttcggcgtgaccctgtgggaggtgctgatgctgtgcagagcccagcccttcggccagctgaccgacgagcaggtgatcgagaacgccggcgagttcttcagagaccagggcagacaggtgtacctgagcagaccccccgcctgcccccagggcctgtacgagctgatgctgagatgctggagcagagagagcgagcagagaccccccttcagccagctgcacagattcctggccgaggacgccctgaacaccgtgtag

SEQ ID NO: 4873 - DNA, 384 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagatag

SEQ ID NO: 4874 - DNA, 1113 bp, Artificial Sequence
  Description of Artificial Sequence: Synthetic coding sequence
atgaagaaggacgagccccccctggacttccccgacaccctggagggcttcgagtacgccttcaacgagaagggccagctgagacacatcaagaccggcgagcccttcgtgttcaactacagagaggacctgcacagatggaaccagaagagatacgaggccctgggcgagatcatcaccaagtacgtgtacgagctgctggagaaggactgcaacctgaagaaggtgagcatccccgtggacgccaccgagagcgagcccaagagcttcatcttcatgagcgaggacgccctgaccaacccccagaagctgatggtgctgatccacggcagcggcgtggtgagagccggccagtgggccagaagactgatcatcaacgaggacctggacagcggcacccagatccccttcatcaagagagccgtggccgagggctacggcgtgatcgtgctgaaccccaacgagaactacatcgaggtggagaagcccaagatccacgtgcagagcagcagcgacagcagcgacgagcccgccgagaagagagagagaaaggacaaggtgagcaaggagaccaagaagagaagagacttctacgagaagtacagaaacccccagagagagaaggagatgatgcagctgtacatcagagagaacggcagccccgaggagcacgccatctacgtgtgggaccacttcatcgcccaggccgccgccgagaacgtgttcttcgtggcccacagctacggcggcctggccttcgtggagctgatgatccagagagaggccgacgtgaagaacaaggtgaccgccgtggccctgaccgacagcgtgcacaacgtgtggcaccaggaggccggcaagaccatcagagagtggatgagagagaactgctgcaactgggtgagcagcagcgagcccctggacaccagcgtggagagcatgctgcccgactgccccagagtgagcgccggcaccgacagacacgagctgaccagctggaagagcttccccagcatcttcaagttcttcaccgaggccagcgaggccaagaccagcagcctgaagcccgccgtgaccagaagaagccacagaatcaagcacgaggagctgtag

SEQ ID NO: 4875 - DNA, 435 bp, Artificial Sequence
  Description of Artificial Sequence: Synthetic coding sequence
atgaagaccggcctgttcttcctgtgcctgctgggcaccgccgccgccatccccaccaacgccagactgctgagcgaccacagcaagcccaccgccgagaccgtggcccccgacaacaccgccatccccagcctgagagccgaggccgaggagaacgagaaggagaccgccgtgagcaccgaggacgacagccaccacaaggccgagaagagcagcgtgctgaagagcaaggaggagagccacgagcagagcgccgagcagggcaagagcagcagccaggagctgggcctgaaggaccaggaggacagcgacggccacctgagcgtgaacctggagtacgcccccaccgagggcaccctggacatcaaggaggacatgagcgagccccaggagaagaagctgagcgagaacaccgacttcctggcccccggctag

SEQ ID NO: 4876 - DNA, 1341 bp, Artificial Sequence
  Description of Artificial Sequence: Synthetic coding sequence
ctgaccctgcacagcctgacctgctacgaggacctggtgaccttcctgcagcagagcatccaccagttcgaggtgggcccctacggctgcatcctgctgaccctgagcgccatcctgagcagaagcaccgagctgatcagacaggacttcgacgtgcccaccagccacctgatcggcgcccacggctactgcacccaggagctggtgaacctgctgctgaccggcaaggccgtgagcaacgtgttcaacgacgtggtggagctggacagcggcgacggcaacatcaccctgctgagaggcatcgccgccagaagcgacatcggcttcctgagcctgttcgagcactacaacatgtgccaggtgggctgcttcctgaagacccccagattccccatctgggtggtgtgcagcgagagccacttcagcatcctgttcagcctgcagcccggcctgctgagagactggagaaccgagagactgttcgacctgtactactacgacggcctggccaaccagcaggagcagatcagactgaccatcgacaccacccagaccatcagcgaggacaccgacaacgacctggtgccccccctggagctgtgcatcagaaccaacatcggcagcgccctgggcttcaagtaccccgtgggcaacaaccagaccgccgtgcaggacaacgtgaaggtgagcctggccttcggcctgagcatcgccaccctggcccagagcgtgggccacatcagcggcgcccacctgaaccccgccgtgaccctgggcctgctgctgagctgccagatcagcatcttcagagccctgatgtacatcatcgcccagtgcgtgggcgccatcgtggccaccgccatcctgagcggcatcaccagcagcctgaccggcaacagcctgggcagaaacgacctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagagtggagatgaagcccaagtag

SEQ ID NO: 4877 - DNA, 81 bp, Artificial Sequence
  Description of Artificial Sequence: Synthetic coding sequence
atgaagctgctgctgtgggcctgcatcgtgtgcgtggccttcgccagaaagaacgccggcctgggcttcctgtggctgtag

SEQ ID NO: 4878 - DNA, 348 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagctag

SEQ ID NO: 4879 - DNA, 165 bp, Artificial Sequence
  Description of Artificial Sequence: Synthetic coding sequence
atgtacatccccctggaccccgactacaacgccgactgccccaacgtgaccgcccccgtgtgcgccagcaacggccacaccttccagaacgagtgcttcttctgcgtggagcagagagagttccactacagaatcaagttcgagaagtacggcaagtgcgactag

SEQ ID NO: 4880 - DNA, 351 bp, Artificial Sequence
  Description of Artificial Sequence: Synthetic coding sequence
atggtgctgctgcactggtgcctgctgtggctgctgttccccctgagcagcagaacccagaagctgcccaccagagacgaggagctgttccagatgcagatcagagacaaggccttcttccacgacagcagcgtgatccccgacggcgccgagatcagcagctacctgttcagagacacccccaagagatacttcttcgtggtggaggaggacaacacccccctgagcgtgaccgtgaccccctgcgacgcccccctggagtggaagctgagcctgcaggagctgcccgaggacagaagcggcgagggcagcggcgacctggagcccctggagcagcagaagcagcagtag

SEQ ID NO: 4881 - DNA, 432 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggctag

SEQ ID NO: 4882 - DNA, 747 bp, Artificial Sequence
  Description of Artificial Sequence: Synthetic coding sequence
atggagctgctgcaggtgaccatcctgttcctgctgcccagcatctgcagcagcaacagcaccggcgtgctggaggccgccaacaacagcctggtggtgaccaccaccaagcccagcatcaccacccccaacaccgagagcctgcagaagaacgtggtgacccccaccaccggcaccacccccaagggcaccatcaccaacgagctgctgaagatgagcctgatgagcaccgccaccttcctgaccagcaaggacgagggcctgaaggccaccaccaccgacgtgagaaagaacgacagcatcatcagcaacgtgaccgtgaccagcgtgaccctgcccaacgccgtgagcaccctgcagagcagcaagcccaagagcagcgtgctgcagcccgacgccagccccagcaagaccggcaccctgaccagcatccccgtgaccatccccgagaacaccagccagagccaggtgatcggcaccgagggcggcaagaacgccagcaccagcgccaccagcagaagctacagcagcatcatcctgcccgtggtgatcgccctgatcgtgatcaccctgagcgtgttcgtgctggtgggcctgtacagaatgtgctggaaggccgaccccggcacccccgagaacggcaacgaccagccccagagcgacaaggagagcgtgaagctgctgaccgtgaagaccatcagccacgagagcggcgagcacagcgcccagggcaagaccaagaactag

SEQ ID NO: 4883 - DNA, 363 bp, Artificial Sequence
  Description of Artificial Sequence: Synthetic coding sequence
atgaagaccggcctgttcttcctgtgcctgctgggcaccgccgccgccatccccaccaacgccagactgctgagcgaccacagcaagcccaccgccgagaccgtggcccccgacaacaccgccatccccagcctgagagccgaggccgaggagaacgagaaggagaccgccgtgagcaccgaggacgacagccaccacaaggccgagaagagcagcgtgctgaagagcaaggaggagagccacgagcagagcgccgagcagggcaagagcagcagccaggagctgggcctgaaggaccaggaggacagcgacggccacctgagcgtgaacctggagtacgcccccaccgagggcaccctgtag

SEQ ID NO: 4884 - DNA, 339 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaagtag

SEQ ID NO: 4885 - DNA, 513 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagcctag

SEQ ID NO: 4886 - DNA, 417 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccagtag

SEQ ID NO: 4887 - DNA, 285 bp, Artificial Sequence; identical to SEQ ID NO: 4394
  Description of Artificial Sequence: Synthetic coding sequence

SEQ ID NO: 4888 - DNA, 156 bp, Artificial Sequence; identical to SEQ ID NO: 4850
  Description of Artificial Sequence: Synthetic coding sequence

SEQ ID NO: 4889 - DNA, 2760 bp, Artificial Sequence; identical to SEQ ID NO: 4172
  Description of Artificial Sequence: Synthetic coding sequence

SEQ ID NO: 4890 - DNA, 318 bp, Artificial Sequence
  Description of Artificial Sequence: Synthetic coding sequence
atgggcgtgagcaagctggacatcctgtacagaagactgctgctgaccaagctgttcatcagaggctggggcagacccgaggacctgaagagactgttcgagttcagaaagatgatcggcaacagagagagatgccagaacctggtgagcagcgactaccccgtgcacatcgacaagatcgaggagcagagcgactgcaagatcctggacggccacttcgtgagccccatggcccactacgtgcccgacatcatgcccatcgagagcgtgatcgccagattccagttcatcgtgcccaaggagtggaacagcaagtag

SEQ ID NO: 4891 - DNA, 126 bp, Artificial Sequence
  Description of Artificial Sequence: Synthetic coding sequence
atgaagctgagcggcatgttcctgctgctgagcctggccctgttctgcttcctgaccggcgtgttcagccagggcggccaggtggactgcggcgagttccaggaccccaaggtgtactgcacctag

SEQ ID NO: 4892 - DNA, 459 bp, Artificial Sequence; identical to SEQ ID NO: 4367
  Description of Artificial Sequence: Synthetic coding sequence

SEQ ID NO: 4893 - DNA, 1611 bp, Artificial Sequence
  Description of Artificial Sequence: Synthetic coding sequence
atggacttcctgctggccctggtgctggtgagcagcctgtacctgcaggccgccgccgagttcgacggcagatggcccagacagatcgtgagcagcatcggcctgtgcagatacggcggcagaatcgactgctgctggggctgggccagacagagctggggccagtgccagcccgtgtgccagcccagatgcaagcacggcgagtgcatcggccccaacaagtgcaagtgccaccccggctacgccggcaagacctgcaaccaggacctgaacgagtgcggcctgaagcccagaccctgcaagcacagatgcatgaacacctacggcagctacaagtgctactgcctgaacggctacatgctgatgcccgacggcagctgcagcagcgccctgacctgcagcatggccaactgccagtacggctgcgacgtggtgaagggccagatcagatgccagtgccccagccccggcctgcagctggcccccgacggcagaacctgcgtggacgtggacgagtgcgccaccggcagagccagctgccccagattcagacagtgcgtgaacaccttcggcagctacatctgcaagtgccacaagggcttcgacctgatgtacatcggcggcaagtaccagtgccacgacatcgacgagtgcagcctgggccagtaccagtgcagcagcttcgccagatgctacaacatcagaggcagctacaagtgcaagtgcaaggagggctaccagggcgacggcctgacctgcgtgtacatccccaaggtgatgatcgagcccagcggccccatccacgtgcccaagggcaacggcaccatcctgaagggcgacaccggcaacaacaactggatccccgacgtgggcagcacctggtggccccccaagaccccctacatcccccccatcatcaccaacagacccaccagcaagcccaccaccagacccacccccaagcccacccccatccccaccccccccccccccccccccctgcccaccgagctgagaacccccctgccccccaccacccccgagagacccaccaccggcctgaccaccatcgcccccgccgccagcaccccccccggcggcatcaccgtggacaacagagtgcagaccgacccccagaagcccagaggcgacgtgttcagcgtgctggtgcacagctgcaacttcgaccacggcctgtgcggctggatcagagagaaggacaacgacctgcactgggagcccatcagagaccccgccggcggccagtacctgaccgtgagcgccgccaaggcccccggcggcaaggccgccagactggtgctgcccctgggcagactgatgcacagcggcgacctgtgcctgagcttcagacacaaggtgaccggcctgcacagcggcaccctgcaggtgttcgtgagaaagcacggcgcccacggcgccgccctgtggggcagaaacggcggccacggctggagacagacccagatcaccctgagaggcgccgacatcaagagcgtggtgttcaagggcgagaagagaagaggccacaccggcgagatcggcctggacgacgtgagcctgaagaagggccactgcagcgaggagagatag

SEQ ID NO: 4894 - DNA, 288 bp, Artificial Sequence
  Description of Artificial Sequence: Synthetic coding sequence
atgctgttcagaaacagattcctgctgctgctggccctggccgccctgctggccttcgtgagcctgagcctgcagttcttccacctgatccccgtgagcacccccaagaacggcatgagcagcaagagcagaaagagaatcatgcccgaccccgtgaccgagccccccgtgaccgaccccgtgtacgaggccctgctgtactgcaacatccccagcgtggccgagagaagcatggagggccacgccccccaccacttcaagctggtgagcgtgcacgtgttcatctag

SEQ ID NO: 4895 - DNA, 213 bp, Artificial Sequence
  Description of Artificial Sequence: Synthetic coding sequence
atggccagcgacctgatcagaaccatcctggccgtggccctgatcagcaagctgggcaccgccgtggacgccgagctgatgcccagcggcgccatcctgcagaacaagagagagaacctgcccagagtgtgccacgccctggccttcctgggcatggccagatgccaggacctgttcctggtgagactgcagggctggaagctgggcacctag

SEQ ID NO: 4896 - DNA, 417 bp, Artificial Sequence; identical to SEQ ID NO: 4886
  Description of Artificial Sequence: Synthetic coding sequence

SEQ ID NO: 4897 - DNA, 219 bp, Artificial Sequence
  Description of Artificial Sequence: Synthetic coding sequence
atggccgtgagcgtgctgagactgaccgtggtgctgggcctgctggtgctgttcctgacctgctacgccgacgacaagcccgacaagcccgacgacaagcccgacgacagcggcaaggaccccaagcccgacttccccaagttcctgagcctgctgggcaccgagatcatcgagaacgccgtggagttcatcctgagaagcatgagcagaagcacctag

SEQ ID NO: 4898 - DNA, 438 bp, Artificial Sequence
  Description of Artificial Sequence: Synthetic coding sequence
atggtgctgctgcactggtgcctgctgtggctgctgttccccctgagcagcagaacccagaagctgcccaccagagacgaggagctgttccagatgcagatcagagacaaggccttcttccacgacagcagcgtgatccccgacggcgccgagatcagcagctacctgttcagagacacccccaagagatacttcttcgtggtggaggaggacaacacccccctgagcgtgaccgtgaccccctgcgacgcccccctggagtggaagctgagcctgcaggagctgcccgaggacagaagcggcgagggcagcggcgacctggagcccctggagcagcagaagcagcagatcatcaacgaggagggcaccgagctgttcagctacaagggcaacgacgtggagtacttcatcagcagcagcagccccagcggcctgtag

SEQ ID NO: 4899 - DNA, 258 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtag

SEQ ID NO: 4900 - DNA, 1410 bp, Artificial Sequence
  Description of Artificial Sequence: Synthetic coding sequence
atgctgaaggtgcactaccccaagttcggcgtgagcgaggactgcctgtacctgaacatctacgcccccgcccacgccgacaccggcagcaagctgcccgtgctggtgtggttccccggcggcgccttcaagaccggcagcgccagcatcttcgacggcagcgccctggccgcctacgaggacgtgctggtggtggtggtgcagtacagactgggcatcttcggcttcttcaccacctgggaccagcacgcccccggcaactgggccttcaaggaccaggtggccgccctgagctgggtgcagaagaacatcgagttcttcggcggcgaccccagcagcgtgaccatcttcggcgagagcgccggcgccatcagcgtgagcagcctgatcctgagccccatggccaagggcctgttccacaaggccatcatggagagcggcgtggccatcatcccctacctggaggcccacgactacgagaagagcgaggacctgcaggtggtggcccacttctgcggcaacaacgccagcgacagcgaggccctgctgagatgcctgagaaccaagcccagcaaggagctgctgaccctgagccagaagaccaagagcttcaccagagtggtggacggcgccttcttccccaacgagcccctggacctgctgagccagaaggccttcaaggccatccccagcatcatcggcgtgaacaaccacgagtgcggcttcctgctgcccatgaaggaggcccccgagatcctgagcggcagcaacaagagcctggccctgcacctgatccagaacatcctgcacatccccccccagtacctgcacctggtggccaacgagtacttccacgacaagcacagcctgaccgagatcagagacagcctgctggacctgctgggcgacgtgttcttcgtggtgcccgccctgatcaccgccagataccacagagacgccggcgcccccgtgtacttctacgagttcagacacagaccccagtgcttcgaggacaccaagcccgccttcgtgaaggccgaccacgccgacgaggtgagattcgtgttcggcggcgccttcctgaagggcgacatcgtgatgttcgagggcgccaccgaggaggagaagctgctgagcagaaagatgatgaagtactgggccaccttcgccagaaccggcaaccccaacggcaacgacctgagcctgtggcccgcctacaacctgaccgagcagtacctgcagctggacctgaacatgagcctgggccagagactgaaggagcccagagtggacttctggaccagcaccatccccctgatcctgagcgccagcgacatgctgcacagccccctgagcagcctgaccttcctgagcctgctgcagcccttcttcttcttctgcgccccctag

SEQ ID NO: 4901 - DNA, 393 bp, Artificial Sequence
  Description of Artificial Sequence: Synthetic coding sequence
atgctgcccttcctgttcttcagcaccctgttcagcagcatcttcaccgaggcccagaagcagtactgggtgtgcaacagcagcgacgccagcatcagctacacctactgcggcagagacctgaagcagctgtacttcaacctgtacatcaccgtgaacaccatgaacctgcccaagagaaaggaggtgatctgcagaggcagcgacgacgactacagcttctgcagagccctgaagggcgagaccgtgaacaccaccatcagcttcagcttcaagggcatcaagttcagcaagggcaagtacaagtgcgtggtggaggccatcagcggcagccccgaggagatgctgttctgcctggagttcgtgatcctgcaccagcccaacagcaactag

SEQ ID NO: 4902 - DNA, 318 bp, Artificial Sequence
  Description of Artificial Sequence: Synthetic coding sequence
atgaagtgcaccgccagagagtggctgagagtgaccaccgtgctgttcatggccagagccatccccgccatggtggtgcccaacgccaccctgctggagaagctgctggagaagtacatggacgaggacggcgagtggtggatcgccaagcagagaggcaagagagccatcaccgacaacgacatgcagagcatcctggacctgcacaacaagctgagaagccaggtgtaccccaccgccagcaacatggagtacatgacctgggacgtggagctggagagaagcgccgagagctgggccgagagctgcctgtggtag

SEQ ID NO: 4903 - DNA, 567 bp, Artificial Sequence
  Description of Artificial Sequence: Synthetic coding sequence
atgaccatggtgtgccacagacccgagggcctggagcagctggaggcccagaccaacttcaccaagagagagctgcaggtgctgtacagaggcttcaagaacgagtgccccagcggcgtggtgaacgaggacaccttcaagcagatctacgcccagttcttcccccacggcgacgccagcacctacgcccactacctgttcaacgccttcgacaccacccagaccggcagcgtgaagttcgaggacttcgtgaccgccctgagcatcctgctgagaggcaccgtgcacgagaagctgagatggaccttcaacctgtacgacatcaacaaggacggctacatcaacaaggaggagatgatggacatcgtgaaggccatctacgacatgatgggcaagtacacctaccccgtgctgaaggaggacacccccagacagcacgtggacgtgttcttccagaagatggacaagaacaaggacggcatcgtgaccctggacgagttcctggagagctgccaggaggacgacaacatcatgagaagcctgcagctgttccagaacgtgatgtag

SEQ ID NO: 4904 - DNA, 1275 bp, Artificial Sequence
  Description of Artificial Sequence: Synthetic coding sequence
atgccccccttcctgatcaccctgttcctgttccacagctgctgcctgagagccaacggccacctgagagagggcatgaccctgctgaagaccgagttcgccctgcacctgtaccagagcgtggccgcctgcagaaacgagaccaacttcgtgatcagccccgccggcgtgagcctgcccctggagatcctgcagttcggcgccgagggcagcaccggccagcagctggccgacgccctgggctacaccgtgcacgacaagagagtgaaggacttcctgcacgccgtgtacgccaccctgcccaccagcagccagggcaccgagatggagctggcctgcagcctgttcgtgcaggtgggcacccccctgagcccctgcttcgtggagcacgtgagctggtgggccaacagcagcctggagcccgccgacctgagcgagcccaacagcaccgccatccagaccagcgagggcgccagcagagagaccgccggcggcggccccagcgagggccccggcggctggccctgggagcaggtgagcgccgccttcgcccagctggtgctggtgagcaccatgagcttccagggcacctggagaaagagattcagcagcaccgacacccagatcctgcccttcacctgcgcctacggcctggtgctgcaggtgcccatgatgcaccagaccaccgaggtgaactacggccagttccaggacaccgccggccaccaggtgggcgtgctggagctgccctacctgggcagcgccgtgagcctgttcctggtgctgcccagagacaaggacacccccctgagccacatcgagccccacctgaccgccagcaccatccacctgtggaccaccagcctgagaagagccagaatggacgtgttcctgcccagattcagaatccagaaccagttcaacctgaagagcatcctgaacagctggggcgtgaccgacctgttcgaccccctgaaggccaacctgaagggcatcagcggccaggacggcttctacgtgagcgaggccatccacaaggccaagatcgaggtgctggaggagggcaccaaggccagcggcgccaccgccctgctgctgctgaagagaagcagaatccccatcttcaaggccgacagacccttcatctacttcctgagagagcccaacaccggcatcaccgtgttcttcgacagaatccagatcatctaccagtgcctgagcagcaacaagggcagcttcgtgcactaccccctgaagaacaagcacagcttctag

SEQ ID NO: 4905 - DNA, 1815 bp, Artificial Sequence
  Description of Artificial Sequence: Synthetic coding sequence
atggccgtgctggtgtgccccgccagctgccacggcctgaaggagttcagaatcagaagaggcatgtggagactgtgcctggtgtactacttctaccccgccagcagcaccctgtacgtgctgagaatcgacgtgctgaactacaccagcaaggacgagggccccagcgccgagggcccccagagaaacaccagactgggctggatccagggcaagcaggtgaccgtgctgggcagccccgtgcccgtgaacgtgttcctgggcgtgcccttcgccgccccccccctgggcagcctgagattcaccaacccccagcccgccagcccctgggacaacctgagagaggccaccagctaccccaacctgtgcctgcagaacagcgagtggctgctgctggaccagcacatgctgaaggtgcactaccccaagttcggcgtgagcgaggactgcctgtacctgaacatctacgcccccgcccacgccgacaccggcagcaagctgcccgtgctggtgtggttccccggcggcgccttcaagaccggcagcgccagcatcttcgacggcagcgccctggccgcctacgaggacgtgctggtggtggtggtgcagtacagactgggcatcttcggcttcttcaccacctgggaccagcacgcccccggcaactgggccttcaaggaccaggtggccgccctgagctgggtgcagaagaacatcgagttcttcggcggcgaccccagcagcgtgaccatcttcggcgagagcgccggcgccatcagcgtgagcagcctgatcctgagccccatggccaagggcctgttccacaaggccatcatggagagcggcgtggccatcatcccctacctggaggcccacgactacgagaagagcgaggacctgcaggtggtggcccacttctgcggcaacaacgccagcgacagcgaggccctgctgagatgcctgagaaccaagcccagcaaggagctgctgaccctgagccagaagaccaagagcttcaccagagtggtggacggcgccttcttccccaacgagcccctggacctgctgagccagaaggccttcaaggccatccccagcatcatcggcgtgaacaaccacgagtgcggcttcctgctgcccatgaaggaggcccccgagatcctgagcggcagcaacaagagcctggccctgcacctgatccagaacatcctgcacatccccccccagtacctgcacctggtggccaacgagtacttccacgacaagcacagcctgaccgagatcagagacagcctgctggacctgctgggcgacgtgttcttcgtggtgcccgccctgatcaccgccagataccacagagacgccggcgcccccgtgtacttctacgagttcagacacagaccccagtgcttcgaggacaccaagcccgccttcgtgaaggccgaccacgccgacgaggtgagattcgtgttcggcggcgccttcctgaagggcgacatcgtgatgttcgagggcgccaccgaggaggagaagctgctgagcagaaagatgatgaagtactgggccaccttcgccagaaccggcaaccccaacggcaacgacctgagcctgtggcccgcctacaacctgaccgagcagtacctgcagctggacctgaacatgagcctgggccagagactgaaggagcccagagtggacttctggaccagcaccatccccctgatcctgagcgccagcgacatgctgcacagccccctgagcagcctgaccttcctgagcctgctgcagcccttcttcttcttctgcgccccctag

SEQ ID NO: 4906 - DNA, 939 bp, Artificial Sequence
  Description of Artificial Sequence: Synthetic coding sequence
atgaacatctggggccagatctggcccaaggccgtgtacctggtgtgcaactacagccccaagggcaactggtggggccacgccccctacaagcacggcagaccctgcagcgcctgcccccccagcttcggcggcggctgcagagagaacctgtgctacaaggagggcagcgacagatactacccccccagagaggaggagaccaacgagatcgagagacagcagagccaggtgcacgacacccacgtgagaaccagaagcgacgacagcagcagaaacgaggtgatcagcgcccagcagatgagccagatcgtgagctgcgaggtgagactgagagaccagtgcaagggcaccacctgcaacagatacgagtgccccgccggctgcctggacagcaaggccaaggtgatcggcagcgtgcactacgagatgcagagcagcatctgcagagccgccatccactacggcatcatcgacaacgacggcggctgggtggacatcaccagacagggcagaaagcactacttcatcaagagcaacagaaacggcatccagaccatcggcaagtaccagagcgccaacagcttcaccgtgagcaaggtgaccgtgcaggccgtgacctgcgagaccaccgtggagcagctgtgccccttccacaagcccgccagccactgccccagagtgtactgccccagaaactgcatgcaggccaacccccactacgccagagtgatcggcaccagagtgtacagcgacctgagcagcatctgcagagccgccgtgcacgccggcgtggtgagaaaccacggcggctacgtggacgtgatgcccgtggacaagagaaagacctacatcgccagcttccagaacggcatcttcagcgagagcctgcagaacccccccggcggcaaggccttcagagtgttcgccgtggtgtag

SEQ ID NO: 4907 - DNA, 777 bp, Artificial Sequence; identical to SEQ ID NO: 3586
  Description of Artificial Sequence: Synthetic coding sequence

SEQ ID NO: 4908 - DNA, 1215 bp, Artificial Sequence; identical to SEQ ID NO: 4411
  Description of Artificial Sequence: Synthetic coding sequence

SEQ ID NO: 4909 - DNA, 936 bp, Artificial Sequence; identical to SEQ ID NO: 4810
  Description of Artificial Sequence: Synthetic coding sequence

SEQ ID NO: 4910 - DNA, 555 bp, Artificial Sequence
  Description of Artificial Sequence: Synthetic coding sequence
atggccagcgagagactgcccaacagacccgcctgcctgctggtggccagcggcgccgccgagggcgtgagcgcccagagcttcctgcactgcttcaccatggccagcaccgccttcaacctgcaggtggccacccccggcggcaaggccatggagttcgtggacgtgaccgagagcaacgccagatgggtgcaggacttcagactgaaggcctacgccagccccgccaagctggagagcatcgacgagcccatctgcgccgtgggccacggcgtggccgccctgtgctgcgccaccaacgaggacagaagctgggtgttcgacagctacagcctgaccggccccagcgtgtgcgagctggtgagagcccccggcttcgccagactgcccctggtggtggaggacttcgtgaaggacagcggcgcctgcttcagcgccagcgagcccgacgccgtgcacgtggtgctggacagacacctggtgaccggccagaacgccagcagcaccgtgcccgccgtgcagaacctgctgttcctgtgcggcagcagaaagtag

SEQ ID NO: 4911 - DNA, 1257 bp, Artificial Sequence; identical to SEQ ID NO: 3980
  Description of Artificial Sequence: Synthetic coding sequence

SEQ ID NO: 4912 - DNA, 1425 bp, Artificial Sequence
  Description of Artificial Sequence: Synthetic coding sequence
atggacagaaaccccagcccccccccccccggcagagacaaggaggaggaggaggaggtggccggcggcgactgcatcggcagcaccgtgtacagcaagcactggctgttcggcgtgctgagcggcctgatccagatcgtgagccccgagaacaccaagagcagcagcgacgacgaggagcagctgaccgagctggacgaggagatggagaacgagatctgcagagtgtgggacatgagcatggacgaggacgtggccctgttcctgcaggagttcaacgcccccgacatcttcatgggcgtgctggccaagagcaagtgccccagactgagagagatctgcgtgggcatcctgggcaacatggcctgcttccaggagatctgcgtgagcatcagcagcgacaagaacctgggccaggtgctgctgcactgcctgtacgacagcgacccccccaccctgctggagaccagcagactgctgctgacctgcctgagccaggccgaggtggccagcgtgtgggtggagagaatccaggagcaccccgccatctacgacagcatctgcttcatcatgagcagcagcaccaacgtggacctgctggtgaaggtgggcgaggtggtggacaagctgttcgacctggacgagaagctgatgctggagtgggtgagaaacggcgccgcccagcccctggaccagccccaggaggagagcgaggagcagcccgtgttcagactggtgccctgcatcctggaggccgccaagcaggtgagaagcgagaaccccgagtggctggacgtgtacatgcacatcctgcagctgctgaccaccgtggacgacggcatccaggccatcgtgcactgccccgacaccggcaaggacatctggaacctgctgttcgacctggtgtgccacgagttctgccagagcgacgacccccccatcatcctgcaggagcagaagaccgtgctggccagcgtgttcagcgtgctgagcgccatctacgccagccagaccgagcaggagtacctgaagatcgagaaggtggacctgcccctgatcgacagcctgatcagagtgctgcagaacatggagcagtgccagaagaagcccgagaacagcgccgagagcaacaccgaggagaccaagagaaccgacctgacccaggacgacttccacctgaagatcctgaaggacatcctgtgcgagttcctgagcaacatcttccaggccctgaccaaggagaccgtggcccagggcgtgaaggagggccagctgagcaagcagaagtgcagcagcgccttccagaacctgctgcccttctacagccccgtggtggaggacttcatcaagatcctgagagaggtggacaaggccctggccgacgacctggagaagaacttccccagcctgaaggtgcagacctag

SEQ ID NO: 4913 - DNA, 438 bp, Artificial Sequence; identical to SEQ ID NO: 3746
  Description of Artificial Sequence: Synthetic coding sequence

SEQ ID NO: 4914 - DNA, 1728 bp, Artificial Sequence
  Description of Artificial Sequence: Synthetic coding sequence
tgaatcttcggcggcagcatccactacttcagagtgcccagagagtactggagagacagactgctgaagatgaaggcctgcggcctgaacaccctgaccacctacgtgccctggaacctgcacgagcccgagagaggcaagttcgacttcagcggcaacctggacctggaggccttcgtgctgatggccgccgagatcggcctgtgggtgatcctgagacccggcccctacatctgcagcgagatggacctgggcggcctgcccagctggctgctgcaggaccccggcatgagactgagaaccacctacaagggcttcaccgaggccgtggacctgtacttcgaccacctgatgagcagagtggtgcccctgcagtacaagagaggcggccccatcatcgccgtgcaggtggagaacgagtacggcagctacaacaaggaccccgcctacatgccctacgtgaagaaggccctggaggacagaggcatcgtggagctgctgctgaccagcgacaacaaggacggcctgagcaagggcatcgtgcagggcgtgctggccaccatcaacctgcagagcacccacgagctgcagctgctgaccaccttcctgttcaacgtgcagggcacccagcccaagatggtgatggagtactggaccggctggttcgacagctggggcggcccccacaacatcctggacagcagcgaggtgctgaagaccgtgagcgccatcgtggacgccggcagcagcatcaacctgtacatgttccacggcggcaccaacttcggcttcatgaacggcgccatgcacttccacgactacaagagcgacgtgaccagctacgactacgacgccgtgctgaccgaggccggcgactacaccgccaagtacatgaagctgagagacttcttcggcagcatcagcggcatccccctgccccccccccccgacctgctgcccaagatgccctacgagcccctgacccccgtgctgtacctgagcctgtgggacgccctgaagtacctgggcgagcccatcaagagcgagaagcccatcaacatggagaacctgcccgtgaacggcggcaacggccagagcttcggctacatcctgtacgagaccagcatcaccagcagcggcatcctgagcggccacgtgcacgacagaggccaggtgttcgtgaacaccgtgagcatcggcttcctggactacaagaccaccaagatcgccgtgcccctgatccagggctacaccgtgctgagaatcctggtggagaacagaggcagagtgaactacggcgagaacatcgacgaccagagaaagggcctgatcggcaacctgtacctgaacgacagccccctgaagaacttcagaatctacagcctggacatgaagaagagcttcttccagagattcggcctggacaagtggagcagcctgcccgagacccccaccctgcccgccttcttcctgggcagcctgagcatcagcagcaccccctgcgacaccttcctgaagctggagggctgggagaagggcgtggtgttcatcaacggccagaacctgggcagatactggaacatcggcccccagaagaccctgtacctgcccggcccctggctgagcagcggcatcaaccaggtgatcgtgttcgaggagaccatggccggccccgccctgcagttcaccgagaccccccacctgggcagaaaccagtacatcaagtag

SEQ ID NO: 4915 - DNA, 255 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctactag

SEQ ID NO: 4916 - DNA, 744 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttcagagacaagagaagcgccctgcagagcatcaacgagtgggccgcccagaccaccgacggcaagctgcccgaggtgaccaaggacgtggagagaaccgacggcgccctgctggtgaacgccatgttcttcaagccccactgggacgagaagttccaccacaagatggtggacaacagaggcttcatggtgaccagaagctacaccgtgggcgtgatgatgatgcacagaaccggcctgtacaactactacgactag

SEQ ID NO: 4917 - DNA, 117 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaaggtgtag

SEQ ID NO: 4918 - DNA, 750 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttcagagacaagagaagcgccctgcagagcatcaacgagtgggccgcccagaccaccgacggcaagctgcccgaggtgaccaaggacgtggagagaaccgacggcgccctgctggtgaacgccatgttcttcaagccccactgggacgagaagttccaccacaagatggtggacaacagaggcttcatggtgaccagaagctacaccgtgggcgtgatgatgatgcacagaaccggcctgtacaactactacgacgacgagtag

SEQ ID NO: 4919 - DNA, 201 bp, Artificial Sequence
  Description of Artificial Sequence: Synthetic coding sequence
atgaagcccctgctggtggtgttcgtgttcctgttcctgtgggaccccgtgctggccggcatcaacagcctgagcagcgagatgcacaagaagtgctacaagaacggcatctgcagactggagtgctacgagagcgagatgctggtggcctactgcatgttccagctggagtgctgcgtgaagggcaaccccgccccctag

SEQ ID NO: 4920 - DNA, 1002 bp, Artificial Sequence; identical to SEQ ID NO: 4312
  Description of Artificial Sequence: Synthetic coding sequence

SEQ ID NO: 4921 - DNA, 645 bp, Artificial Sequence
  Description of Artificial Sequence: Synthetic coding sequence
atgagacccaagaccggccaggtgggctgcgagacccccgaggagctgggccccggccccagacagagatggcccctgctgctgctgggcctggccatggtggcccacggcctgctgagacccatggtggccccccagagcggcgaccccgaccccggcgccagcgtgggcagcagcagaagcagcctgagaagcctgtggggcagactgctgctgcagcccagcccccagagagccgaccccagatgctggcccagaggcttctggagcgagccccagagcctgtgctacgtgttcggcaccggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagctag

SEQ ID NO: 4922 - DNA, 1050 bp, Artificial Sequence
  Description of Artificial Sequence: Synthetic coding sequence
tgactgtacaagaacagactgggcagcggcggcagaggcagatgcatcaagcagggcgagaactggtacagccccaccgagttcgaggccatggccggcagagccagcagcaaggactggaagagaagcatcagatacgccggcagacccctgcagtgcctgatccaggacggcatcctgaacccccacgccgccagctgcacctgcgccgcctgctgcgacgacatgaccctgagcggccccgtgagactgttcgtgccctacaagagaagaaagaaggagaacgagctgcccaccacccccgtgaagaaggacagccccaagaacatcaccctgctgcccgccaccgccgccaccaccttcaccgtgacccccagcggccagatcaccaccagcggcgccctgaccttcgacagagccagcaccgtggaggccaccgccgtgatcagcgagagccccgcccagggcgacgtgttcgccggcgccaccgtgcaggaggccagcgtgcagcccccctgcagagccagccaccccgagccccactaccccggctaccaggacagctgccagatcgcccccttccccgaggccgccctgcccaccagccaccccaagatcgtgctgaccagcctgcccgccctggccgtgcccccccccacccccaccaaggccgccccccccgccctggtgaacggcctggagctgagcgagcccagaagctggctgtacctggaggagatggtgaacagcctgctgaacaccgcccagcagctgaagaccctgttcgagcaggccaagcacgccagcacctacagagaggccgccaccaaccaggccaagatccacgccgacgccgagagaaaggagcagagctgcgtgaactgcggcagagaggccatgagcgagtgcaccggctgccacaaggtgaactactgcagcaccttctgccagagaaagagatggagcctgaccatgctgaccagcctggtgagcatcagctggctgagagccatcctgccctgccagccccccaaggtgctgggcctgtag

SEQ ID NO: 4923 - DNA, 600 bp, Artificial Sequence
  Description of Artificial Sequence: Synthetic coding sequence
atgagcctggacatccagagcctggacatccagtgcgaggagctgagcgacgccagatgggccgagctgctgcccctgctgcagcagtgccaggtggtgagactggacgactgcggcctgaccgaggccagatgcaaggacatcagcagcgccctgagagtgaaccccgccctggccgagctgaacctgagaagcaacgagctgggcgacgtgggcgtgcactgcgtgctgcagggcctgcagacccccagctgcaagatccagaagctgagcctgcagaactgctgcctgaccggcgccggctgcggcgtgctgagcagcaccctgagaaccctgcccaccctgcaggagctgcacctgagcgacaacctgctgggcgacgccggcctgcagctgctgtgcgagggcctgctggacccccagtgcagactggagaagctgcagctggagtactgcagcctgagcgccgccagctgcgagcccctggccagcgtgctgagagccaagcccgacttcaaggagctgaccgtgagcaacaacgacatcaacgaggccggcgtgagagtgctgtgccagggcctgaaggacagcccctgctag

SEQ ID NO: 4924 - DNA, 465 bp, Artificial Sequence
  Description of Artificial Sequence: Synthetic coding sequence
atggccggcatccccggcctgctgttcctgctgttcttcctgctgtgcgccgtgggccaggtgagcccctacagcgccccctggaagcccacctggcccgcctacagactgcccgtggtgctgccccagagcaccctgaacctggccaagcccgacttcggcgccgaggccaagctggaggtgagcagcagctgcggcccccagtgccacaagggcacccccctgcccacctacgaggaggccaagcagtacctgagctacgagaccctgtacgccaacggcagcagaaccgagacccaggtgggcatctacatcctgagcagcagcggcgacggcgcccagcacagagacagcggcagcagcggcaagagcagaagaaagagacagatctacggctacgacagcagattcagcatcttcggcaaggacttcctgctgaactaccccttcagcaccagcgtgtag

SEQ ID NO: 4925 - DNA, 936 bp, Artificial Sequence; identical to SEQ ID NO: 3636
  Description of Artificial Sequence: Synthetic coding sequence

SEQ ID NO: 4926 - DNA, 1404 bp, Artificial Sequence; identical to SEQ ID NO: 3990
  Description of Artificial Sequence: Synthetic coding sequence

SEQ ID NO: 4927 - DNA, 81 bp, Artificial Sequence
  Description of Artificial Sequence: Synthetic coding sequence
atgagaaccctgttcaacctgctgtggctggccctggcctgcagccccgtgcacaccaccctgagcaagagcgacgcctag

SEQ ID NO: 4928 - DNA, 549 bp, Artificial Sequence
  Description of Artificial Sequence: Synthetic coding sequence
atgagaagaatgtgggccacccagggcctggccgtggccctggccctgagcgtgctgcccggcagcagagccctgagacccggcgactgcgaggtgtgcatcagctacctgggcagattctaccaggacctgaaggacagagacgtgaccttcagccccgccaccatcgagaacgagctgatcaagttctgcagagaggccagaggcaaggagaacagactgtgctactacatcggcgccaccgacgacgccgccaccaagatcatcaacgaggtgagcaagcccctggcccaccacatccccgtggagaagatctgcgagaagctgaagaagaaggacagccagatctgcgagctgaagtacgacaagcagatcgacctgagcaccgtggacctgaagaagctgagagtgaaggagctgaagaagatcctggacgactggggcgagacctgcaagggctgcgccgagaagagcgactacatcagaaagatcaacgagctgatgcccaagtacgcccccaaggccgccagcgccagaaccgacctgtag

SEQ ID NO: 4929 - DNA, 153 bp, Artificial Sequence
  Description of Artificial Sequence: Synthetic coding sequence
atgaaggtgttcttcctgttcgccgtgctgttctgcctggtgcagaccaacagcgtgcacatcagccacagagaggccagaggccccagcttcagaatctgcgtggacttcctgggccccagatgggccagaggctgcagcaccggcaactag

SEQ ID NO: 4930 - DNA, 666 bp, Artificial Sequence
  Description of Artificial Sequence: Synthetic coding sequence
atgggcgccaccaccatggaccagaagagcctgtgggccggcgtggtggtgctgctgctgctgcagggcggcagcgcctacaagctggtgtgctacttcaccaactggagccaggacagacaggagcccggcaagttcacccccgagaacatcgaccccttcctgtgcagccacctgatctacagcttcgccagcatcgagaacaacaaggtgatcatcaaggacaagagcgaggtgatgctgtaccagaccatcaacagcctgaagaccaagaaccccaagctgaagatcctgctgagcatcggcggctacctgttcggcagcaagggcttccaccccatggtggacagcagcaccagcagactggagttcatcaacagcatcatcctgttcctgagaaaccacaacttcgacggcctggacgtgagctggatctaccccgaccagaaggagaacacccacttcaccgtgctgatccacgagctggccgaggccttccagaaggacttcaccaagagcaccaaggagagactgctgctgaccgccggcgtgagcgccggcagacagatgatcgacaacagctaccaggtggagaagctggccaaggacctggacttcatcaacctgctgagcttcgacttccacggcagctgggagaagccctag

SEQ ID NO: 4931 - DNA, 1257 bp, Artificial Sequence; identical to SEQ ID NO: 3870
  Description of Artificial Sequence: Synthetic coding sequence

SEQ ID NO: 4932 - DNA, 612 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttcagagacaagagaagcgccctgcagagcatcaacgagtgggccgcccagaccaccgacggcaagctgcccgaggtgaccaaggacgtggagagaaccgacggcgccctgctggtgaacgcctag

SEQ ID NO: 4933 - DNA, 492 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttctag

SEQ ID NO: 4934 - DNA, 570 bp, Artificial Sequence
  Description of Artificial Sequence: Synthetic coding sequence
atgagcctggacatccagagcctggacatccagtgcgaggagctgagcgacgccagatgggccgagctgctgcccctgctgcagcagtgccaggtggtgagactggacgactgcggcctgaccgaggccagatgcaaggacatcagcagcgccctgagagtgaaccccgccctggccgagctgaacctgagaagcaacgagctgggcgacgtgggcgtgcactgcgtgctgcagggcctgcagacccccagctgcaagatccagaagctgagcctgcagaactgctgcctgaccggcgccggctgcggcgtgctgagcagcaccctgagaaccctgcccaccctgcaggagctgcacctgagcgacaacctgctgggcgacgccggcctgcagctgctgtgcgagggcctgctggacccccagtgcagactggagaagctgcagctggagtactgcagcctgagcgccgccagctgcgagcccctggccagcgtgctgagagccaagcccgacttcaaggagctgaccgtgagcaacaacgacatcaacgaggccggcgtgagagtgtag

SEQ ID NO: 4935 - DNA, 585 bp, Artificial Sequence
  Description of Artificial Sequence: Synthetic coding sequence
atgagcctggacatccagagcctggacatccagtgcgaggagctgagcgacgccagatgggccgagctgctgcccctgctgcagcagtgccaggtggtgagactggacgactgcggcctgaccgaggccagatgcaaggacatcagcagcgccctgagagtgaaccccgccctggccgagctgaacctgagaagcaacgagctgggcgacgtgggcgtgcactgcgtgctgcagggcctgcagacccccagctgcaagatccagaagctgagcctgcagaactgctgcctgaccggcgccggctgcggcgtgctgagcagcaccctgagaaccctgcccaccctgcaggagctgcacctgagcgacaacctgctgggcgacgccggcctgcagctgctgtgcgagggcctgctggacccccagtgcagactggagaagctgcagctggagtactgcagcctgagcgccgccagctgcgagcccctggccagcgtgctgagagccaagcccgacttcaaggagctgaccgtgagcaacaacgacatcaacgaggccggcgtgagagtgctgtgccagggcctgtag

SEQ ID NO: 4936 - DNA, 1086 bp, Artificial Sequence; identical to SEQ ID NO: 4639
  Description of Artificial Sequence: Synthetic coding sequence

SEQ ID NO: 4937 - DNA, 327 bp, Artificial Sequence
  Description of Artificial Sequence: Synthetic coding sequence
tgacccaagagcaagtggagaagcaagatcctgctgggcctgaacttctacggcatggactacgccaccagcaaggacgccagagagcccgtggtgggcgccagatacatccagaccctgaaggaccacagacccagaatggtgtgggacagccaggccagcgagcacttcttcgagtacaagaagagcagaagcggcagacacgtggtgttctaccccaccctgaagagcctgcaggtgagactggagctggccagagagctgggcgtgggcgtgagcatctgggagctgggccagggcctggactacttctacgacctgctgtag

SEQ ID NO: 4938 - DNA, 504 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttcagagacaagagatag

SEQ ID NO: 4939 - DNA, 1209 bp, Artificial Sequence; identical to SEQ ID NO: 3820
  Description of Artificial Sequence: Synthetic coding sequence

SEQ ID NO: 4940 - DNA, 975 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttcagagacaagagaagcgccctgcagagcatcaacgagtgggccgcccagaccaccgacggcaagctgcccgaggtgaccaaggacgtggagagaaccgacggcgccctgctggtgaacgccatgttcttcaagccccactgggacgagaagttccaccacaagatggtggacaacagaggcttcatggtgaccagaagctacaccgtgggcgtgatgatgatgcacagaaccggcctgtacaactactacgacgacgagaaggagaagctgcagatcgtggagatgcccctggcccacaagctgagcagcctgatcatcctgatgccccaccacgtggagcccctggagagactggagaagctgctgaccaaggagcagctgaagatctggatgggcaagatgcagaagaaggccgtggccatcagcctgcccaagggcgtggtggaggtgacccacgacctgcaggtgagaggcggccccgcctag

SEQ ID NO: 4941 - DNA, 990 bp, Artificial Sequence
  Description of Artificial Sequence: Synthetic coding sequence
atggtgagcaagagcagatggaagctgctggccatgctggccctggtgctggtggtgatggtgtggtacagcatcagcagagaggacagcttctacttccccatccccgagaagaaggagccctgcctgcagggcgaggccgagagcaaggccagcaagctgttcggcaactacagcagagaccagcccatcttcctgagactggaggactacttctgggtgaagacccccagcgcctacgagctgccctacggcaccaagggcagcgaggacctgctgctgagagtgctggccatcaccagcagcagcatccccaagaacatccagagcctgagatgcagaagatgcgtggtggtgggcaacggccacagactgagaaacagcagcctgggcgacgccatcaacaagtacgacgtggtgatcagactgaacaacgcccccgtggccggctacgagggcgacgtgggcagcaagaccaccatgagactgttctaccccgagagcgcccacttcgaccccaaggtggagaacaaccccgacaccctgctggtgctggtggccttcaaggccatggacttccactggatcgagaccatcctgagcgacaagaagagagtgagaaagggcttctggaagcagccccccctgatctgggacgtgaaccccaagcagatcagaatcctgaaccccttcttcatggagatcgccgccgacaagctgctgagcctgcccatgcagcagcccagaaagatcaagcagaagcccaccaccggcctgctggccatcaccctggccctgcacctgtgcgacctggtgcacatcgccggcttcggctaccccgacgcctacaacaagaagcagaccatccactactacgagcagatcaccctgaagagcatggccggcagcggccacaacgtgagccaggaggccctggccatcaagagaatgctggagatgggcgccatcaagaacctgaccagcttctag

SEQ ID NO: 4942 - DNA, 351 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctacgtgaccccctggaacagccacggctacgacgtgaccaaggtgttcggcagcaagttcacccagatcagccccgtgtggctgcagctgaagagaagatag

SEQ ID NO: 4943 - DNA, 282 bp, Artificial Sequence; identical to SEQ ID NO: 4196
  Description of Artificial Sequence: Synthetic coding sequence

SEQ ID NO: 4944 - DNA, 255 bp, Artificial Sequence
  Description of Artificial Sequence: Synthetic coding sequence
atgagacccaagaccggccaggtgggctgcgagacccccgaggagctgggccccggccccagacagagatggcccctgctgctgctgggcctggccatggtggcccacggcctgctgagacccatggtggccccccagagcggcgaccccgaccccggcgccagcgtgggcagcagcagaagcagcctgagaagcctgtggggcagaagcgcccagggccagccccactgccacagcgtgcccgccctgctgtag

SEQ ID NO: 4945 - DNA, 27 bp, Artificial Sequence
  Description of Artificial Sequence: Synthetic coding sequence
atgagcctggacatccagagcctgtag

SEQ ID NO: 4946 - DNA, 576 bp, Artificial Sequence
  Description of Artificial Sequence: Synthetic coding sequence
atgctgatcttctggaccatcaccctgttcctgctgggcgccgccaagggcaaggaggtgtgctacgaggacctgggctgcttcagcgacaccgagccctggggcggcaccgccatcagacccctgaagatcctgccctggagccccgagaagatcggcaccagattcctgctgtacaccaacgagaaccccaacaacttccagatcctgctgctgagcgaccccagcaccatcgaggccagcaacttccagatggacagaaagaccagattcatcatccacggcttcatcgacaagggcgacgagagctgggtgaccgacatgtgcaagaagctgttcgaggtggaggaggtgaactgcatctgcgtggactggaagaagggcagccaggccacctacacccaggccgccaacaacgtgagagtggtgggcgcccaggtggcccagatgctggacatcctgctgaccgagtacagctacccccccagcaaggtgcacctgatcggccacagcctgggcgcccacgtggccggcgaggccggcagcaagacccccggcctgagcagaatcacctag

SEQ ID NO: 4947 - DNA, 123 bp, Artificial Sequence
  Description of Artificial Sequence: Synthetic coding sequence
atgagcctggacatccagagcctggacatccagtgcgaggagctgagcgacgccagatgggccgagctgctgcccctgctgcagcagtgccaggtggtgagactggacgactgcggcctgtag

SEQ ID NO: 4948 - DNA, 648 bp, Artificial Sequence
  Description of Artificial Sequence: Synthetic coding sequence
atgagacccaagaccggccaggtgggctgcgagacccccgaggagctgggccccggccccagacagagatggcccctgctgctgctgggcctggccatggtggcccacggcctgctgagacccatggtggccccccagagcggcgaccccgaccccggcgccagcgtgggcagcagcagaagcagcctgagaagcctgtggggcagcagactgctgctgcagcccagcccccagagagccgaccccagatgctggcccagaggcttctggagcgagccccagagcctgtgctacgtgttcggcaccggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagctag

SEQ ID NO: 4949 - DNA, 999 bp, Artificial Sequence
  Description of Artificial Sequence: Synthetic coding sequence
atgtgccccgccggctggaagctgctggccatgctggccctggtgctggtggtgatggtgtggtacagcatcagcagagaggacagatacatcgagctgttctacttccccatccccgagaagaaggagccctgcctgcagggcgaggccgagagcaaggccagcaagctgttcggcaactacagcagagaccagcccatcttcctgagactggaggactacttctgggtgaagacccccagcgcctacgagctgccctacggcaccaagggcagcgaggacctgctgctgagagtgctggccatcaccagcagcagcatccccaagaacatccagagcctgagatgcagaagatgcgtggtggtgggcaacggccacagactgagaaacagcagcctgggcgacgccatcaacaagtacgacgtggtgatcagactgaacaacgcccccgtggccggctacgagggcgacgtgggcagcaagaccaccatgagactgttctaccccgagagcgcccacttcgaccccaaggtggagaacaaccccgacaccctgctggtgctggtggccttcaaggccatggacttccactggatcgagaccatcctgagcgacaagaagagagtgagaaagggcttctggaagcagccccccctgatctgggacgtgaaccccaagcagatcagaatcctgaaccccttcttcatggagatcgccgccgacaagctgctgagcctgcccatgcagcagcccagaaagatcaagcagaagcccaccaccggcctgctggccatcaccctggccctgcacctgtgcgacctggtgcacatcgccggcttcggctaccccgacgcctacaacaagaagcagaccatccactactacgagcagatcaccctgaagagcatggccggcagcggccacaacgtgagccaggaggccctggccatcaagagaatgctggagatgggcgccatcaagaacctgaccagcttctag

SEQ ID NO: 4950 - DNA, 888 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagcaagcagcactacaactgcgagcacagcaagatcaacttcagagacaagagaagcgccctgcagagcatcaacgagtgggccgcccagaccaccgacggcaagctgcccgaggtgaccaaggacgtggagagaaccgacggcgccctgctggtgaacgccatgttcttcaagccccactgggacgagaagttccaccacaagatggtggacaacagaggcttcatggtgaccagaagctacaccgtgggcgtgatgatgatgcacagaaccggcctgtacaactactacgacgacgagaaggagaagctgcagatcgtggagatgcccctggcccacaagctgagcagcctgatcatcctgatgccccaccacgtggagcccctggagagactggagaagctgctgaccaaggagcagctgaagatctggatgggctag

SEQ ID NO: 4951 - DNA, 399 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctacgtgaccccctggaacagccacggctacgacgtgaccaaggtgttcggcagcaagttcacccagatcagccccgtgtggctgcagctgaagagaagaggcagagagatgttcgaggtgaccggcctgcacgacgtggaccagggctag

SEQ ID NO: 4952 - DNA, 360 bp, Artificial Sequence
  Description of Artificial Sequence: Synthetic coding sequence
atgagaaccctgttcaacctgctgtggctggccctggcctgcagccccgtgcacaccaccctgagcaagagcgacgccaagaaggccgccagcaagaccctgctggagaagagccagttcagcgacaagcccgtgcaggacagaggcctggtggtgaccgacctgaaggccgagagcgtggtgctggagcacagaagctactgcagcgccaaggccagagacagacacttcgccggcgacgtgctgggctacgtgaccccctggaacagccacggctacgacgtgaccaaggtgttcggcagcaagttcacccagatcagccccgtgtggctgcagctgaagagaagaggcagagagtag

SEQ ID NO: 4953 - DNA, 390 bp, Artificial Sequence; identical to SEQ ID NO: 3632
  Description of Artificial Sequence: Synthetic coding sequence

SEQ ID NO: 4954 - DNA, 1386 bp, Artificial Sequence; identical to SEQ ID NO: 3950
  Description of Artificial Sequence: Synthetic coding sequence

SEQ ID NO: 4955 - DNA, 453 bp, Artificial Sequence
  Description of Artificial Sequence: Synthetic coding sequence
atgagaagcctgctgctgctgagcgccttctgcctgctggaggccgccctggccgccgaggtgaagaagcccgccgccgccgccgcccccggcaccgccgagaagctgagccccaaggccgccaccctggccgagagaagcgccggcctggccttcagcctgtaccaggccatggccaaggaccaggccgtggagaacatcctggtgagccccgtggtggtggccagcagcctgggcctggtgagcctgggcggcaaggccaccaccgccagccaggccaaggccgtgctgagcgccgagcagctgagagacgaggaggtgcacgccggcctgggcgagctgctgagaagcctgagcaacagcaccgccagaaacgtgacctggaagctgggcagcagactgtacggccccagcagcgtgagcttcgccgacgacttcgtgagaagcagctag

SEQ ID NO: 4956 - DNA, 1257 bp, Artificial Sequence; identical to SEQ ID NO: 3980
  Description of Artificial Sequence: Synthetic coding sequence

SEQ ID NO: 4957 - DNA, 1002 bp, Artificial Sequence; identical to SEQ ID NO: 4312
  Description of Artificial Sequence: Synthetic coding sequence

SEQ ID NO: 4958 - DNA, 987 bp, Artificial Sequence
  Description of Artificial Sequence: Synthetic coding sequence
atgtgccccgccggctggaagctgctggccatgctggccctggtgctggtggtgatggtgtggtacagcatcagcagagaggacagcttctacttccccatccccgagaagaaggagccctgcctgcagggcgaggccgagagcaaggccagcaagctgttcggcaactacagcagagaccagcccatcttcctgagactggaggactacttctgggtgaagacccccagcgcctacgagctgccctacggcaccaagggcagcgaggacctgctgctgagagtgctggccatcaccagcagcagcatccccaagaacatccagagcctgagatgcagaagatgcgtggtggtgggcaacggccacagactgagaaacagcagcctgggcgacgccatcaacaagtacgacgtggtgatcagactgaacaacgcccccgtggccggctacgagggcgacgtgggcagcaagaccaccatgagactgttctaccccgagagcgcccacttcgaccccaaggtggagaacaaccccgacaccctgctggtgctggtggccttcaaggccatggacttccactggatcgagaccatcctgagcgacaagaagagagtgagaaagggcttctggaagcagccccccctgatctgggacgtgaaccccaagcagatcagaatcctgaaccccttcttcatggagatcgccgccgacaagctgctgagcctgcccatgcagcagcccagaaagatcaagcagaagcccaccaccggcctgctggccatcaccctggccctgcacctgtgcgacctggtgcacatcgccggcttcggctaccccgacgcctacaacaagaagcagaccatccactactacgagcagatcaccctgaagagcatggccggcagcggccacaacgtgagccaggaggccctggccatcaagagaatgctggagatgggcgccatcaagaacctgaccagcttctag

SEQ ID NO: 4959 - DNA, 585 bp, Artificial Sequence; identical to SEQ ID NO: 3585
  Description of Artificial Sequence: Synthetic coding sequence

SEQ ID NO: 4960 - DNA, 1386 bp, Artificial Sequence; identical to SEQ ID NO: 3950
  Description of Artificial Sequence: Synthetic coding sequence

SEQ ID NO: 4961 - DNA, 1995 bp, Artificial Sequence
  Description of Artificial Sequence: Synthetic coding sequence
atgccccaggcccccagcaccggcagcagcctgatcagagaccccagcatcgcccacagaaacacccagatcctgtggaccgaggccggcagagacctggcccaggacaccagatacaccggcgaggagagcctgaccatcttcgtggacaagagaaagctgagcaagagagccgagggcagcgacagcaccaccaacagcagcagcgtgaccctggagaccctgcaccagctggccgccagctacttcatcgacagagacagcaccctgagaagactgcaccacatccagatcgccagcaccgccatcaaggtgaccgagaccagaaccggccccctgggctgcagcaactacgacaacctggacagcgtgagcagcgtgctggtgcagagccccgagaacaagatccagctgcagggcctgcaggtgctgctgcccgactacctgcaggagagattcgtgcaggccgccctgagctacatcgcctgcaacagcgagggcgagttcatctgcaaggagaacgactgctggtgccactgcggccccaagttccccgagtgcaactgccccagcatggacatccaggccatggaggagaacctgctgagaatcaccgagacctggaaggcctacaacagcgacttcgaggagagcgacgagttcaagctgttcatgaagagactgcccatgaactacttcctgaacaccagcaccatcatgcacctgtggaccatggacagcaacttccagagaagatacgagcagctggagaacagcatgaagcagctgttcctgaaggcccagaagatcgtgcacaagctgttcagcctgagcaagagatgccacaagcagcccctgatcagcctgcccagacagagaaccagcacctactggctgaccagaatccagagcttcctgtactgcaacgagaacggcctgctgggcagcttcagcgaggagacccacagctgcacctgccccaacgaccaggtggtgtgcaccgccttcctgccctgcaccgtgggcgacgccagcgcctgcctgacctgcgcccccgacaacagaaccagatgcggcacctgcaacaccggctacatgctgagccagggcctgtgcaagcccgaggtggccgagagcaccgaccactacatcggcttcgagaccgacctgcaggacctggagatgaagtacctgctgcagaagaccgacagaagaatcgaggtgcacgccatcttcatcagcaacgacatgagactgaacagctggttcgaccccagctggagaaagagaatgctgctgaccctgaagagcaacaagtacaagagcagcctggtgcacatgatcctgggcctgagcctgcagatctgcctgaccaagaacagcaccctggagcccgtgctggccgtgtacgtgaaccccttcggcggcagccacagcgagagctggttcatgcccgtgaacgagaacagcttccccgactgggagagaaccaagctggacctgcccctgcagtgctacaactggaccctgaccctgggcaacaagtggaagaccttcttcgagaccgtgcacatctacctgagaagcagaatcaagagcaacggccccaacggcaacgagagcatctactacgagcccctggagttcatcgaccccagcagaaacctgggctacatgaagatcaacaacatccaggtgttcggctacagcatgcacttcgaccccgaggccatcagagacctgatcctgcagctggactacccctacacccagggcagccaggacagcgccctgctgcagctgctggagatcagagacagagtgaacaagctgagcccccccggccagagaagactggacctgttcagctgcctgctgagacacagactgaagctgagcaccagcgaggtggtgagaatccagagcgccctgcaggccttcaacgccaagctgcccaacaccatggactacgacaccaccaagctgtgcagctag

SEQ ID NO: 4962 - DNA, 459 bp, Artificial Sequence
  Description of Artificial Sequence: Synthetic coding sequence
atggccagagactacgaccacctgttcaagctgctgatcatcggcgacagcggcgtgggcaagagcagcctgctgctgagattcgccgacaacaccttcagcggcagctacatcaccaccatcggcgtggacttcaagatcagaaccgtggagatcaacggcgagaaggtgaagctgcagatctgggacaccgccggccaggagagattcagaaccatcaccagcacctactacagaggcacccacggcgtgatcgtggtgtacgacgtgaccagcgccgagagcttcgtgaacgtgaagagatggctgcacgagatcaaccagaactgcgacgacgtgtgcagaatcctggacgtgcagctgcaccacggcgccggcccccccagcaaggagagacagcccggcaagaccgccgccgccaccaccgagagatgcggcgaggcccacgaggagcagtag

SEQ ID NO: 4963 - DNA, 696 bp, Artificial Sequence
  Description of Artificial Sequence: Synthetic coding sequence
atgctgtacatcggcatcgccgagtacttcttcaagagcgccagcttcgcccacttcaccgccggcgtgttcaacgtgaccctgagcaccgaggagatcagcaaccacttcgtgcagaacagccagggcctgggcaacgtgctgagcagaatcgccgagatctacatcctgagccagcccttcatggtgagaatcatggccaccgagccccccatcatcaacctgcagcccggcaacttcaccctggacatccccgccagcatcatgatgctgacccagcccaagaacagcaccgtggagaccatcgtgagcatggacttcgtggccagcaccagcgtgggcctggtgatcctgggccagagactggtgtgcagcctgagcctgaacagattcagactggccctgcccgagagcaacagaagcaacatcgaggtgctgagattcgagaacatcctgagcagcatcctgcacttcggcgtgctgcccctggccaacgccaagctgcagcagggcttccccctgagcaacccccacaagttcctgttcgtgaacagcgacatcgaggtgctggagggcttcctgctgatcagcaccgacctgaagtacgagaccagcagcaagcagcagcccagcttccacgtgtgggagggcctgaacctgatcagcagacagtggagaggcaagagcgccccctag

SEQ ID NO: 4964 - DNA, 1911 bp, Artificial Sequence; identical to SEQ ID NO: 3895
  Description of Artificial Sequence: Synthetic coding sequence

SEQ ID NO: 4965 - DNA, 1374 bp, Artificial Sequence
  Description of Artificial Sequence: Synthetic coding sequence
atgggctgcagcctgcccctgagctgcatcatggtgagaagcgtggcctgggccggcttcatggtgctgctgatgatcccctggggcagcgccgccaagctggtgtgctacttcaccaactgggcccagtacagacagggcgaggccagattcctgcccaaggacctggaccccagcctgtgcacccacctgatctacgccttcgccggcatgaccaaccaccagctgagcaccaccgagtggaacgacgagaccctgtaccaggagttcaacggcctgaagaagatgttcaccgacatggtggccaccgccaacaacagacagaccttcgtgaacagcgccatcagattcctgagaaagtacagcttcgacggcctggacctggactgggagtaccccggcagccagggcagccccgccgtggacaaggagagattcaccaccctggtgcaggacctggccaacgccttccagcaggaggcccagaccagcggcaaggagagactgctgctgagcgccgccgtgcccgccggccagacctacgtggacgccggctacgaggtggacaagatcgcccagaacctggacttcgtgaacctgatggcctacgacttccacggcagctgggagaaggtgaccggccacaacagccccctgtacaagagacaggaggagagcggcgccgccgccagcctgaacgtggacgccgccgtgcagcagtggctgcagaagggcacccccgccagcaagctgatcctgggcatgcccacctacggcagaagcttcaccctggccagcagcagcgacaccagagtgggcgcccccgccaccggcagcggcacccccggccccttcaccaaggagggcggcatgctggcctactacgaggtgtgcagctggaagggcgccaccaagcagagaatccaggaccagaaggtgccctacatcttcagagacaaccagtgggtgggcttcgacgacgtggagagcttcaagaccaaggtgagctacctgaagcagaagggcctgggcggcgccatggtgtgggccctggacctggacgacttcgccggcttcagctgcaaccagggcagataccccctgatccagaccctgagacaggagctgagcctgccctacctgcccagcggcacccccgagctggaggtgcccaagcccggccagcccagcgagcccgagcacggccccagccccggccaggacaccttctgccagggcaaggccgacggcctgtaccccaaccccagagagagaagcagcttctacagctgcgccgccggcagactgttccagcagagctgccccaccggcctggtgttcagcaacagctgcaagtgctgcacctggaactag

SEQ ID NO: 4966 - DNA, 1125 bp, Artificial Sequence
  Description of Artificial Sequence: Synthetic coding sequence
atgtacgtgagcaccagagagagatacaagtggctgagattcagcgaggactgcctgtacctgaacgtgtacgcccccgccagagcccccggcgacccccagctgcccgtgatggtgtggttccccggcggcgccttcatcgtgggcgccgccagcagctacgagggcagcgacctggccgccagagagaaggtggtgctggtgttcctgcagcacagactgggcatcttcggcttcctgagatggagaggcagaaccgacgacagccacgccagaggcaactggggcctgctggaccagatggccgccctgagatgggtgcaggagaacatcgccgccttcggcggcgaccccggcaacgtgaccctgttcggccagagcgccggcgccatgagcatcagcggcctgatgatgagccccctggccagcggcctgttccacagagccatcagccagagcggcaccgccctgttcagactgttcatcaccagcaaccccctgaaggtggccaagaaggtggcccacctggccggctgcaaccacaacagcacccagatcctggtgaactgcctgagagccctgagcggcaccaaggtgatgagagtgagcaacaagatgagattcctgcagctgaacttccagagagaccccgaggagatcatctggagcatgagccccgtggtggacggcgtggtgatccccgacgaccccctggtgctgctgacccagggcaaggtgagcagcgtgccctacctgctgggcgtgaacaacctggagttcaactggctgctgccctacatcatgaagttccccctgaacagacaggccatgagaaaggagaccatcaccaagatgctgtggagcaccagaaccctgctgaacatcaccaaggagcaggtgcccctggtggtggaggagtacctggacaacgtgaacgagcacgactggaagatgctgagaaacagaatgatggacatcgtgcaggacgccaccttcgtgtacgccaccctgcagaccgcccactaccacagagagacccccatgatgggcatctgccccgccggccacgccaccaccagaatgaagagcacctgcagctggatcctgccccaggagtgggcctag

SEQ ID NO: 4967 - DNA, 384 bp, Artificial Sequence
  Description of Artificial Sequence: Synthetic coding sequence
atgaagaccggcctgttcttcctgtgcctgctgggcaccgccgccgccatccccaccaacgccagactgctgagcgaccacagcaagcccaccgccgagaccgtggcccccgacaacaccgccatccccagcctgagagccgaggccgaggagaacgagaaggagaccgccgtgagcaccgaggacgacagccaccacaaggccgagaagagcagcgtgctgaagagcaaggaggagagccacgagcagagcgccgagcagggcaagagcagcagccaggagctgggcctgaaggaccaggaggacagcgacggccacctgagcgtgaacctggagtacgcccccaccgagggcaccctggacatcaaggaggacatgagctag

SEQ ID NO: 4968 - DNA, 285 bp, Artificial Sequence; identical to SEQ ID NO: 4264
  Description of Artificial Sequence: Synthetic coding sequence

SEQ ID NO: 4969 - DNA, 414 bp, Artificial Sequence
  Description of Artificial Sequence: Synthetic coding sequence
atggccgccctgagcagagccctgggccccctgagaacccccgccccccccctgtggatcggcctgttcctggtggccaccggcagccagcagagcctggcccagcccctgcccggcaacaccaccgaggccacccccagaagcctgagagccagcggcagcctgtgcggcccccacgccaaggccccctacctgtgcgaggccacccacgagcccgccgccgccagaatcagagcccaggtgcccgacaccagatggagcagagtgggcggccagagattctacagcagagtgctgagccccctgcacagaggccccagcggccacaccgaggccagcgcccagagaagccacatgggcaagctgaaggagccccagccccaggaccacaagcccggcctgggcgccagctag

SEQ ID NO: 4970 - DNA, 228 bp, Artificial Sequence
  Description of Artificial Sequence: Synthetic coding sequence
atgctgaaggtgcactaccccaagttcggcgtgagcgaggactgcctgtacctgaacatctacgcccccgcccacgccgacaccggcagcaagctgcccgtgctggtgtggttccccggcggcgccttcaagaccggcagcgccagcatcttcgacggcagcgccctggccgcctacgaggacgtgctggtggtggtggtgcagtacagactgggcatcttcggctag

SEQ ID NO: 4971 - DNA, 1491 bp, Artificial Sequence
  Description of Artificial Sequence: Synthetic coding sequence
atggcccccgccagaaccatggccagagccagactggcccccgccgactgcctgaacagcttcaccgccggcgtgcccggcttcgtgctggacaccaacgccagcgtgagcaacggcgccaccttcctggagagccccaccgtgagaagaggctgggactgcgtgagagcctgctgcaccacccagaactgcaacctggccctggtggagctgcagcccgacagaggcgaggacgccatcgccgcctgcttcctgatcaactgcctgtacgagcagaacttcgtgtgcaagttcgcccccagagagggcttcatcaactacctgaccagagaggtgtacagaagctacagacagctgagaacccagggcttcggcggcagcggcatccccaaggcctgggccggcatcgacctgaaggtgcagccccaggagcccctggtgctgaaggacgtggagaacaccgactggagactgctgagaggcgacaccgacgtgagagtggagagaaaggaccccaaccaggtggagctgtggggcctgaaggagggcacctacctgttccagctgaccgtgaccagcagcgaccaccccgaggacaccgccaacgtgaccgtgaccgtgctgagcaccaagcagaccgaggactactgcctggccagcaacaaggtgggcagatgcagaggcagcttccccagatggtactacgaccccaccgagcagatctgcaagagcttcgtgtacggcggctgcctgggcaacaagaacaactacctgagagaggaggagtgcatcctggcctgcagaggcgtgcagggcggccccctgagaggcagcagcggcgcccaggccaccttcccccagggccccagcatggagagaagacaccccgtgtgcagcggcacctgccagcccacccagttcagatgcagcaacggctgctgcatcgacagcttcctggagtgcgacgacacccccaactgccccgacgccagcgacgaggccgcctgcgagaagtacaccagcggcttcgacgagctgcagagaatccacttccccagcgacaagggccactgcgtggacctgcccgacaccggcctgtgcaaggagagcatccccagatggtactacaaccccttcagcgagcactgcgccagattcacctacggcggctgctacggcaacaagaacaacttcgaggaggagcagcagtgcctggagagctgcagaggcatcagcaagaaggacgtgttcggcctgagaagagagatccccatccccagcaccggcagcgtggagatggccgtggccgtgttcctggtgatctgcatcgtggtggtggtggccatcctgggctactgcttcttcaagaaccagagaaaggacttccacggccaccaccaccaccccccccccacccccgccagcagcaccgtgagcaccaccgaggacaccgagcacctggtgtacaaccacaccaccagacccctgtag

SEQ ID NO: 4972 - DNA, 528 bp, Artificial Sequence
  Description of Artificial Sequence: Synthetic coding sequence
atgccccccggcaccagagcctgcagagtgcccagacccggcagaagagcccccagacccagaagagacggcgagcccggcggccacggcgtggcccccgccagcgccgaggaggtgggcgccagacccggcctgagagccgtggccagactgctgccccagcagcacctgcaggccggctacgtgtgcgagagaaaggacctgctggtgaacggctgctgcaacgtgaacgtgcccagcaccaagcagtactgctgcgacggctgctggcccaacggctgctgcagcgcctacgagtactgcgtgagctgctgcctgcagcccaacaagcagctgctgctggagagattcctgaacagagccgccgtggccttccagaacctgttcatggccgtggaggaccacttcgagctgtgcctggccaagtgcagaaccagcagccagagcgtgcagcacgagaacacctacagagaccccatcgccaagtactgctacggcgagagcccccccgagctgttccccgcctag

SEQ ID NO: 4973 - DNA, 1881 bp, Artificial Sequence
  Description of Artificial Sequence: Synthetic coding sequence
atggacctggtgctgaagagatgcctgctgcacctggccgtgatcggcgccctgctggccgtgggcgccaccaaggtgcccagaaaccaggactggctgggcgtgagcagacagctgagaaccaaggcctggaacagacagctgtaccccgagtggaccgaggcccagagactggactgctggagaggcggccaggtgagcctgaaggtgagcaacgacggccccaccctgatcggcgccaacgccagcttcagcatcgccctgaacttccccggcagccagaaggtgctgcccgacggccaggtgatctgggtgaacaacaccatcatcaacggcgaccaggtgtggggcggccagcccgtgtacccccaggagaccgacgacgcctgcatcttccccgacggcggcccctgccccagcggcagctggagccagaagagaagcttcgtgtacgtgtggaagacctggggccagtactggcaggtgctgggcggccccgtgagcggcctgagcatcggcaccggcagagccatgctgggcacccacaccatggaggtgaccgtgtaccacagaagaggcagcagaagctacgtgcccctggcccacagcagcagcgccttcaccatcaccgaccaggtgcccttcagcgtgagcgtgagccagctgagagccctggacggcggcaacaagcacttcctgagaaaccagcccctgaccttcgccctgcagctgcacgaccccagcggctacctggccgaggccgacctgagctacacctgggacttcggcgacagcagcggcaccctgatcagcagagccctggtggtgacccacacctacctggagcccggccccgtgaccgcccaggtggtgctgcaggccgccatccccctgaccagctgcggcagcagccccgtgcccggcaccaccgacggccacagacccaccgccgaggcccccaacaccaccgccggccaggtgcccaccaccgaggtggtgggcaccacccccggccaggcccccaccgccgagcccagcggcaccaccagcgtgcaggtgcccaccaccgaggtgatcagcaccgcccccgtgcagatgcccaccgccgagagcaccgccgcccaggtgaccaccaccgagtgggtggagaccaccgccagagagctgcccatccccgagcccgagggccccgacgccagcagcatcatgagcaccgagagcatcaccggcagcctgggccccctgctggacggcaccgccaccctgagactggtgaagagacaggtgcccctggactgcgtgctgtacagatacggcagcttcagcgtgaccctggacatcgtgcagggcatcgagagcgccgagatcctgcaggccgtgcccagcggcgagggcgacgccttcgagctgaccgtgagctgccagggcggcctgcccaaggaggcctgcatggagatcagcagccccggctgccagccccccgcccagagactgtgccagcccgtgctgcccagccccgcctgccagctggtgctgcaccagatcctgaagggcggcagcggcacctactgcctgaacgtgagcctggccgacaccaacagcctggccgtggtgagcacccagctgatcatgcccgtgcccggcatcctgctgaccggccaggaggccggcctgggccaggtgcccctgatcgtgggcatcctgctggtgctgatggccgtggtgctggccagcctgatctacagaagaagactgatgaagcaggacttcagcgtgccccagctgccccacagcagcagccactggctgagactgcccagaatcttctgcagctgccccatcggcgagaacagccccctgctgagcggccagcaggtgtag

SEQ ID NO: 4974 - DNA, 1611 bp, Artificial Sequence
  Description of Artificial Sequence: Synthetic coding sequence
atgcccaccctgtgcagcagcttcggcctgcaggtgctgctgcccgagtacctgagagagagattcgtggccgccgccctgagctacatcacctgcagcagcgagggcgagctggtgtgcaaggagaacgactgctggtgcaagtgcagccccaccttccccgagtgcaactgccccgacgccgacatccaggccatggaggacagcctgctgcagatccaggacagctgggccacccacaacagacagttcgaggagagcgaggagttccaggccctgctgaagagactgcccgacgacagattcctgaacagcaccgccatcagccagttctgggccatggacaccagcctgcagcacagataccagcagctgggcgccggcctgaaggtgctgttcaagaagacccacagaatcctgagaagactgttcaacctgtgcaagagatgccacagacagcccagattcagactgcccaaggagagcagccccagaagcctgagctactggtggaacagaatccagagcctgctgtactgcggcgagagcaccttccccggcaccttcctggagcagagccacagctgcacctgcccctacgaccagagcagctgccagggccccatcccctgcgccctgggcgagggccccgcctgcgcccactgcgcccccgacaacagcaccagatgcggcagctgcaaccccggctacgtgctggcccagggcctgtgcagacccgaggtggccgagagcctggagaacttcctgggcctggagaccgacctgcaggacctggagctgaagtacctgctgcagaagcaggacagcagaatcgaggtgcacagcatcttcatcagcaacgacatgagactgggcagctggttcgaccccagctggagaaagagaatgctgctgaccctgaagagcaacaagtacaagcccggcctggtgcacgtgatgctggccctgagcctgcagatctgcctgaccaagaacagcaccctggagcccgtgatggccatctacgtgaaccccttcggcggcagccacagcgagagctggttcatgcccgtgaacgagggcagcttccccgactgggagagaaccaacgtggacgccgccgcccagtgccagaactggaccatcaccctgggcaacagatggaagaccttcttcgagaccgtgcacgtgtacctgagaagcagaatcaagagcctggacgacagcagcaacgagaccatctactacgagcccctggagatgaccgaccccagcaagaacctgggctacatgaagatcaacaccctgcaggtgttcggctacagcctgcccttcgaccccgacgccatcagagacctgatcctgcagctggactacccctacacccagggcagccaggacagcgccctgctgcagctgatcgagctgagagacagagtgaaccagctgagcccccccggcaaggtgagactggacctgttcagctgcctgctgagacacagactgaagctggccaacaacgaggtgggcagaatccagagcagcctgagagccttcaacagcaagctgcccaaccccgtggagtacgagaccggcaagctgtgcagctag

SEQ ID NO: 4975 - DNA, 423 bp, Artificial Sequence
  Description of Artificial Sequence: Synthetic coding sequence
atgagccagagcatcgaggtgctgaacctgagaacccagagagacttccagtacgtgctgaagatggagacccagatgaagggcctgaaggccaagttcagacagatcgaggacgacagaaagaccctgatgaccaagcacttccaggagctgaaggagaagatggacgagctgctgcccctgatccccgtgctggagcagtacaagaccgacgccaagctgatcacccagttcaaggaggagatcagaaacctgagcgccgtgctgaccggcatccaggaggagatcggcgcctacgactacgaggagctgcaccagagagtgctgagcctggagaccagactgagagactgcatgaagaagctgatcgacctgaagaagagaaaggaggaggagaagagacagcagaagggcgaggcctag

SEQ ID NO: 4976 - DNA, 1119 bp, Artificial Sequence
  Description of Artificial Sequence: Synthetic coding sequence
atggcctacatcgagcagagaagaatcagccacgagggcagccccgtgaagcccgtggccatcagagagttccagaagaccgaggacatgagaagatacctgcaccagaacagagtgcccgccgagcccagcagcctgctgagcctgagcgccagccacaaccagctgagccacaccgacctggagctgcaccagagaagagagcagctggtggagagaaccagaagagaggcccagctggccgccctgcagtacgaggaggagaagatcagaaccaagcagatccagagagacgccgtgctggacttcgtgaagcagaaggccagccagagcccccagaagcagcaccccctgctggacggcgtggacggcgagtgccccttccccagcagaagaagccagcacaccgacgacagcgccctgtgcatgagcctgagcggcctgaaccaggtgggctgcgccgccaccctgccccacagcagcgccttcacccccctgaagagcgacgacagacccaacgccctgctgagcagccccgccaccgagaccgtgcaccacagccccgcctacagcttccccgccgccatccagagaaaccagccccagagacccgagagcttcctgttcagagccggcgtgagagccgagaccaacaagggccacgccagccccctgccccccagcgccgcccccaccaccgacagcaccgacagcatcaccggccagaacagcagacagagagaggaggagctggagctgatcgaccagctgagaaagcacatcgagtacagactgaaggtgagcctgccctgcgacctgggcgccgccctgaccgacggcgtggtgctgtgccacctggccaaccacgtgagacccagaagcgtgcccagcatccacgtgcccagccccgccgtgcccaagctgaccatggccaagtgcagaagaaacgtggagaacttcctggaggcctgcagaaagatcggcgtgccccaggagcagctgtgcctgcccctgcacatcctggaggagaagggcctgagccaggtggccgtgaccgtgcaggccctgctggagctggccccccccaagcagcagcagcaccagctgagcgccgtgtag

SEQ ID NO: 4977 - DNA, 1242 bp, Artificial Sequence; identical to SEQ ID NO: 4070
  Description of Artificial Sequence: Synthetic coding sequence

SEQ ID NO: 4978 - DNA, 2541 bp, Artificial Sequence; identical to SEQ ID NO: 4219
  Description of Artificial Sequence: Synthetic coding sequence

SEQ ID NO: 4979 - DNA, 582 bp, Artificial Sequence
  Description of Artificial Sequence: Synthetic coding sequence
atgctgggcgtgctggagctgctgctgctgggcgccgcctggctggccggccccgccagaggccagaacgagaccgagcccatcgtgctggagggcaagtgcctggtggtgtgcgacagcaaccccaccagcgaccccaccggcaccgccctgggcatcagcgtgagaagcggcagcgccaaggtggccttcagcgccatcagaagcaccaaccacgagcccagcgagatgagcaacagaaccatgatcatctacttcgaccaggtgctggtgaacatcggcaacaacttcgacagcgagagaagcaccttcatcgcccccagaaagggcatctacagcttcaacttccacgtggtgaaggtgtacaacagacagaccatccaggtgagcctgatgctgaacggctggcccgtgatcagcgccttcgccggcgaccaggacgtgaccagagaggccgccagcaacggcgtgctgatccagatggagaagggcgacagagcctacctgaagctggagagaggcaacctgatgggcggctggaagtacagcaccttcagcggcttcctggtgttccccctgtag

SEQ ID NO: 4980 - DNA, 813 bp, Artificial Sequence
  Description of Artificial Sequence: Synthetic coding sequence
atgcacggcagctgcagcttcctgatgctgctgctgcccctgctgctgctgctggtggccaccaccggccccgtgggcgccctgaccgacgaggagaagagactgatggtggagctgcacaacctgtacagagcccaggtgagccccaccgccagcgacatgctgcacatgagatgggacgaggagctggccgccttcgccaaggcctacgccagacagtgcgtgtggggccacaacaaggagagaggcagaagaggcgagaacctgttcgccatcaccgacgagggcatggacgtgcccctggccatggaggagtggcaccacgagagagagcactacaacctgagcgccgccacctgcagccccggccagatgtgcggccactacacccaggtggtgtgggccaagaccgagagaatcggctgcggcagccacttctgcgagaagctgcagggcgtggaggagaccaacatcgagctgctggtgtgcaactacgagccccccggcaacgtgaagggcaagagaccctaccaggagggcaccccctgcagccagtgccccagcggctaccactgcaagaacagcctgtgcgagcccatcggcagccccgaggacgcccaggacctgccctacctggtgaccgaggcccccagcttcagagccaccgaggccagcgacagcagaaagatgggcgccgagggccccgacaagcccagcgtggtgagcggcctgaacagcggccccggccacgtgtggggccccctgctgggcctgctgctgctgccccccctggtgctggccggcatcttctag

SEQ ID NO: 4981 - DNA, 702 bp, Artificial Sequence
  Description of Artificial Sequence: Synthetic coding sequence
atggaccaggtgttcatgatcgacagcaagtgcgagagcggcaagggcagatgcagcttcaaccccaacgtgaacaccgtgagcgtgatgatcaacgaggagctgttcagcggcatgtacatcgacttcatgggcaccgacgccgccatcttcagaagcctgaccaagagaaacgccgtgagaaccgaccagcacaacagcaagtggctgagcgagcccatgttcgtggacgcccacgtgatccccgacggcaccgaccccaacgacgccaaggtgtacttcttcttcaaggagaagctgaccgacaacaacagaagcaccaagcagatccacagcatgatcgccagaatctgccccaacgacaccggcggcctgagaagcctggtgaacaagtggaccaccttcctgaaggccagactggtgtgcagcgtgaccgacgaggacggccccgagacccacttcgacgagctggaggacgtgttcctgctggagaccgacaaccccagaaccaccctggtgtacggcatcttcaccaccagcagcagcgtgttcaagggcagcgccgtgtgcgtgtaccacctgagcgacatccagaccgtgttcaacggccccttcgcccacaaggagggccccaaccaccagctgatcagctaccagggcagaatcccctaccccagacccggcaccaacacctgcgtgtag

SEQ ID NO: 4982 - DNA, 1368 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcatccccacccccagcctggccagcggcctgtggagaaccctgcaggtgggctggaacatgcagctgctgcccgccggcctggccagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcggcgcccagtgcgccaccaaggtgcacttccccttccacacctgcgacctgagaatcgacggcgactgcttcatggtgagcagcgaggccgacacctactacagagccagaatgaagtgccagagaaagggcggcgtgctggcccagatcaagagccagaaggtgcaggacatcctggccttctacctgggcagactggagaccaccaacgaggtgatcgacagcgacttcgagaccagaaacttctggatcggcctgacctacaagaccgccaaggacagcttcagatgggccaccggcgagcaccaggccttcaccagcttcgccttcggccagcccgacaaccacggcctggtgtggctgagcgccgccatgggcttcggcaactgcgtggagctgcaggccagcgccgccttcaactggaacaaccagagatgcaagaccagaaacagatacatctgccagttcgcccaggagcacatcagcagatggggccccggcagctag

SEQ ID NO: 4983 - DNA, 462 bp, Artificial Sequence
  Description of Artificial Sequence: Synthetic coding sequence
atggccagattctgggtgtgcgtggccggcgccggcttcttcctggccttcctggtgctgcacagcagattctgcggcagccccgtgctgagaaacttcaccttcgccgtgagctggagaaccgagaagatcctgtacagactggacgtgggctggcccaagcaccccgagtacttcaccggcaccaccttctgcgtggccgtggacagcctgaacggcctggtgtacatcggccagagaggcgacaacatccccaagatcctggtgttcaccgaggacggctacttcctgagagcctggaactacaccgtggacaccccccacggcatcttcgccgccagcaccctgtacgagcagagcgtgtggatcaccgacgtgggcagcgacttcatgatcctgtggctgcacggcgagaacggcaccggccccgccaagttcaacatcccccacagcgtgacctag

SEQ ID NO: 4984 - DNA, 375 bp, Artificial Sequence
  Description of Artificial Sequence: Synthetic coding sequence
atgtggagatgccccctgggcctgctgctgctgctgcccctggccggccacctggccctgggcgcccagcagggcagaggcagaagagagctggcccccggcctgcacctgagaggcatcagagacgccggcggcagatactgccaggagcaggacctgtgctgcagaggcagagccgacgactgcgccctgccctacctgggcgccatctgctactgcgacctgttctgcaacagaaccgtgagcgactgctgccccgacttctgggacttctgcctgggcgtgcccccccccttcccccccatccaggcccccgccagaagaaccggcagcggcagcgtgaccaagaaccacgcctggtggatccagacctag

SEQ ID NO: 4985 - DNA, 777 bp, Artificial Sequence
  Description of Artificial Sequence: Synthetic coding sequence
atgaagaccctgtacctggccgacaccttccccaccaacttcagagacagcgccggcgccatgaagcagatcaacgactacgtggccaagcagaccaagggcaagatcgtggacctgctgaagaacctggacagcaacgccgtggtgatcatggtgaactacatcttcttcaaggccaagtgggagaccagcttcaaccacaagggcacccaggagcaggacttctacgtgaccagcgagaccgtggtgagagtgcccatgatgagcagagaggaccagtaccactacctgctggacagaaacctgagctgcagagtggtgggcgtgccctaccagggcaacgccaccgccctgttcatcctgcccagcgagggcaagatgcagcaggtggagaacggcctgagcgagaagaccctgagaaagtggctgaagatgttcaagaagagacagctggagctgtacctgcccaagttcagcatcgagggcagctaccagctggagaaggtgctgcccagcctgggcatcagcaacgtgttcaccagccacgccgacctgagcggcatcagcaaccacagcaacatccaggtgagcgagatggtgcacaaggccgtggtggaggtggacgagagcggcaccagagccgccgccgccaccggcaccatcttcaccttcagaagcgccagactgaacagccagagactggtgttcaacagacccttcctgatgttcatcgtggacaacaacatcctgttcctgggcaaggtgaacagaccctag

SEQ ID NO: 4986 - DNA, 1731 bp, Artificial Sequence; identical to SEQ ID NO: 4338
  Description of Artificial Sequence: Synthetic coding sequence

SEQ ID NO: 4987 - DNA, 1359 bp, Artificial Sequence
  Description of Artificial Sequence: Synthetic coding sequence
atggccgacatgcacagaggctacgccgacagccccagcaaggccggcgccgccccctacgtgcaggccttcgacagcctgctggccggccccgtggccgagtacctgaagatcagcaaggagatcggcggcgacgtgcagaagcacgccgagatggtgcacaccggcctgaagctggagagagccctgctggtgaccgccagccagtgccagcagcccgccgagaacaagctgagcgacctgctggcccccatcagcgagcagatcaaggaggtgatcaccttcagagagaagaacagaggcagcaagctgttcaaccacctgagcgccgtgagcgagagcatccaggccctgggctgggtggccatggcccccaagcccggcccctacgtgaaggagatgaacgacgccgccatgttctacaccaacagagtgctgaaggagtacaaggacgtggacaagaagcacgtggactgggtgaaggcctacctgagcatctggaccgagctgcaggcctacatcaaggagttccacaccaccggcctggcctggagcaagaccggccccgtggccaaggagctgagcggcctgcccagcggccccagcgccggcagctgccccccccccccccccccctgccccccccccccccccgtgagcaccatcagctgcagctacgagagcgccagcagaagcagcctgttcgcccagatcaaccagggcgagagcatcacccacgccctgaagcacgtgagcgacgacatgaagacccacaagaaccccgccctgaaggcccagagcggccccgtgagaagcggccccaagcccttcagcgcccccaagccccagaccagccccagccccaagagagccaccaagaaggagcccgccgtgctggagctggagggcaagaagtggagagtggagaaccaggagaacgtgagcaacctggtgatcgaggacaccgagctgaagcaggtggcctacatctacaagtgcgtgaacaccaccctgcagatcaagggcaagatcaacagcatcaccgtggacaactgcaagaagctgggcctggtgttcgacgacgtggtgggcatcgtggagatcatcaacagcaaggacgtgaaggtgcaggtgatgggcaaggtgcccaccatcagcatcaacaagaccgacggctgccacgcctacctgagcaagaacagcctggactgcgagatcgtgagcgccaagagcagcgagatgaacgtgctgatccccaccgagggcggcgacttcaacgagttccccgtgcccgagcagttcaagaccctgtggaacggccagaagctggtgaccaccgtgaccgagatcgccggctag

SEQ ID NO: 4988 - DNA, 1533 bp, Artificial Sequence
  Description of Artificial Sequence: Synthetic coding sequence
atgggcagacccacccagtggcccagcctgctgctgctgctgctgctgcccggccccccccccgtggccggcctggaggacgccgccttcccccacctgggcgagagcctgcagcccctgcccagagcctgccccctgagatgcagctgccccagagtggacaccgtggactgcgacggcctggacctgagagtgttccccgacaacatcaccagagccgcccagcacctgagcctgcagaacaaccagctgcaggagctgccctacaacgagctgagcagactgagcggcctgagaaccctgaacctgcacaacaacctgatcagcagcgagggcctgcccgacgaggccttcgagagcctgacccagctgcagcacctgtgcgtggcccacaacaagctgagcgtggccccccagttcctgcccagaagcctgagagtggccgacctggccgccaaccaggtgatggagatcttccccctgaccttcggcgagaagcccgccctgagaagcgtgtacctgcacaacaaccagctgagcaacgccggcctgccccccgacgccttcagaggcagcgaggccatcgccaccctgagcctgagcaacaaccagctgagctacctgccccccagcctgccccccagcctggagagactgcacctgcagaacaacctgatcagcaaggtgcccagaggcgccctgagcagacagacccagctgagagagctgtacctgcagcacaaccagctgaccgacagcggcctggacgccaccaccttcagcaagctgcacagcctggagtacctggacctgagccacaaccagctgaccaccgtgcccgccggcctgcccagaaccctggccatcctgcacctgggcagaaacagaatcagacaggtggaggccgccagactgcacggcgccagaggcctgagatacctgctgctgcagcacaaccagctgggcagcagcggcctgcccgccggcgccctgagacccctgagaggcctgcacaccctgcacctgtacggcaacggcctggacagagtgccccccgccctgcccagaagactgagagccctggtgctgccccacaaccacgtggccgccctgggcgccagagacctggtggccacccccggcctgaccgagctgaacctggcctacaacagactggccagcgccagagtgcaccacagagccttcagaagactgagagccctgagaagcctggacctggccggcaaccagctgaccagactgcccatgggcctgcccaccggcctgagaaccctgcagctgcagagaaaccagctgagaatgctggagcccgagcccctggccggcctggaccagctgagagagctgagcctggcccacaacagactgagagtgggcgacatcggccccggcacctggcacgagctgcaggccctgcaggtgagacacagactggtgagccacaccgtgcccagagccccccccagcccctgcctgccctgccacgtgcccaacatcctggtgagctggtag

SEQ ID NO: 4989 - DNA, 114 bp, Artificial Sequence
  Description of Artificial Sequence: Synthetic coding sequence
atgaacagcaccctgaacttcttcatccagagctacaacaacgccagcaacgacacctacctgtacagagtgcagagactgatcagaagccagatgcagcaggtgcactgctag

SEQ ID NO: 4990 - DNA, 1266 bp, Artificial Sequence
  Description of Artificial Sequence: Synthetic coding sequence
atgggcagacccacccagtggcccagcctgctgctgctgctgctgctgcccggccccccccccgtggccggcctggaggacgccgccttcccccacctgggcgagagcctgcagcccctgcccagagcctgccccctgagatgcagctgccccagagtggacaccgtggactgcgacggcctggacctgagagtgttccccgacaacatcaccagagccgcccagcacctgagcctgcagaacaaccagctgcaggagctgccctacaacgagctgagcagactgagcggcctgagaaccctgaacctgcacaacaacctgatcagcagcgagggcctgcccgacgaggccttcgagagcctgacccagctgcagcacctgtgcgtggcccacaacaagaacaacctgatcagcaaggtgcccagaggcgccctgagcagacagacccagctgagagagctgtacctgcagcacaaccagctgaccgacagcggcctggacgccaccaccttcagcaagctgcacagcctggagtacctggacctgagccacaaccagctgaccaccgtgcccgccggcctgcccagaaccctggccatcctgcacctgggcagaaacagaatcagacaggtggaggccgccagactgcacggcgccagaggcctgagatacctgctgctgcagcacaaccagctgggcagcagcggcctgcccgccggcgccctgagacccctgagaggcctgcacaccctgcacctgtacggcaacggcctggacagagtgccccccgccctgcccagaagactgagagccctggtgctgccccacaaccacgtggccgccctgggcgccagagacctggtggccacccccggcctgaccgagctgaacctggcctacaacagactggccagcgccagagtgcaccacagagccttcagaagactgagagccctgagaagcctggacctggccggcaaccagctgaccagactgcccatgggcctgcccaccggcctgagaaccctgcagctgcagagaaaccagctgagaatgctggagcccgagcccctggccggcctggaccagctgagagagctgagcctggcccacaacagactgagagtgggcgacatcggccccggcacctggcacgagctgcaggccctgcaggtgagacacagactggtgagccacaccgtgcccagagccccccccagcccctgcctgccctgccacgtgcccaacatcctggtgagctggtag

SEQ ID NO: 4991 - DNA, 993 bp, Artificial Sequence
  Description of Artificial Sequence: Synthetic coding sequence
atgagcagctggagcagacagagacccaagagccccggcggcatccagccccacgtgagcagaaccctgttcctgctgctgctgctggccgccagcgcctggggcgtgaccctgagccccaaggactgccaggtgttcagaagcgaccacggcagcagcatcagctgccagccccccgccgagatccccggctacctgcccgccgacaccgtgcacctggccgtggagttcttcaacctgacccacctgcccgccaacctgctgcagggcgccagcaagctgcaggagctgcacctgagcagcaacggcctggagagcctgagccccgagttcctgagacccgtgccccagctgagagtgctggacctgaccagaaacgccctggtgctgaaggagaaccagctggaggtgctggaggtgagctggctgcacggcctgaaggccctgggccacctggacctgagcggcaacagactgagaaagctgccccccggcctgctggccaacttcaccctgctgagaaccctggacctgggcgagaaccagctggagaccctgccccccgacctgctgagaggccccctgcagctggagagactgcacctggagggcaacaagctgcaggtgctgggcaaggacctgctgctgccccagcccgacctgagatacctgttcctgaacggcaacaagctggccagagtggccgccggcgccttccagggcctgagacagctggacatgctggacctgagcaacaacagcctggccagcgtgcccgagggcctgtgggccagcctgggccagcccaactgggacatgagagacggcttcgacatcagcggcaacccctggatctgcgaccagaacctgagcgacctgtacagatggctgcaggcccagaaggacaagatgttcagccagaacgacaccagatgcgccggccccgaggccgtgaagggccagaccctgctggccgtggccaagagccagtag

SEQ ID NO: 4992 - DNA, 1815 bp, Artificial Sequence; identical to SEQ ID NO: 3505
  Description of Artificial Sequence: Synthetic coding sequence

SEQ ID NO: 4993 - DNA, 948 bp, Artificial Sequence
  Description of Artificial Sequence: Synthetic coding sequence
atgggccaggacagagaggagaccaacatcgagctgctggtgtgcaactacgagccccccggcaacgtgaagggcaagagaccctaccaggagggcaccccctgcagccagtgccccagcggctaccactgcaagaacagcctgtgcgagcccatcggcagccccgaggacgcccaggacctgccctacctggtgaccgaggcccccagcttcagagccaccgaggccagcgacagcagaaagatgggcacccccagcagcctggccaccggcatccccgccttcctggtgaccgaggtgagcggcagcctggccaccaaggccctgcccgccgtggagacccaggcccccaccagcctggccaccaaggacccccccagcatggccaccgaggcccccccctgcgtgaccaccgaggtgcccagcatcctggccgcccacagcctgcccagcctggacgaggagcccgtgaccttccccaagagcacccacgtgcccatccccaagagcgccgacaaggtgaccgacaagaccaaggtgcccagcagaagccccgagaacagcctggaccccaagatgagcctgaccggcgccagagagctgctgccccacgcccaggaggaggccgaggccgaggccgagctgccccccagcagcgaggtgctggccagcgtgttccccgcccaggacaagcccggcgagctgcaggccaccctggaccacaccggccacaccagcagcaagagcctgcccaacttccccaacaccagcgccaccgccaacgccaccggcggcagagccctggccctgcagagcagcctgcccggcgccgagggccccgacaagcccagcgtggtgagcggcctgaacagcggccccggccacgtgtggggccccctgctgggcctgctgctgctgccccccctggtgctggccggcatcttctag

SEQ ID NO: 4994 - DNA, 207 bp, Artificial Sequence
  Description of Artificial Sequence: Synthetic coding sequence
atgcaggtgagcaccgccgccctggccgtgctgctgtgcaccatggccctgtgcaaccaggtgctgagcgcccccctggccgccgacacccccaccgcctgctgcttcagctacaccagcagacagatcccccagaacttcatcgccgactacttcgagaccagcagccagtgcagcaagcccagcgtgatggccgcccccggctag

SEQ ID NO: 4995 - DNA, 3369 bp, Artificial Sequence
  Description of Artificial Sequence: Synthetic coding sequence
atgagcctgcaggagatgttcagattccccatgggcctgctgctgggcagcgtgctgctggtggccagcgcccccgccaccctggagccccccggctgcagcaacaaggagcagcaggtgaccgtgagccacacctacaagatcgacgtgcccaagagcgccctggtgcaggtggacgccgacccccagcccctgagcgacgacggcgccagcctgctggccctgggcgaggccagagaggagcagaacatcatcttcagacacaacatcagactgcagaccccccagaaggactgcgagctggccggcagcgtgcaggacctgctggccagagtgaagaagctggaggaggagatggtggagatgaaggagcagtgcagcgcccagagatgctgccagggcgtgaccgacctgagcagacactgcagcggccacggcaccttcagcctggagacctgcagctgccactgcgaggagggcagagagggccccgcctgcgagagactggcctgccccggcgcctgcagcggccacggcagatgcgtggacggcagatgcctgtgccacgagccctacgtgggcgccgactgcggctaccccgcctgccccgagaactgcagcggccacggcgagtgcgtgagaggcgtgtgccagtgccacgaggacttcatgagcgaggactgcagcgagaagagatgccccggcgactgcagcggccacggcttctgcgacaccggcgagtgctactgcgaggagggcttcaccggcctggactgcgcccaggtggtgaccccccagggcctgcagctgctgaagaacaccgaggacagcctgctggtgagctgggagcccagcagccaggtggaccactacctgctgagctactaccccctgggcaaggagctgagcggcaagcagatccaggtgcccaaggagcagcacagctacgagatcctgggcctgctgcccggcaccaagtacatcgtgaccctgagaaacgtgaagaacgaggtgagcagcagcccccagcacctgctggccaccaccgacctggccgtgctgggcaccgcctgggtgaccgacgagaccgagaacagcctggacgtggagtgggagaaccccagcaccgaggtggactactacaagctgagatacggccccatgaccggccaggaggtggccgaggtgaccgtgcccaagagcagcgaccccaagagcagatacgacatcaccggcctgcaccccggcaccgagtacaagatcaccgtggtgcccatgagaggcgagctggagggcaagcccatcctgctgaacggcagaaccgagatcgacagccccaccaacgtggtgaccgacagagtgaccgaggacaccgccaccgtgagctgggaccccgtgcaggccgtgatcgacaagtacgtggtgagatacaccagcgccgacggcgacaccaaggagatggccgtgcacaaggacgagagcagcaccgtgctgaccggcctgaagcccggcgaggcctacaaggtgtacgtgtgggccgagagaggcaaccagggcagcaagaaggccgacaccaacgccctgaccgagatcgacagccccgccaacctggtgaccgacagagtgaccgagaacaccgccaccatcagctgggaccccgtgcaggccaccatcgacagatacgtggtgagatacaccagcgccaaggacggcgagaccagagaggtgcccgtgggcaaggagcagagcagcaccgtgctgaccggcctgagacccggcgtggagtacaccgtgcacgtgtgggcccagaagggcgcccaggagagcaagaaggccgacaccaaggcccagaccgacatcgacagcccccagaacctggtgaccgactgggtgaccgagaacaccgccaccgtgagctgggaccccgtgcaggccaccatcgacagatacgtggtgcactacaccagcgccaacggcgagaccagagaggtgcccgtgggcaaggagcagagcagcaccgtgctgaccggcctgagacccggcatggagtacaccgtgcacgtgtgggcccagaagggcaaccaggagagcaagaaggccgacaccaaggcccagaccgagatcgacggccccaagaacctggtgaccgactgggtgaccgagaacatggccaccgtgagctgggaccccgtgcaggccaccatcgacaagtacatggtgagatacaccagcgccgacggcgagaccagagaggtgcccgtgggcaaggagcacagcagcaccgtgctgaccggcctgagacccggcatggagtacatggtgcacgtgtgggcccagaagggcgcccaggagagcaagaaggccgacaccaaggcccagaccgagctggacccccccagaaacctgagacccagcgccgtgacccagagcggcggcatcctgacctggaccccccccagcgcccagatccacggctacatcctgacctaccagttccccgacggcaccgtgaaggagatgcagctgggcagagaggaccagagattcgccctgcagggcctggagcagggcgccacctaccccgtgagcctggtggccttcaagggcggcagaagaagcagaaacgtgagcaccaccctgagcaccgtgggcgccagattcccccaccccagcgactgcagccaggtgcagcagaacagcaacgccgccagcggcctgtacaccatctacctgcacggcgacgccagcagacccctgcaggtgtactgcgacatggagaccgacggcggcggctggatcgtgttccagagaagaaacaccggccagctggacttcttcaagagatggagaagctacgtggagggcttcggcgaccccatgaaggagttctggctgggcctggacaagctgcacaacctgaccaccggcacccccgccagatacgaggtgagagtggacctgcagaccgccaacgagagcgcctacgccatctacgacttcttccaggtggccagcagcaaggagagatacaagctgaccgtgggcaagtacagaggcaccgccggcgacgccctgacctaccacaacggctggaagttcaccaccttcgacagagacaacgacatcgccctgagcaactgcgccctgacccaccacggcggctggtggtacaagaactgccacctggccaaccccaacggcagatacggcgagaccaagcacagcgagggcgtgaactgggagccctggaagggccacgagttcagcatcccctacgtggagctgaagatcagaccccacggctacagcagagagcccgtgctgggcagaaagaagagaaccctgagaggcagactgagaaccttctag

SEQ ID NO: 4996 - DNA, 897 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctgaactggctgaagcccggccccctgtggaaccccaaccccgagcccggcgtgagacccgtggcccaccccgccagcggcctggagcacgccgcctgccccagagcctggagacccctgctgaagtggagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacgagcccagcgtgccccccagatgcatcttccccagcacccccgtgacctag

SEQ ID NO: 4997 - DNA, 1728 bp, Artificial Sequence
  Description of Artificial Sequence: Synthetic coding sequence
atggacctggtgctgaagagatgcctgctgcacctggccgtgatcggcgccctgctggccgtgggcgccaccaagggcagccaggtgtggggcggccagcccgtgtacccccaggagaccgacgacgcctgcatcttccccgacggcggcccctgccccagcggcagctggagccagaagagaagcttcgtgtacgtgtggaagacctggggccagtactggcaggtgctgggcggccccgtgagcggcctgagcatcggcaccggcagagccatgctgggcacccacaccatggaggtgaccgtgtaccacagaagaggcagcagaagctacgtgcccctggcccacagcagcagcgccttcaccatcaccgaccaggtgcccttcagcgtgagcgtgagccagctgagagccctggacggcggcaacaagcacttcctgagaaaccagcccctgaccttcgccctgcagctgcacgaccccagcggctacctggccgaggccgacctgagctacacctgggacttcggcgacagcagcggcaccctgatcagcagagccctggtggtgacccacacctacctggagcccggccccgtgaccgcccaggtggtgctgcaggccgccatccccctgaccagctgcggcagcagccccgtgcccggcaccaccgacggccacagacccaccgccgaggcccccaacaccaccgccggccaggtgcccaccaccgaggtggtgggcaccacccccggccaggcccccaccgccgagcccagcggcaccaccagcgtgcaggtgcccaccaccgaggtgatcagcaccgcccccgtgcagatgcccaccgccgagagcaccggcatgacccccgagaaggtgcccgtgagcgaggtgatgggcaccaccctggccgagatgagcacccccgaggccaccggcatgacccccgccgaggtgagcatcgtggtgctgagcggcaccaccgccgcccaggtgaccaccaccgagtgggtggagaccaccgccagagagctgcccatccccgagcccgagggccccgacgccagcagcatcatgagcaccgagagcatcaccggcagcctgggccccctgctggacggcaccgccaccctgagactggtgaagagacaggtgcccctggactgcgtgctgtacagatacggcagcttcagcgtgaccctggacatcgtgcagggcatcgagagcgccgagatcctgcaggccgtgcccagcggcgagggcgacgccttcgagctgaccgtgagctgccagggcggcctgcccaaggaggcctgcatggagatcagcagccccggctgccagccccccgcccagagactgtgccagcccgtgctgcccagccccgcctgccagctggtgctgcaccagatcctgaagggcggcagcggcacctactgcctgaacgtgagcctggccgacaccaacagcctggccgtggtgagcacccagctgatcatgcccggccaggaggccggcctgggccaggtgcccctgatcgtgggcatcctgctggtgctgatggccgtggtgctggccagcctgatctacagaagaagactgatgaagcaggacttcagcgtgccccagctgccccacagcagcagccactggctgagactgcccagaatcttctgcagctgccccatcggcgagaacagccccctgctgagcggccagcaggtgtag

SEQ ID NO: 4998 - DNA, 330 bp, Artificial Sequence
  Description of Artificial Sequence: Synthetic coding sequence
tgaagcggccagagcctgaagagcctgaacgccagcagcggccacctggccctgatcctgagcagcatcttcggcctgctgctgctggtgctgttcatcctgttcctgacctggtgcagagtgcagaagcagaagcacctgcccctgagagtgagcaccagaagaagaggcagcctggaggagaacctgttccacgagatggagacctgcctgaagagagaggacccccacggcaccagaaccagcgacgacacccccaaccacggctgcgaggacgccagcgacaccagcctgctgggcgtgctgcccgccagcgaggccaccaagtag

SEQ ID NO: 4999 - DNA, 312 bp, Artificial Sequence; identical to SEQ ID NO: 3978
  Description of Artificial Sequence: Synthetic coding sequence

SEQ ID NO: 5000 - DNA, 2889 bp, Artificial Sequence; identical to SEQ ID NO: 4187
  Description of Artificial Sequence: Synthetic coding sequence

SEQ ID NO: 5001 - DNA, 912 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccaggccagagccgccctgtgcggcacccccacccccagcctggccagcggcctgtggagaaccctgcaggtgggctggaacatgcagctgctgcccgccggcctggtgagcttcgtggaggtggtgagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacggcgagcccagcgtgccccccagatgcatcttccccagcacccccgtgacctag

SEQ ID NO: 5002 - DNA, 1356 bp, Artificial Sequence
  Description of Artificial Sequence: Synthetic coding sequence
atggaggccaccggcaccgacgaggtggacaagctgaagaccaagttcatcagcgcctggaacaacatgaagtacagctgggtgctgaagaccaagacctacttcagcagaaacagccccgtgctgctgctgggcaagtgctaccacttcaagtacgaggacgaggacaagaccctgcccgccgagagcggctgcaccatcgaggaccacgtgatcgccggcaacgtggaggagttcagaaaggacttcatcagcagaatctggctgacctacagagaggagttcccccagatcgagggcagcgccctgaccaccgactgcggctggggctgcaccctgagaaccggccagatgctgctggcccagggcctgatcctgcacttcctgggcagagcctggacctggcccgacgccctgaacatcgagaacagcgacagcgagagctggaccagccacaccgtgaagaagttcaccgccagcttcgaggccagcctgagcggcgagagagagttcaagacccccaccatcagcctgaaggagaccatcggcaagtacagcgacgaccacgagatgagaaacgaggtgtaccacagaaagatcatcagctggttcggcgacagccccctggccctgttcggcctgcaccagctgatcgagtacggcaagaagagcggcaagaaggccggcgactggtacggccccgccgtggtggcccacatcctgagaaaggccgtggaggaggccagacaccccgacctgcagggcatcaccatctacgtggcccaggactgcaccgtgtacaacagcgacgtgatcgacaagcagagcgccagcatgaccagcgacaacgccgacgacaaggccgtgatcatcctggtgcccgtgagactgggcggcgagagaaccaacaccgactacctggagttcgtgaagggcatcctgagcctggagtactgcgtgggcatcatcggcggcaagcccaagcagagctactacttcgccggcttccaggacgacagcctgatctacatggacccccactactgccagagcttcgtggacgtgagcatcaaggacttccccctggagaccttccactgccccagccccaagaagatgagcttcagaaagatggaccccagctgcaccatcggcttctactgcagaaacgtgcaggacttcaagagagccagcgaggagatcaccaagatgctgaagttcagcagcaaggagaagtaccccctgttcaccttcgtgaacggccacagcagagactacgacttcaccagcaccaccaccaacgaggaggacctgttcagcgaggacgagaagaagcagaagaagaagaagaagtag

SEQ ID NO: 5003 - DNA, 1557 bp, Artificial Sequence
  Description of Artificial Sequence: Synthetic coding sequence
atgagaacctgggactacagatggagcctggccctggtggcccagaccggcgtgcactgctgcaacctgagcagcctgcagcccctgccccccagattcaagagattcagctgcctgagcctgagcagcggctgggactacagcaacagcggcaacatgaagccccccctgctggtgttcatcgtgtgcctgctgtggctgaaggacagccactgcgcccccacctggaaggacaagaccgccatcagcgagaacctgaagagcttcagcgaggtgggcgagatcgacgccgacgaggaggtgaagaaggccctgaccggcatcaagcagatgaagatcatgatggagagaaaggagaaggagcacaccaacctgatgagcaccctgaagaagtgcagagaggagaagcaggaggccctgaagctgctgaacgaggtgcaggagcacctggaggaggaggagagactgtgcagagagagcctggccgacagctggggcgagtgcagaagctgcctggagaacaactgcatgagaatctacaccacctgccagcccagctggagcagcgtgaagaacaagatcgagagattcttcagaaagatctaccagttcctgttccccttccacgaggacaacgagaaggacctgcccatcagcgagaagctgatcgaggaggacgcccagctgacccagatggaggacgtgttcagccagctgaccgtggacgtgaacagcctgttcaacagaagcttcaacgtgttcagacagatgcagcaggagttcgaccagaccttccagagccacttcatcagcgacaccgacctgaccgagccctacttcttccccgccttcagcaaggagcccatgaccaaggccgacctggagcagtgctgggacatccccaacttcttccagctgttctgcaacttcagcgtgagcatctacgagagcgtgagcgagaccatcaccaagatgctgaaggccatcgaggacctgcccaagcaggacaaggcccccgaccacggcggcctgatcagcaagatgctgcccggccaggacagaggcctgtgcggcgagctggaccagaacctgagcagatgcttcaagttccacgagaagtgccagaagtgccaggcccacctgagcgaggactgccccgacgtgcccgccctgcacaccgagctggacgaggccatcagactggtgaacgtgagcaaccagcagtacggccagatcctgcagatgaccagaaagcacctggaggacaccgcctacctggtggagaagatgagaggccagttcggctgggtgagcgagctggccaaccaggcccccgagaccgagatcatcttcaacagcatccaggtggtgcccagaatccacgagggcaacatcagcaagcaggacgagaccatgatgaccgacctgagcatcctgcccagcagcaacttcaccctgaagatccccctggaggagagcgccgagagcagcaacttcatcggctacgtggtggccaaggccctgcagcacttcaaggagcacttcaagacctggtag

SEQ ID NO: 5004 - DNA, 1716 bp, Artificial Sequence
  Description of Artificial Sequence: Synthetic coding sequence
gtggagatgagaaagtggagcagcgagcccggccccgagcccgacaccgtggaggccgtgatcgagtacatgtacaccggcagaatcagagtgagcaccggcagcgtgcacgaggtgctggagctggccgacagattcctgctgatcagactgaaggagttctgcggcgagttcctgaagaagaagctgcacctgagcaactgcgtggccatccacagcctggcccacatgtacaccctgagccagctggccctgaaggccgccgacatgatcagaagaaacttccacaaggtgatccaggacgaggagttctacaccctgcccttccacctgatcagagactggctgagcgacctggagatcaccgtggacagcgaggaggtgctgttcgagaccgtgctgaagtgggtgcagagaaacgccgaggagagagagagatacttcgaggagctgttcaagctgctgagactgagccagatgaagcccacctacctgaccagacacgtgaagcccgagagactggtggccaacaacgaggtgtgcgtgaagctggtggccgacgccgtggagagacacgccctgagagccgagaacatccagagcggcacctgccagcaccccaccagccacgtgagcctgctgcccagatacggccagaacatggacgtgatcatggtgatcggcggcgtgagcgagggcggcgactacctgagcgagtgcgtgggctacttcgtggacgaggacagatgggtgaacctgccccacatccacaaccacctggacggccacgccgtggccgtgaccgagagctacgtgtacgtggccggcagcatggagcccggcttcgccaagaccgtggagagatacaaccccaacctgaacacctgggagcacgtgtgcagcctgatgaccagaaagcacagcttcggcctgaccgaggtgaagggcaagctgtacagcatcggcggccacggcaacttcagccccggcttcaaggacgtgaccgtgtacaaccccgagctggacaagtggcacaacctggagagcgcccccaagatcctgagagacgtgaaggccctggccatcgaggacagattcgtgtacatcgccgccagaacccccgtggacagagacaccgaggacggcctgaaggccgtgatcacctgctacgacaccgagaccagacagtggcaggacgtggagagcctgcccctgatcgacaactactgcttcttccagatgagcgtggtgaacagcaacttctaccagaccgccagctgctgccccaagagctactgcctggagaacgaggaggccgtgagaaagatcgccagccaggtgagcgacgagatcctggagagcctgccccccgaggtgctgagcatcgagggcgccgccatctgctactacaaggacgacgtgttcatcatcggcggctggaagaacagcgacgacatcgacaagcagtacagaaaggaggcctacagatactgcgccgagagaaagagatggatgctgctgccccccatgccccagcccagatgcagagccaccgcctgccacgtgagaatcccctacagatacctgcacggcacccagagataccccatgccccagaacctgatgtggcagaaggacagaatcagacagatgcaggagatccacagacacgccctgaacatgagaagagtgcccagcagccagatcgagtgctag

SEQ ID NO: 5005 - DNA, 729 bp, Artificial Sequence
  Description of Artificial Sequence: Synthetic coding sequence
atgctgaagaagatcagcgtgggcgtggccggcgacctgaacaccgtgaccatgaagctgggctgcgtgctgatggcctgggccctgtacctgagcctgggcgtgctgtgggtggcccagatgctgctggccgccggctgccacgccgagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 5006 - DNA, 1392 bp, Artificial Sequence
  Description of Artificial Sequence: Synthetic coding sequence
atgtacgtgagcaccagagagagatacaagtggctgagattcagcgaggactgcctgtacctgaacgtgtacgcccccgccagagcccccggcgacccccagctgcccgtgatggtgtggttccccggcggcgccttcatcgtgggcgccgccagcagctacgagggcagcgacctggccgccagagagaaggtggtgctggtgttcctgcagcacagactgggcatcttcggcttcctgagcaccgacgacagccacgccagaggcaactggggcctgctggaccagatggccgccctgagatgggtgcaggagaacatcgccgccttcggcggcgaccccggcaacgtgaccctgttcggccagagcgccggcgccatgagcatcagcggcctgatgatgagccccctggccagcggcctgttccacagagccatcagccagagcggcaccgccctgttcagactgttcatcaccagcaaccccctgaaggtggccaagaaggtggcccacctggccggctgcaaccacaacagcacccagatcctggtgaactgcctgagagccctgagcggcaccaaggtgatgagagtgagcaacaagatgagattcctgcagctgaacttccagagagaccccgaggagatcatctggagcatgagccccgtggtggacggcgtggtgatccccgacgaccccctggtgctgctgacccagggcaaggtgagcagcgtgccctacctgctgggcgtgaacaacctggagttcaactggctgctgccctacatcatgaagttccccctgaacagacaggccatgagaaaggagaccatcaccaagatgctgtggagcaccagaaccctgctgaacatcaccaaggagcaggtgcccctggtggtggaggagtacctggacaacgtgaacgagcacgactggaagatgctgagaaacagaatgatggacatcgtgcaggacgccaccttcgtgtacgccaccctgcagaccgcccactaccacagagacgccggcctgcccgtgtacctgtacgagttcgagcaccacgccagaggcatcatcgtgaagcccagaaccgacggcgccgaccacggcgacgagatgtacttcctgttcggcggccccttcgccaccggcctgagcatgggcaaggagaaggccctgagcctgcagatgatgaagtactgggccaacttcgccagaaccggcaaccccaacgacggcaacctgccctgctggcccagatacaacaaggacgagaagtacctgcagctggacttcaccaccagagtgggcatgaagctgaaggagaagaagatggccttctggatgagcctgtaccagagccagagacccgagaagcagagacagttctag

SEQ ID NO: 5007 - DNA, 1215 bp, Artificial Sequence
  Description of Artificial Sequence: Synthetic coding sequence
atgttctaccacgcctacgacagctacctggagaacgccttccccttcgacgagctgagacccctgacctgcgacggccacgacacctggggcagcttcagcctgaccctgatcgacgccctggacaccctgctgatcctgggcaacgtgagcgagttccagagagtggtggaggtgctgcaggacagcgtggacttcgacatcgacgtgaacgccagcgtgttcgagaccaacatcagagtggtgggcggcctgctgagcgcccacctgctgagcaagaaggccggcgtggaggtggaggccggctggccctgcagcggccccctgctgagaatggccgaggaggccgccagaaagctgctgcccgccttccagacccccaccggcatgccctacggcaccgtgaacctgctgcacggcgtgaaccccggcgagacccccgtgacctgcaccgccggcatcggcaccttcatcgtggagttcgccaccctgagcagcctgaccggcgaccccgtgttcgaggacgtggccagagtggccctgatgagactgtgggagagcagaagcgacatcggcctggtgggcaaccacatcgacgtgctgaccggcaagtgggtggcccaggacgccggcatcggcgccggcgtggacagctacttcgagtacctggtgaagggcgccatcctgctgcaggacaagaagctgatggccatgttcctggagtacaacaaggccatcagaaactacaccagattcgacgactggtacctgtgggtgcagatgtacaagggcaccgtgagcatgcccgtgttccagagcctggaggcctactggcccggcctgcagagcctgatcggcgacatcgacaacgccatgagaaccttcctgaactactacaccgtgtggaagcagttcggcggcctgcccgagttctacaacatcccccagggctacaccgtggagaagagagagggctaccccctgagacccgagctgatcgagagcgccatgtacctgtacagagccaccggcgaccccaccctgctggagctgggcagagacgccgtggagagcatcgagaagatcagcaaggtggagtgcggcttcgccaccgtgagcgtgtgcatggcccccagaaccggcaagagcctgcccctgctgctgaagagcctgttcaagggcagagccctgggcgtgctgacctaccagcactag

SEQ ID NO: 5008 - DNA, 1281 bp, Artificial Sequence
  Description of Artificial Sequence: Synthetic coding sequence
atgggctggaccgacaccctggagagcgccgaggacatcttctggaagcaggccgacttcggctacgccagagagagactggaggagatgcacgtgctgtgccagcccaaggagaccagcgacagcagcctggtgtgcagcagatacctgcagtactgcagagccaccaacctgtacctggacctgagaaacatcaagagaaaccacgacagattcaaggaggacttcttccagagcggcgagatcggcggccactgcaagctggacatcagaaccctgaccagcgagggccagagaaagagccccctgcagagctggttcgccgagctgcagagctacacccagctgaacttcagacccatcgaggacgccaagtgcgacatcgtgatcgagaagcccacctacttcatgaagctggacgccggcgtgaacatgtaccaccacttctgcgacttcatcaacctgtacatcacccagcacgtgaacaacagcttcagcaccgacgtgtacatcgtgatgtgggacaccagcagctacggctacggcgacctgttcagcgacacctggaacgccttcaccgactacgacgtgatccacctgaagacctacgacagcaagagagtgtgcttcaaggaggccgtgttcagcctgctgcccagaatgagatacggcctgttctacaacacccccctgatcagcggctgccagaacaccggcctgttcagagccttcgcccagcacgtgctgcacagactgaacatcacccaggagggccccaaggacggcaagatcagagtgaccatcctggccagaagcaccgagtacagaaagatcctgaaccagaacgagctggtgaacgccctgaagaccgtgagcaccttcgaggtgcagatcgtggactacaagtacagagagctgggcttcctggaccagctgagaatcacccacaacaccgacatcttcatcggcatgcacggcgccggcctgacccacctgctgttcctgcccgactgggccgccgtgttcgagctgtacaactgcgaggacgagagatgctacctggacctggccagactgagaggcgtgcactacatcacctggagaagacagaacaaggtgttcccccaggacaagggccaccaccccaccctgggcgagcaccccaagttcaccaactacagcttcgacgtggaggagttcatgtacctggtgctgcaggccgccgaccacgtgctgcagcaccccaagtggcccttcaagaagaagcacgacgagctgtag

SEQ ID NO: 5009 - DNA, 1098 bp, Artificial Sequence
  Description of Artificial Sequence: Synthetic coding sequence
atgaagctgggctgcgtgctgatggcctgggccctgtacctgagcctgggcgtgctgtgggtggcccagatgctgctggtggccagcagcttcagcgccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacgactggctgatcctgcagggccccgccaagcccgtgttcgagggcgacctgctggtgctgagatgccaggcctggcaggactggcccctgacccaggtgaccttctacagagacggcagcgccctgggcccccccggccccaacagagagttcagcatcaccgtggtgcagaaggccgacagcggccactaccactgcagcggcatcttccagagccccggccccggcatccccgagaccgccagcgtggtggccatcaccgtgcaggagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 5010 - DNA, 1407 bp, Artificial Sequence
  Description of Artificial Sequence: Synthetic coding sequence
atgagatggatcctgtgctggagcctgaccctgtgcctgatggcccagaccgccctgggcgccctgcacaccaagagaccccaggtggtgaccaagtacggcaccctgcagggcaagcagatgcacgtgggcaagacccccatccaggtgttcctgggcgtgcccttcagcagaccccccctgggcatcctgagattcgccccccccgagccccccgagccctggaagggcatcagagacgccaccacctacccccccggctgcctgcaggagagctggggccagctggccagcatgtacgtgagcaccagagagagatacaagtggctgagattcagcgaggactgcctgtacctgaacgtgtacgcccccgccagagcccccggcgacccccagctgcccgtgatggtgtggttccccggcggcgccttcatcgtgggcgccgccagcagctacgagggcagcgacctggccgccagagagaaggtggtgctggtgttcctgcagcacagactgggcatcttcggcttcctgagcaccgacgacagccacgccagaggcaactggggcctgctggaccagatggccgccctgagatgggtgcaggagaacatcgccgccttcggcggcgaccccggcaacgtgaccctgttcggccagagcgccggcgccatgagcatcagcggcctgatgatgagccccctggccagcggcctgttccacagagccatcagccagagcggcaccgccctgttcagactgttcatcaccagcaaccccctgaaggtggccaagaaggtggcccacctggccggctgcaaccacaacagcacccagatcctggtgaactgcctgagagccctgagcggcaccaaggtgatgagagtgagcaacaagatgagattcctgcagctgaacttccagagagaccccgaggagatcatctggagcatgagccccgtggtggacggcgtggtgatccccgacgaccccctggtgctgctgacccagggcaaggtgagcagcgtgccctacctgctgggcgtgaacaacctggagttcaactggctgctgccctacatcatgaagttccccctgaacagacaggccatgagaaaggagaccatcaccaagatgctgtggagcaccagaaccctgctgaacatcaccaaggagcaggtgcccctggtggtggaggagtacctggacaacgtgaacgagcacgactggaagatgctgagaaacagaatgatggacatcgtgcaggacgccaccttcgtgtacgccaccctgcagaccgcccactaccacagagagacccccatgatgggcatctgccccgccggccacgccaccaccagaatgaagagcacctgcagctggatcctgccccaggagtgggcctag

SEQ ID NO: 5011 - DNA, 756 bp, Artificial Sequence
  Description of Artificial Sequence: Synthetic coding sequence
atgagcagctacggctacggcgacctgttcagcgacacctggaacgccttcaccgactacgacgtgatccacctgaagacctacgacagcaagagagtgtgcttcaaggaggccgtgttcagcctgctgcccagaatgagatacggcctgttctacaacacccccctgatcagcggctgccagaacaccggcctgttcagagccttcgcccagcacgtgctgcacagactgaacatcacccaggagggccccaaggacggcaagatcagagtgaccatcctggccagaagcaccgagtacagaaagatcctgaaccagaacgagctggtgaacgccctgaagaccgtgagcaccttcgaggtgcagatcgtggactacaagtacagagagctgggcttcctggaccagctgagaatcacccacaacaccgacatcttcatcggcatgcacggcgccggcctgacccacctgctgttcctgcccgactgggccgccgtgttcgagctgtacaactgcgaggacgagagatgctacctggacctggccagactgagaggcgtgcactacatcacctggagaagacagaacaaggtgttcccccaggacaagggccaccaccccaccctgggcgagcaccccaagttcaccaactacagcttcgacgtggaggagttcatgtacctggtgctgcaggccgccgaccacgtgctgcagcaccccaagtggcccttcaagaagaagcacgacgagctgtag

SEQ ID NO: 5012 - DNA, 927 bp, Artificial Sequence
  Description of Artificial Sequence: Synthetic coding sequence
atgatccccgtggagctgctgctgtgctacctgctgctgcaccccgtggacgccaccagctacggcaagcagaccaacgtgctgatgcacttccccctgagcctggagagccagacccccagcagcgaccccctgagctgccagttcctgcaccccaagagcctgcccggcttcagccacatggcccccctgcccaagttcctggtgagcctggccctgagaaacgccctggaggaggccggctgccaggccgacgtgtgggccctgcagctgcagctgtacagacagggcggcgtgaacgccacccaggtgctgatccagcacctgagaggcctgcagaagggcagaagcaccgagagaaacgtgagcgtggaggccctggccagcgccctgcagctgctggccagagagcagcagagcaccggcagagtgggcagaagcctgcccaccgaggactgcgagaacgagaaggagcaggccgtgcacaacgtggtgcagctgctgcccggcgtgggcaccttctacaacctgggcaccgccctgtactacgccacccagaactgcctgggcaaggccagagagagaggcagagacggcgccatcgacctgggctacgacctgctgatgaccatggccggcatgagcggcggccccatgggcctggccatcagcgccgccctgaagcccgccctgagaagcggcgtgcagcagctgatccagtactaccaggaccagaaggacgccaacatcagccagcccgagaccaccaaggagggcctgagagccatcagcgacgtgagcgacctggaggagaccaccaccctggccagcttcatcagcgaggtggtgagcagcgccccctactggggctgggccatcatcaagagctacgacctggaccccggcgccggcagcctggagatctag

SEQ ID NO: 5013 - DNA, 2862 bp, Artificial Sequence
  Description of Artificial Sequence: Synthetic coding sequence
atgagagtgctggcctgcctgctggccgccctggtgggcatccaggccgtggagagactgagactggccgacggcccccacggctgcgccggcagactggaggtgtggcacggcggcagatggggcaccgtgtgcgacgacggctgggacctgagagacgccgccgtggcctgcagacagctgggctgcggcggcgccctggccgcccccggcggcgccttcttcggcgagggcgccggccccgtgtggctgagcgagctggcctgcagaggcaacgagggccagctgggcctgtgccaccacagaggctggaaggcccacatctgcagccacgaggaggacgccggcgtggtgtgcgccggccagagagtggccaacagcagagacgacagcaccagccccctggacggcgccccctggcccggcctgctgctggagctgagccccagcaccgaggagcccctggtgacccacgcccccagacccgccggcaacccccagaacgccagcagaaagaagagccccagacccaagcaggccaagagcaccagagcccccctgctgaccaccggcgcccccagacaggagagactgagactggtgagcggcccccacagatgcgccggcagactggaggtgtggcacggcggcagatggggcaccgtgtgcgacgacggctgggacctgagagacgccgccgtggcctgcagagagctgggctgcggcggcgccctggccgcccccggcggcgccagattcggccccggcgccggccccgtgtggatggacgacgtgggctgcggcggcggcgagcaggccctgagagactgccccagaagcccctggggcagaagcaactgcgaccacagcgaggacgccggcctggtgtgcaccggccccgcccccagactgagactggccgacggcccccacggctgcgccggcagactggaggtgtggcacggcggcagatggggcagcgtgtgcgacgacgcctgggacctgagagacgccgccgtggcctgcagagagctgggctgcggcggcgccctggccgcccccggcggcgccttcttcggcgagggcagcggccccatcatcctggacgacctgagatgcagaggcaacgagaccgccctgagattctgccccgccagaccctggggccagcacgactgccaccacagagaggacgccggcgccgtgtgcgacggcatgcccctgggctacgtgccccccaccgcccccaccgacagcaacaacagcacccccagagaggccgccagcagaccccccagcaccatgaccagccaggcccccggcaccgccggcgtgagccccccccccgccagccccaccgtgctgtgggagcccggccccgaggccggcagcccccagctgagactggtggccggccccagcaagtgcagcggcagactggaggtgtggcacgaccagagatggggcaccgtgtgcgacgacagctgggacatgagagacagcgccgtggtgtgcagagagctgggctgcggcggcccccagcagcccgaccccgccgccggcagattcggctggggcgccggccccatctggctggacgacgtgggctgcgtgggcaccgaggccagcctgagcgactgccccgccgccccctggggcaagcacaactgcgcccacaacgaggacgtgggcgtgacctgcaccggcccccccggcctggacagcatcagcgaccccttcagctggagctggatccccggcctgggcagagacagagacgcctggctgcccggcgagctggccaccaagcccagcgccagcgtgaccgccagcgtgctggagaagaccaccaccaaggcccccggcaagatgcccaagagcaccaagaagtgggtgaccaagaacgccaagagacccaccacccagccccccgtgatgcccaccaccaagcacagcagagcccagagcccccccgacctgaccagccagaccaccgccgccctgaccaccgaggccagcagaagacccaccagcgagttcaccagaagacccaccaccgaggccccccagagatggaccagccacaccaccgccaccctgaccccccaggcccccagagagagaaccaccaagaccatggccatgctgaccacccagggcccccaggagatgaccagcgagagcaccatcaagagcatcccccaggccagcctggagcccagcgccgagatccccgagggcagccccgagagccccaaggaccccgcccccagccccagcgtgagcaccaccggcgagagcggcctgttcagagtgagactggccgacggccccaacagatgcgccggcagactggaggtgtggcacgccggcagatggggcaccgtgtgcgacgacaactgggacctgagagacgccaccgtggcctgctgggagctgggctgcggcaaggtgagacccagagtgggcaagacccactacggccccggcaccggccccatctggctggacgacatgggctgcaagggcagcgaggccagcctgagcgactgccccagcggcgcctggggcaagcacaactgcgaccacgaggaggacgtgggcctgacctgcaccggctacaccgactacgacgactaccccccctggacctgggaccccaccagcagagaggacctggccaagggcaccaccaccgccggcgtgcccggccacaccctgccctggagaaccaccagaagacccggcagcagcagccccgccatcagaagactgcccgacaccgagcccgaggccggcctgagagaggtgatgctgctggtgcagggcctgcccggcctgcagagactgcccagcccctag

SEQ ID NO: 5014 - DNA, 474 bp, Artificial Sequence
  Description of Artificial Sequence: Synthetic coding sequence
atgctgagaaccgagagctgcagacccagaagccccgccggccaggtggccgccgccagccccctgctgctgctgctgctgctgctggcctggtgcgccggcgcctgcagaggcgcccccatcctgccccagggcctgcagcccgagcagcagctgcagctgtggaacgagatcgacgacacctgcagcagcttcctgagcatcgacagccagccccaggccagcaacgccctggaggagctgtgcttcatgatcatgggcatgctgcccaagccccaggagcaggacgagaaggacaacaccaagagaagcagcgtggtgcaccccctgctgcagctggtgccccacctgcacgagagaagaatgaagagattcagagtggacgaggagttccagagccccttcgccagccagagcagaggctacttcctgttcagacccagaaacggcagaagaagcgccggcttcatctag

SEQ ID NO: 5015 - DNA, 1545 bp, Artificial Sequence
  Description of Artificial Sequence: Synthetic coding sequence
atgcccagcaccgtgctgcccagcaccgtgctgcccagcctgctgcccaccgccggcgccggctggagcatgagatggatcctgtgctggagcctgaccctgtgcctgatggcccagaccgccctgggcgccctgcacaccaagagaccccaggtggtgaccaagtacggcaccctgcagggcaagcagatgcacgtgggcaagacccccatccaggtgttcctgggcgtgcccttcagcagaccccccctgggcatcctgagattcgccccccccgagccccccgagccctggaagggcatcagagacgccaccacctacccccccggctgcctgcaggagagctggggccagctggccagcatgtacgtgagcaccagagagagatacaagtggctgagattcagcgaggactgcctgtacctgaacgtgtacgcccccgccagagcccccggcgacccccagctgcccgtgatggtgtggttccccggcggcgccttcatcgtgggcgccgccagcagctacgagggcagcgacctggccgccagagagaaggtggtgctggtgttcctgcagcacagactgggcatcttcggcttcctgagcaccgacgacagccacgccagaggcaactggggcctgctggaccagatggccgccctgagatgggtgcaggagaacatcgccgccttcggcggcgaccccggcaacgtgaccctgttcggccagagcgccggcgccatgagcatcagcggcctgatgatgagccccctggccagcggcctgttccacagagccatcagccagagcggcaccgccctgttcagactgttcatcaccagcaaccccctgaaggtggccaagaaggtggcccacctggccggctgcaaccacaacagcacccagatcctggtgaactgcctgagagccctgagcggcaccaaggtgatgagagtgagcaacaagatgagattcctgcagctgaacttccagagagaccccgaggagatcatctggagcatgagccccgtggtggacggcgtggtgatccccgacgaccccctggtgctgctgacccagggcaaggtgagcagcgtgccctacctgctgggcgtgaacaacctggagttcaactggctgctgccctacaacatcaccaaggagcaggtgcccctggtggtggaggagtacctggacaacgtgaacgagcacgactggaagatgctgagaaacagaatgatggacatcgtgcaggacgccaccttcgtgtacgccaccctgcagaccgcccactaccacagaggcctgagcatgggcaaggagaaggccctgagcctgcagatgatgaagtactgggccaacttcgccagaaccggcaaccccaacgacggcaacctgccctgctggcccagatacaacaaggacgagaagtacctgcagctggacttcaccaccagagtgggcatgaagctgaaggagaagaagatggccttctggatgagcctgtaccagagccagagacccgagaagcagagacagttctag

SEQ ID NO: 5016 - DNA, 1062 bp, Artificial Sequence
  Description of Artificial Sequence: Synthetic coding sequence
atgagcaaccccacccagaccgacgccgacagcgacctggtgggcgacgtgtgcgacaccaacgaggacagcgacggcgacggccaccaggacaccaaggacaactgcccccagctgcccaacagcagccagctggacagcgacaacgacggcctgggcgacgagtgcgacggcgacgacgacaacgacggcatccccgactacgtgccccccggccccgacaactgcagactggtgcccaaccccaaccagaaggacagcgacggcaacggcgtgggcgacgtgtgcgaggacgacttcgacaacgacgccgtggtggaccccctggacgtgtgccccgagagcgccgaggtgaccctgaccgacttcagagcctaccagaccgtggtgctggaccccgagggcgacgcccagatcgaccccaactgggtggtgctgaaccagggcatggagatcgtgcagaccatgaacagcgaccccggcctggccgtgggctacaccgccttcaacggcgtggacttcgagggcaccttccacgtgaacaccgtgaccgacgacgactacgccggcttcctgttcagctaccaggacagcggcagattctacgtggtgatgtggaagcagaccgagcagacctactggcaggccacccccttcagagccgtggcccagcccggcctgcagctgaaggccgtgaccagcgtgagcggccccggcgagcacctgagaaacgccctgtggcacaccggccacacccccgaccaggtgagactgctgtggaccgaccccagaaacgtgggctggagagacaagaccagctacagatggcagctgctgcacagaccccaggtgggctacatcagagtgaagctgtacgagggcccccagctggtggccgacagcggcgtgatcatcgacaccagcatgagaggcggcagactgggcgtgttctgcttcagccaggagaacatcatctggagcaacctgcagtacagatgcaacgacaccgtgcccgaggacttcgagcccttcagaagacagctgctgcagggcagagtgtag

SEQ ID NO: 5017 - DNA, 1074 bp, Artificial Sequence
  Description of Artificial Sequence: Synthetic coding sequence
atggagatcgagcacaccctggaccagatgatcagcaaggtgggcaaccacatcgacgtgctgaccggcaagtgggtggcccaggacgccggcatcggcgccggcgtggacagctacttcgagtacctggtgaagggcgccatcctgctgcaggacaagaagctgatggccatgttcctggagtacaacaaggccatcagaaactacaccagattcgacgactggtacctgtgggtgcagatgtacaagggcaccgtgagcatgcccgtgttccagagcctggaggcctactggcccggcctgcagagcctgatcggcgacatcgacaacgccatgagaaccttcctgaactactacaccgtgtggaagcagttcggcggcctgcccgagttctacaacatcccccagggctacaccgtggagaagagagagggctaccccctgagacccgagctgatcgagagcgccatgtacctgtacagagccaccggcgaccccaccctgctggagctgggcagagacgccgtggagagcatcgagaagatcagcaaggtggagtgcggcttcgccaccatcaaggacctgagagaccacaagctggacaacagaatggagagcttcttcctggccgagaccgtgaagtacctgtacctgctgttcgaccccaccaacttcatccacaacaacggcagcaccttcgacgccgtgatcaccccctacggcgagtgcatcctgggcgccggcggctacatcttcaacaccgaggcccaccccatcgaccccgccgccctgcactgctgccagagactgaaggaggagcagtgggaggtggaggacctgatgagagagttctacagcctgaagagaagcagaagcaagttccagaagaacaccgtgagcagcggcccctgggagccccccgccagacccggcaccctgttcagccccgagaaccacgaccaggccagagagagaaagcccgccaagcagaaggtgcccctgctgagctgccccagccagcccttcaccagcaagctggccctgctgggccaggtgttcctggacagcagctag

SEQ ID NO: 5018 - DNA, 1341 bp, Artificial Sequence; identical to SEQ ID NO: 3757
  Description of Artificial Sequence: Synthetic coding sequence

SEQ ID NO: 5019 - DNA, 900 bp, Artificial Sequence; identical to SEQ ID NO: 3786
  Description of Artificial Sequence: Synthetic coding sequence

SEQ ID NO: 5020 - DNA, 1458 bp, Artificial Sequence
  Description of Artificial Sequence: Synthetic coding sequence
atggacaacaacaagcactgcaagcaggacaactgcctgctgacccccaacagcggccaggaggacgccgacaacgacggcgtgggcgaccagtgcgacgacgacgccgacggcgacggcatcaagaacgtggaggacaactgcagactgttccccaacaaggaccagcagaacagcgacaccgacagcttcggcgacgcctgcgacaactgccccaacgtgcccaacaacgaccagaaggacaccgacggcaacggcgagggcgacgcctgcgacaacgacgtggacggcgacggcatccccaacggcctggacaactgccccaaggtgcccaaccccctgcagaccgacagagacgaggacggcgtgggcgacgcctgcgacagctgccccgagatgagcaaccccacccagaccgacgccgacagcgacctggtgggcgacgtgtgcgacaccaacgaggacagcgacggcgacggccaccaggacaccaaggacaactgcccccagctgcccaacagcagccagctggacagcgacaacgacggcctgggcgacgagtgcgacggcgacgacgacaacgacggcatccccgactacgtgccccccggccccgacaactgcagactggtgcccaaccccaaccagaaggacagcgacggcaacggcgtgggcgacgtgtgcgaggacgacttcgacaacgacgccgtggtggaccccctggacgtgtgccccgagagcgccgaggtgaccctgaccgacttcagagcctaccagaccgtggtgctggaccccgagggcgacgcccagatcgaccccaactgggtggtgctgaaccagggcatggagatcgtgcagaccatgaacagcgaccccggcctggccgtgggctacaccgccttcaacggcgtggacttcgagggcaccttccacgtgaacaccgtgaccgacgacgactacgccggcttcctgttcagctaccaggacagcggcagattctacgtggtgatgtggaagcagaccgagcagacctactggcaggccacccccttcagagccgtggcccagcccggcctgcagctgaaggccgtgaccagcgtgagcggccccggcgagcacctgagaaacgccctgtggcacaccggccacacccccgaccaggtgagactgctgtggaccgaccccagaaacgtgggctggagagacaagaccagctacagatggcagctgctgcacagaccccaggtgggctacatcagagtgaagctgtacgagggcccccagctggtggccgacagcggcgtgatcatcgacaccagcatgagaggcggcagactgggcgtgttctgcttcagccaggagaacatcatctggagcaacctgcagtacagatgcaacgacaccgtgcccgaggacttcgagcccttcagaagacagctgctgcagggcagagtgtag

SEQ ID NO: 5021 - DNA, 2358 bp, Artificial Sequence
  Description of Artificial Sequence: Synthetic coding sequence
atgaagcacaccctggccctgctggcccccctgctgggcctgggcctgggcctggccctgagccagctggccgccggcgccaccgactgcaagttcctgggccccgccgagcacctgaccttcacccccgccgccagagccagatggctggcccccagagtgagagcccccggcctgctggacagcctgtacggcaccgtgagaagattcctgagcgtggtgcagctgaaccccttccccagcgagctggtgaaggccctgctgaacgagctggccagcgtgaaggtgaacgaggtggtgagatacgaggccggctacgtggtgtgcgccgtgatcgccggcctgtacctgctgctggtgcccaccgccggcctgtgcttctgctgctgcagatgccacagaagatgcggcggcagagtgaagaccgagcacaaggccctggcctgcgagagagccgccctgatggtgttcctgctgctgaccaccctgctgctgctgatcggcgtggtgtgcgccttcgtgaccaaccagagaacccacgagcagatgggccccagcatcgaggccatgcccgagaccctgctgagcctgtggggcctggtgagcgacgtgccccaggagctgcaggccgtggcccagcagttcagcctgccccaggagcaggtgagcgaggagctggacggcgtgggcgtgagcatcggcagcgccatccacacccagctgagaagcagcgtgtaccccctgctggccgccgtgggcagcctgggccaggtgctgcaggtgagcgtgcaccacctgcagaccctgaacgccaccgtggtggagctgcaggccggccagcaggacctggagcccgccatcagagagcacagagacagactgctggagctgctgcaggaggccagatgccagggcgactgcgccggcgccctgagctgggccagaaccctggagctgggcgccgacttcagccaggtgcccagcgtggaccacgtgctgcaccagctgaagggcgtgcccgaggccaacttcagcagcatggtgcaggaggagaacagcaccttcaacgccctgcccgccctggccgccatgcagaccagcagcgtggtgcaggagctgaagaaggccgtggcccagcagcccgagggcgtgagaaccctggccgagggcttccccggcctggaggccgccagcagatgggcccaggccctgcaggaggtggaggagagcagcagaccctacctgcaggaggtgcagagatacgagacctacagatggatcgtgggctgcgtgctgtgcagcgtggtgctgttcgtggtgctgtgcaacctgctgggcctgaacctgggcatctggggcctgagcgccagagacgaccccagccaccccgaggccaagggcgaggccggcgccagattcctgatggccggcgtgggcctgagcttcctgttcgccgcccccctgatcctgctggtgttcgccaccttcctggtgggcggcaacgtgcagaccctggtgtgccagagctgggagaacggcgagctgttcgagttcgccgacacccccggcaacctgccccccagcatgaacctgagccagctgctgggcctgagaaagaacatcagcatccaccaggcctaccagcagtgcaaggagggcgccgccctgtggaccgtgctgcagctgaacgacagctacgacctggaggagcacctggacatcaaccagatccagagacccgtggtgaagaccagcatggagcagctggcccaggagctgcagggcctggcccaggcccaggacaacagcgtgctgggccagagactgcaggaggaggcccagggcctgagaaacctgcaccaggagaaggtggtgccccagcagagcctggtggccaagctgaacctgagcgtgagagccctggagagcagcgcccccaacctgcagctggagaccagcgacgtgctggccaacgtgacctacctgaagggcgagctgcccgcctgggccgccagaatcctgagaaacgtgagcgagtgcttcctggccagagagatgggctacttcagccagtacgtggcctgggtgagagaggaggtgacccagagaatcgccacctgccagcccctgagcggcgccctggacaacagcagagtgatcctgtgcgacatgatggccgacccctggaacgccttctggttctgcctggcctggtgcaccttcttcctgatccccagcatcatcttcgccgtgaagaccagcaagtacttcagacccatcagaaagagactgagcagcaccagcagcgaggagacccagctgttccacatccccagagtgaccagcctgaagctgtag

SEQ ID NO: 5022 - DNA, 792 bp, Artificial Sequence
  Description of Artificial Sequence: Synthetic coding sequence
atgggcagagtgctggaggaggccagattcgccgtggccttcaccgagagcatgaaggagatggcccaggcccagtggaaggccagacagatcagcctggccgtgaccagcgccgtgcccgtgcagccccacgccaagggcaaggtgtacgtgcagagccagggcatcgccaccacccccaacgccgccttcaactggaacaccttcctgcagagaagcgagatcaaccagagcgccgacaacctgcacatcttcctgctgatctgcggcctgagacaggtgaaggaccccctgtacctggtggacgccttcagcgcctggcaccaggaggagcccaacgtgcacctggtgatcgtgggccccgaggtggaccccgtgttcaccagagaggtgaaggccaaggtgaagagagccgccggcgtgagactgatcggcgagatgccccaggaggacctgcacgccgtggtgaagaactgcttcgccgtggtgaacagcagcgtgagcgagggcatgagcgccgccatcctggaggccatggacctggaggtgcccgtgctggccagaaacatccccggcaacgccgccgtggtgaagcacgaggtgaccggcctgctgttcagcaacccccaggagttcgtgcacctggccaagagactggtgagcgaccccgccctggagaaggagatcgtggtgaacggcagagagtacgtgagaatgtaccacagctggcaggtggagagagacacctaccagcagctgatcagaaagctggagggcagcaccgaggactag

SEQ ID NO: 5023 - DNA, 456 bp, Artificial Sequence
  Description of Artificial Sequence: Synthetic coding sequence
atgaagaccgccgtgatgaaggagctgtacagcttcctgcaccaccagaacagatacggcagcgagcaggagttcgtggacgacctgaagaacatgtggttcggcctgtacagcagaggcaacgaggagggcgacagcagcggcttcgagcacgtgttcagcggcgaggtgaagaagggcaaggtgaccggcttccacaactggatcagattctacctggaggagaaggagggcctggtggactactacagccacatctacgacggccccgtgcccgtgaagcccggcagaatcagcctgagctgccccgacatctacctgggccaggtgcacctgtgggagtggcaggaggtgcacagacacagcctgcacagcgtgttccacctgatcgagctgagagccagaaagggccacgagggcagctgcgagaccgaggtgctgagcagcctggactag

SEQ ID NO: 5024 - DNA, 363 bp, Artificial Sequence
  Description of Artificial Sequence: Synthetic coding sequence
atgctgccccagtggctgctgctgctgttcctgctgttcttcttcctgttcctgctgaccagaggcagcctgagccccaccaagtacaacctgctggagctgaaggagagctgcatcagaaaccaggactgcgagaccggctgctgccagagagcccccgacaactgcgagagccactgcgccgagaagggcagcgagggcagcctgtgccagacccaggtgttcttcggccagtacagagcctgcccctgcctgagaaacctgacctgcatctacagcaagaacgagaagtggctgagcatcgcctacggcagatgccagaagatcggcagacagaagctggccaagaagatgttcttctag

SEQ ID NO: 5025 - DNA, 951 bp, Artificial Sequence
  Description of Artificial Sequence: Synthetic coding sequence
atggccgaggccgccctggaggccgtgagaagcgagctgagagagttccccgccgccgccagagagctgtgcgtgcccctggccgtgccctacctggacaagccccccacccccctgcacttctacagagactgggtgtgccccaacagaccctgcatcatcagaaacgccctgcagcactggcccgccctgcagaagtggagcctgccctacttcagagccaccgtgggcagcaccgaggtgagcgtggccgtgacccccgacggctacgccgacgccgtgagaggcgacagattcatgatgcccgccgagagaagactgcccctgagcttcgtgctggacgtgctggagggcagagcccagcaccccggcgtgctgtacgtgcagaagcagtgcagcaacctgcccagcgagctgccccagctgctgcccgacctggagagccacgtgccctgggccagcgaggccctgggcaagatgcccgacgccgtgaacttctggctgggcgaggccgccgccgtgaccagcctgcacaaggaccactacgagaacctgtactgcgtggtgagcggcgagaagcacttcctgttccacccccccagcgacagacccttcatcccctacgagctgtacacccccgccacctaccagctgaccgaggagggcaccttcaaggtggtggacgaggaggccatggagaaggtgccctggatccccctggaccccctggcccccgacctggccagataccccagctacagccaggcccaggccctgagatgcaccgtgagagccggcgagatgctgtacctgcccgccctgtggttccaccacgtgcagcagagccagggctgcatcgccgtgaacttctggtacgacatggagtacgacctgaagtacagctacttccagctgctggacagcctgaccaaggccagcggcctggactag

SEQ ID NO: 5026 - DNA, 657 bp, Artificial Sequence; identical to SEQ ID NO: 4208
  Description of Artificial Sequence: Synthetic coding sequence

SEQ ID NO: 5027 - DNA, 909 bp, Artificial Sequence
  Description of Artificial Sequence: Synthetic coding sequence
atggccatgttcctggagtacaacaaggccatcagaaactacaccagattcgacgactggtacctgtgggtgcagatgtacaagggcaccgtgagcatgcccgtgttccagagcctggaggcctactggcccggcctgcagagcctgatcggcgacatcgacaacgccatgagaaccttcctgaactactacaccgtgtggaagcagttcggcggcctgcccgagttctacaacatcccccagggctacaccgtggagaagagagagggctaccccctgagacccgagctgatcgagagcgccatgtacctgtacagagccaccggcgaccccaccctgctggagctgggcagagacgccgtggagagcatcgagaagatcagcaaggtggagtgcggcttcgccaccatcaaggacctgagagaccacaagctggacaacagaatggagagcttcttcctggccgagaccgtgaagtacctgtacctgctgttcgaccccaccaacttcatccacaacaacggcagcaccttcgacgccgtgatcaccccctacggcgagtgcatcctgggcgccggcggctacatcttcaacaccgaggcccaccccatcgaccccgccgccctgcactgctgccagagactgaaggaggagcagtgggaggtggaggacctgatgagagagttctacagcctgaagagaagcagaagcaagttccagaagaacaccgtgagcagcggcccctgggagccccccgccagacccggcaccctgttcagccccgagaaccacgaccaggccagagagagaaagcccgccaagcagaaggtgcccctgctgagctgccccagccagcccttcaccagcaagctggccctgctgggccaggtgttcctggacagcagctag

SEQ ID NO: 5028 - DNA, 459 bp, Artificial Sequence
  Description of Artificial Sequence: Synthetic coding sequence
atgctggtggacggccccagcgagagacccgccctgtgcttcctgctgctggccgtggccatgagcttcttcggcagcgccctgagcatcgacgagaccagagcccacctgctgctgaaggagaagatgatgagactgggcggcagactggtgctgaacaccaaggaggagctggccaacgagagactgatgaccctgaagatcgccgagatgaaggaggccatgagaaccctgatcttcccccccagcatgcacttcttccaggccaagcacctgatcgagagaagccaggtgttcaacatcctgagaatgatgcccaagggcgccgccctgcacctgcacgacatcggcatcgtgaccatggactggctggtgagaaacgtgacctacagaccccactgccacatctgcttcacccccagaggcatcatgcagttcagattcgcccaccccacctag

SEQ ID NO: 5029 - DNA, 3951 bp, Artificial Sequence
  Description of Artificial Sequence: Synthetic coding sequence
atggagcccagactgttctgctggaccaccctgttcctgctggccggctggtgcctgcccggcctgccctgccccagcagatgcctgtgcttcaagagcaccgtgagatgcatgcacctgatgctggaccacatcccccaggtgccccagcagaccaccgtgctggacctgagattcaacagaatcagagagatccccggcagcgccttcaagaagctgaagaacctgaacaccctgctgctgaacaacaaccacatcagaaagatcagcagaaacgccttcgagggcctggagaacctgctgtacctgtacctgtacaagaacgagatccacgccctggacaagcagaccttcaagggcctgatcagcctggagcacctgtacatccacttcaaccagctggagatgctgcagcccgagaccttcggcgacctgctgagactggagagactgttcctgcacaacaacaagctgagcaagatccccgccggcagcttcagcaacctggacagcctgaagagactgagactggacagcaacgccctggtgtgcgactgcgacctgatgtggctgggcgagctgctgcagggcttcgcccagcacggccacacccaggccgccgccacctgcgagtaccccagaagactgcacggcagagccgtggccagcgtgaccgtggaggagttcaactgccagagccccagaatcaccttcgagccccaggacgtggaggtgcccagcggcaacaccgtgtacttcacctgcagagccgagggcaaccccaagcccgagatcatctggatccacaacaaccacagcctggacctggaggacgacaccagactgaacgtgttcgacgacggcaccctgatgatcagaaacaccagagagagcgaccagggcgtgtaccagtgcatggccagaaacagcgccggcgaggccaagacccagagcgccatgctgagatacagcagcctgcccgccaagcccagcttcgtgatccagccccaggacaccgaggtgctgatcggcaccagcaccaccctggagtgcatggccaccggccacccccaccccctgatcacctggaccagagacaacggcctggagctggacggcagcagacacgtggccaccagcagcggcctgtacctgcagaacatcacccagagagaccacggcagattcacctgccacgccaacaacagccacggcaccgtgcaggccgccgccaacatcatcgtgcaggcccccccccagttcaccgtgacccccaaggaccaggtggtgctggaggagcacgccgtggagtggctgtgcgaggccgacggcaaccccccccccgtgatcgtgtggaccaagaccggcggccagctgcccgtggagggccagcacaccgtgctgagcagcggcaccctgagaatcgacagagccgcccagcacgaccagggccagtacgagtgccaggccgtgagcagcctgggcgtgaagaaggtgagcgtgcagctgaccgtgaagcccaaggccctggccgtgttcacccagctgccccaggacaccagcgtggaggtgggcaagaacatcaacatcagctgccacgcccagggcgagccccagcccatcatcacctggaacaaggagggcgtgcagatcaccgagagcggcaagttccacgtggacgacgagggcaccctgaccatctacgacgccggcttccccgaccagggcagatacgagtgcgtggccagaaacagcttcggcctggccgtgaccaacatgttcctgaccgtgaccgccatccagggcagacaggccggcgacgacttcgtggagagcagcatcctggacgccgtgcagagagtggacagcgccatcaacagcaccagaagacacctgttcagccagaagccccacaccagcagcgacctgctggcccagttccactaccccagagaccccctgatcgtggagatggccagagccggcgagatcttcgagcacaccctgcagctgatcagagagagagtgaagcagggcctgaccgtggacctggagggcaaggagttcagatacaacgacctggtgagccccagaagcctgagcctgatcgccaacctgagcggctgcaccgccagaagacccctgcccaactgcagcaacagatgcttccacgccaagtacagagcccacgacggcacctgcaacaacctgcagcagcccacctggggcgccgccctgaccgccttcgccagactgctgcagcccgcctacagagacggcatcagagcccccagaggcctgggcctgcccgtgggcagcagacagcccctgcccccccccagactggtggccaccgtgtgggccagagccgccgccgtgacccccgaccacagctacaccagaatgctgatgcactggggctggttcctggagcacgacctggaccacaccgtgcccgccctgagcaccgccagattcagcgacggcagaccctgcagcagcgtgtgcaccaacgaccccccctgcttccccatgaacaccagacacgccgaccccagaggcacccacgccccctgcatgctgttcgccagaagcagccccgcctgcgccagcggcagacccagcgccaccgtggacagcgtgtacgccagagagcagatcaaccagcagaccgcctacatcgacggcagcaacgtgtacggcagcagcgagagagagagccaggccctgagagaccccagcgtgcccagaggcctgctgaagaccggcttcccctggccccccagcggcaagcccctgctgcccttcagcaccggcccccccaccgagtgcgccagacaggagcaggagagcccctgcttcctggccggcgaccacagagccaacgagcacctggccctggccgccatgcacaccctgtggttcagagagcacaacagaatggccaccgagctgagcgccctgaacccccactgggagggcaacaccgtgtaccaggaggccagaaagatcgtgggcgccgagctgcagcacatcacctacagccactggctgcccaaggtgctgggcgaccccggcaccagaatgctgagaggctacagaggctacaaccccaacgtgaacgccggcatcatcaacagcttcgccaccgccgccttcagattcggccacaccctgatcaaccccatcctgtacagactgaacgccaccctgggcgagatcagcgagggccacctgcccttccacaaggccctgttcagccccagcagaatcatcaaggagggcggcatcgaccccgtgctgagaggcctgttcggcgtggccgccaagtggagagcccccagctacctgctgagccccgagctgacccagagactgttcagcgccgcctacagcgccgccgtggacagcgccgccaccatcatccagagaggcagagaccacggcatccccccctacgtggacttcagagtgttctgcaacctgaccagcgtgaagaacttcgaggacctgcagaacgagatcaaggacagcgagatcagacagaagctgagaaagctgtacggcagccccggcgacatcgacctgtggcccgccctgatggtggaggacctgatccccggcaccagagtgggccccaccctgatgtgcctgttcgtgacccagttccagagactgagagacggcgacagattctggtacgagaaccccggcgtgttcacccccgcccagctgacccagctgaagcaggccagcctgagcagagtgctgtgcgacaacggcgacagcatccagcaggtgcaggccgacgtgttcgtgaaggccgagtacccccaggactacctgaactgcagcgagatccccaaggtggacctgagagtgtggcaggactgctgcgccgacaagcaggccggcggcacccccgaggccggcagagtgtacagatgctag

SEQ ID NO: 5030 - DNA, 891 bp, Artificial Sequence
  Description of Artificial Sequence: Synthetic coding sequence
atggaccccagcaagatcgcccacaccgagtaccccgtgaacaccatcatcatccacgaggacttcgacaacaacagcatgagcaacaacatcgccctgctgaagaccgacaccgccatgcacttcggcaacctggtgcagagcatctgcttcctgggcagaatgctgcacaccccccccgtgctgcagaactgctgggtgagcggctggaaccccaccagcgccaccggcaaccacatgaccatgagcgtgctgagaaagatcttcgtgaaggacctggacatgtgccccctgtacaagctgcagaagaccgagtgcggcagccacaccaaggaggagaccaagaccgcctgcctgggcgaccccggcagccccatgatgtgccagctgcagcagttcgacctgtgggtgctgagaggcgtgctgaacttcggcggcgagacctgccccggcctgttcctgtacaccaaggtggaggactacagcaagtggatcaccagcaaggccgagagagccggcccccccctgagcagcctgcaccactgggagaagctgatcagcttcagccaccacggccccaacgccaccatgacccagaagacctacagcgacagcgagctgggccacgtgggcagctacctgcagggccagagaagaaccatcacccacagcagactgggcaacagcagcagagacagcctggacgtgagagagaaggacgtgaaggagagcggcagaagccccgaggccagcgtgcagcccctgtactacgactactacggcggcgaggtgggcgagggcagaatcttcgccggccagaacagactgtaccagcccgaggagatcatcctggtgagcttcgtgctggtgttcttctgcagcagcatctag

SEQ ID NO: 5031 - DNA, 2808 bp, Artificial Sequence
  Description of Artificial Sequence: Synthetic coding sequence
atgagaaagcccagaagaaagagcagacagaacgccgagggcagaagaagccccagcccctacagcctgaagtgcagccccaccagagagaccctgacctacgcccaggcccagagaatcgtggaggtggacatcgacggcagactgcacagaatcagcatctacgaccccctgaagatcatcaccgaggacgagctgaccgcccaggacatcaccgagtgcaacagcaacaaggagaacagcgagcagccccagttccccggcaagagcaagaagcccagcagcaagggcaagaagaaggagagctgcagcaagcacgccagcggcaccagcttccacctgccccagcccagcttcagaatggtggacagcggcatccagcccgaggccccccccctgcccgccgcctactacagatacatcgagaagccccccgaggacctggacgccgaggtggagtacgacatggacgaggaggacctggcctggctggacatggtgaacgagaagagaagagtggacggccacagcctggtgagcgccgacaccttcgagctgctggtggacagactggagaaggagagctacctggagagcagaagcagcggcgcccagcagagcctgatcgacgaggacgccttctgctgcgtgtgcctggacgacgagtgccacaacagcaacgtgatcctgttctgcgacatctgcaacctggccgtgcaccaggagtgctacggcgtgccctacatccccgagggccagtggctgtgcagatgctgcctgcagagccccagcagacccgtggactgcatcctgtgccccaacaagggcggcgccttcaagcagaccagcgacggccactgggcccacgtggtgtgcgccatctggatccccgaggtgtgcttcgccaacaccgtgttcctggagcccatcgagggcatcgacaacatcccccccgccagatggaagctgacctgctacatctgcaagcagaagggcctgggcgccgccatccagtgccacaaggtgaactgctacaccgccttccacgtgacctgcgcccagagagccggcctgttcatgaagatcgagcccatgagagagaccagcctgaacggcaccatcttcaccgtgagaaagaccgcctactgcgaggcccacagcccccccggcgccgccaccgccagaagaaagggcgacagccccagaagcatcagcgagaccggcgacgaggagggcctgaaggagggcgacggcgaggaggaggaggaggaggaggtggaggaggaggagcaggaggcccagggcggcgtgagcggcagcctgaagggcgtgcccaagaagagcaagatgagcctgaagcagaagatcaagaaggagcccgaggaggccggccaggacacccccagcaccctgcccatgctggccgtgccccagatccccagctacagactgaacaagatctgcagcggcctgagcttccagagaaagaaccagttcatgcagagactgcacaactactggctgctgaagagacaggccagaaacggcgtgcccctgatcagaagactgcacagccacctgcagagccagagaaacgccgagcagagagagcaggacgagaagaccagcgccgtgaaggaggagctgaagtactggcagaagctgagacacgacctggagagagccagactgctgatcgagctgatcagaaagagagagaagctgaagagagagcaggtgaaggtgcagcaggccgccatggagctggagctgatgcccttcaacgtgctgctgagaaccaccctggacctgctgcaggagaaggaccccgcccacatcttcgccgagcccgtgaacctgagcgaggtgcccgactacctggagttcatcagcaagcccatggacttcagcaccatgagaagaaagctggagagccacctgtacagaaccctggaggagttcgaggaggacttcaacctgatcgtgaccaactgcatgaagtacaacgccaaggacaccatcttccacagagccgccgtgagactgagagacctgggcggcgccatcctgagacacgccagaagacaggccgagaacatcggctacgaccccgagagaggcacccacctgcccgagagccccaagctggaggacttctacagattcagctgggaggacggcatgaccaacggcttcggcaagcacaccgagagcggcagcgacagcgagtgcagcctgggcctgagcggcggcctggccttcgaggcctgcagcggcctgaccccccccaagagaagcagaggcaagcccgccctgagcagagtgcccttcctggagggcgtgaacggcgacagcgactacaacggcagcggcagaagcctgctgctgcccttcgaggacagaggcgacctggagcccctggagctggtgtgggccaagtgcagaggctaccccagctaccccgccctgatcatcgaccccaagatgcccagagagggcctgctgcacaacggcgtgcccatccccgtgccccccctggacgtgctgaagctgggcgagcagaagcaggccgaggccggcgagaagctgttcctggtgctgttcttcgacaacaagagaacctggcagtggctgcccagagacaaggtgctgcccctgggcgtggaggacaccgtggacaagctgaagatgctggagggcagaaagaccagcatcagaaagagcgtgcaggtggcctacgacagagccatgatccacctgagcagagtgagaggcccccacagcttcgtgaccagcagctacctgtag

SEQ ID NO: 5032 - DNA, 270 bp, Artificial Sequence
  Description of Artificial Sequence: Synthetic coding sequence
atgaagaccggcctgttcttcctgtgcctgctgggcaccgccgccgccatccccaccaacgccagactgctgagcgaccacagcaagcccaccgccgagaccgtggcccccgacaacaccgccatccccagcctgagagccgaggccgaggagaacgagaaggagaccgccgtgagcaccgaggacgacagccaccacaaggccgagaagagcagcgtgctgaagagcaaggaggagagccacgagcagagcgccgagcagggcaagtag

SEQ ID NO: 5033 - DNA, 657 bp, Artificial Sequence; identical to SEQ ID NO: 4208
  Description of Artificial Sequence: Synthetic coding sequence

SEQ ID NO: 5034 - DNA, 540 bp, Artificial Sequence
  Description of Artificial Sequence: Synthetic coding sequence
atgagcctgggccccgaggtgttcctgggcccccccgaggcccagagcttcctgagcagccacaccagaatccccagagccaaccactgggacctggagctgctgacccccggcaacctggagagagagtgcctggaggagagatgcagctgggaggaggccagagagtacttcgaggacaacaccctgaccgagagattctgggagagctacatctacaacggcaagggcggcagaggcagagtggacgtggccagcctggccgtgggcctgaccggcggcatcctgctgatcgtgctggccggcctgggcgccttctggtacctgagatggagacagcacagaggccagcagccctgcccccaggaggccggcctgatcagccccctgagccccctgaaccccctgggcccccccacccccctgccccccccccccccccccccccccggcctgcccacctacgagcaggccctggccgccagcggcgtgcacgacgcccccccccccccctacaccagcctgagaagaccccactag

SEQ ID NO: 5035 - DNA, 765 bp, Artificial Sequence
  Description of Artificial Sequence: Synthetic coding sequence
atgaccctggaggacatcgtgcagagagaggtgtggggcaccgtggtggccagaggcgcccccgccccccccggccccgtgcccaccagaggcgccgccagcagaagactgagcgtgagccccgccagcaccagcgagaccagcctgtaccaggtgctgctgggcgccagacagctggtgcagcccggcccccacgccatgtacgccagagtgagacaggtggagagcaaccccctgtaccagggcaccgccagcagcgccgacgtggccctggtggagctggaggcccccgtgcccttcaccaactacatcctgcccgtgtgcctgcccgaccccagcgtgatcttcgagaccggcatgaactgctgggtgaccggctggggcagccccagcgaggaggacctgctgcccgagcccagaatcctgcagaagctggccgtgcccatcatcgacacccccaagtgcaacctgctgtacagcaaggacaccgagttcggctaccagcccaagaccatcaagaacgacatgctgtgcgccggcttcgaggagggcaagaaggacgcctgcaagggcgacagcggcggccccctggtgtgcctggtgggccagagctggctgcaggccggcgtgatcagctggggcgagggctgcgccagacagaacagacccggcgtgtacatcagagtgaccgcccaccacaactggatccacagaatcatccccaagctgcagttccagcccgccagactgggcggccagaagtag

SEQ ID NO: 5036 - DNA, 1899 bp, Artificial Sequence
  Description of Artificial Sequence: Synthetic coding sequence
atgaccccccccgtgctgaccaccgccgagaccagcgtgaagcccagcgtgagcgccttcacccacagcccccccgagaacaccaccggcatcagcagcaccatcagcttccacagcagaaccctgaacctgaccgacgtgatcgaggagctggcccaggccagcacccagaccctgaagagcaccatcgccagcgagaccaccctgagcagcaagagccaccagagcaccaccaccagaaaggccatcatcagacacagcaccatcccccccttcctgagcagcagcgccaccctgatgcccgtgcccatcagcccccccttcacccagagagccgtgaccgacaacgtggccacccccatcagcggcctgatgaccaacaccgtggtgaagctgcacgagagcagcagacacaacgccaagccccagcagctggtggccgaggtggccaccagccccaaggtgcaccccaacgccaagttcaccatcggcaccacccacttcatctacagcaacctgctgcacagcacccccatgcccgccctgaccaccgtgaagagccagaacagcaagctgacccccagcccctgggccgagaaccagttctggcacaagccctacagcgagatcgccgagaagggcaagaagcccgaggtgagcatgctggccaccaccggcctgagcgaggccaccaccctggtgagcgactgggacggccagaagaacaccaagaagagcgacttcgacaagaagcccgtgcaggaggccaccaccagcaagctgctgcccttcgacagcctgagcagatacatcttcgagaagcccagaatcgtgggcggcaaggccgccagcttcaccatccccgccaacagcgacgccttcctgccctgcgaggccgtgggcaaccccctgcccaccatccactggaccagagtgcccagcggcctggacctgagcaagagaaagcagaacagcagagtgcaggtgctgcccaacggcaccctgagcatccagagagtggagatccaggacagaggccagtacctgtgcagcgccagcaacctgttcggcaccgaccacctgcacgtgaccctgagcgtggtgagctacccccccagaatcctggagagaagaaccaaggagatcaccgtgcacagcggcagcaccgtggagctgaagtgcagagccgagggcagacccagccccaccgtgacctggatcctggccaaccagaccgtggtgagcgagagcagccagggcagcagacaggccgtggtgaccgtggacggcaccctggtgctgcacaacctgagcatctacgacagaggcttctacaagtgcgtggccagcaaccccggcggccaggacagcctgctggtgaagatccaggtgatcgccgccccccccgtgatcctggagcagagaagacaggtgatcgtgggcacctggggcgagagcctgaagctgccctgcaccgccaagggcaccccccagcccagcgtgtactgggtgctgagcgacggcaccgaggtgaagcccctgcagttcaccaacagcaagctgttcctgttcagcaacggcaccctgtacatcagaaacctggccagcagcgacagaggcacctacgagtgcatcgccaccagcagcaccggcagcgagagaagagtggtgatgctgaccatggaggagagagtgaccagccccagaatcgaggccgccagccagaagagaaccgaggtgaacttcggcgacaagctgctgctgaactgcagcgccaccggcgagcccaagccccagatcatgtggagactgcccagcaaggccgtggtggaccagcagcacagagtggccgccggcagcaccagcaccctgatggacccctgcctgctggaccagtag

SEQ ID NO: 5037 - DNA, 681 bp, Artificial Sequence
  Description of Artificial Sequence: Synthetic coding sequence
atggacatcatcgtgctgctgcccaagggccactgcaccaagatccaggagctgcagatgaccaccgtgctgaagcagaacgtgcacgtgttcggcgtggagggcaacagcgacgagctggacgagcccatcaagaccgtgttcgccgacgtggccttcgtgaagaagcacaacctgatgagcctgaacagcatcaactggagcagagtgctggtgcagatggcccaccacttcttcgcctacttccagtgcacccccagcctggacacccaccccctgcccctggtggaggtggtggtgcccaccggcgccgccggcaacctggccgccggctacatcgcccagaagatcggcctgcccatcagactggtggtggccgtgaacagaaacgacatcatccacagaaccgtgcagcagggcgacttcagcctgagcgaggccgtgaagagcaccctggccagcgccatggacatccaggtgccctacaacatggagagagtgttctggctgctgagcggcagcgacagccaggtgaccagagccctgatggagcagttcgagagaacccagagcgtgaacctgcccaaggagctgcacagcaagcacagccccgtgctgcccagaccctgcctgtgcagccaggtgcccggcagctgccccggctgctggcccgacccctag

SEQ ID NO: 5038 - DNA, 729 bp, Artificial Sequence
  Description of Artificial Sequence: Synthetic coding sequence
atgttccagaccggcggcctgatcgtgttctacggcctgctggcccagaccctgcccctgaacgtgaaccccgccctgcccctgagccccaccggcctggccggcagcctgaccaacgccctgagcaacggcctgctgagcggcggcctgctgggcatcctggagaacctgcccctgctggacatcctgaagcccggcggcggcaccagcggcggcctgctgggcggcctgctgggcaaggtgaccagcgtgatccccggcctgaacaacatcatcgacatcaaggtgaccgacccccagctgctggagctgggcctggtgcagagccccgacggccacagactgtacgtgaccatccccctgggcatcaagctgcaggtgaacacccccctggtgggcgccagcctgctgagactggccgtgaagctggacatcaccgccgagatcctggccgtgagagacaagcaggagagaatccacctggtgctgggcgactgcacccacagccccggcagcctgcagatcagcctgctggacggcctgggccccctgcccatccagggcctgctggacagcctgaccggcatcctgaacaaggtgctgcccgagctggtgcagggcaacgtgtgccccctggtgaacgaggtgctgagaggcctggacatcaccctggtgcacgacatcgtgaacatgctgatccacggcctgcagttcgtgatcaaggtgtag

SEQ ID NO: 5039 - DNA, 1422 bp, Artificial Sequence
  Description of Artificial Sequence: Synthetic coding sequence
atgagcctggaggccagcctgtgcagcctggaggagtgcgccgccttccagcccagcagccccagccccctgcagccccagggccccgtgaagagcaacaacatcgtgaccgtgaccggcatcagcctgtgcctgttcatcatcatcgccaccgtgctgatcaccctgtggagaagattcggcagacccgccaagtgcagcacccccgccagacacaacagcatccacagccccagcttcagaaagaacagcgacgaggagaacatctgcgagctgagcgagcagagaggcagcttcagcgacggcggcgacggccccaccggcagccccggcgacaccggcatccccctgacctacagaagaagcggccccgtgccccccgaggacgacgccagcggcagcgagagcttccagagcaacgcccagaagatcatcccccccctgttcagctacagactggcccagcagcagctgaaggagatgaagaagaagggcctgaccgagaccaccaaggtgtaccacgtgagccagagccccctgaccgacaccgccatcgacgccgcccccagcgcccccctggacctggagagccccgaggaggccgccgccaacaagttcagaatcaagagccccttccccgagcagcccgccgtgagcgccggcgagagaccccccagcagactggacctgaacgtgacccaggccagctgcgccatcagccccagccagaccctgatcagaaagagccaggccagacacgtgggcagcagaggcggccccagcgagagaagccacgccagaaacgcccacttcagaagaaccgccagcttccacgaggccagacaggccagacccttcagagagagaagcatgagcaccctgacccccagacaggcccccgcctacagcagcagaaccagaacctgcgagcaggccgaggacagattcagaccccagagcagaggcgcccacctgttccccgagaagctggagcacttccaggaggccagcggcaccagaggccccctgaaccccctgcccaagagctacaccctgggccagcccctgagaaagcccgacctgggcgaccaccaggccggcctggtggccggcatcgagagaaccgagccccacagagccagaagaggccccagccccagccacaagagcgtgagcagaaagcagagcagccccatcagccccaaggacaactaccagagagtgagcagcctgagccccagccagtgcagaaaggacaagtgccagagcttccccacccaccccgagttcgccttctacgacaacaccagcttcggcctgaccgaggccgagcagagaatgctggacctgcccggctacttcggcagcaacgaggaggacgagaccaccagcaccctgagcgtggagaagctggtgatctag

SEQ ID NO: 5040 - DNA, 2310 bp, Artificial Sequence
  Description of Artificial Sequence: Synthetic coding sequence
atgctgagcaagaagggcatcttcccctggatcctgacctgcatcagcgaggagatggccttcagaaccatctgcgtgctggtgggcgtgttcatctgcagcatctgcgtgaagggcagcagccagccccaggccagagtgtacctgaccttcgacgagctgagagagaccaagaccagcgagtacttcagcctgagccaccaccccctggactacagaatcctgctgatggacgaggaccaggacagaatctacgtgggcagcaaggaccacatcctgagcctgaacatcaacaacatcagccaggaggccctgagcgtgttctggcccgccagcaccatcaaggtggaggagtgcaagatggccggcaaggaccccacccacggctgcggcaacttcgtgagagtgatccagaccttcaacagaacccacctgtacgtgtgcggcagcggcgccttcagccccgtgtgcacctacctgaacagaggcagaagaagcgaggaccaggtgttcatgatcgacagcaagtgcgagagcggcaagggcagatgcagcttcaaccccaacgtgaacaccgtgagcgtgatgatcaacgaggagctgttcagcggcatgtacatcgacttcatgggcaccgacgccgccatcttcagaagcctgaccaagagaaacgccgtgagaaccgaccagcacaacagcaagtggctgagcgagcccatgttcgtggacgcccacgtgatccccgacggcaccgaccccaacgacgccaaggtgtacttcttcttcaaggagaagctgaccgacaacaacagaagcaccaagcagatccacagcatgatcgccagaatctgccccaacgacaccggcggcctgagaagcctggtgaacaagtggaccaccttcctgaaggccagactggtgtgcagcgtgaccgacgaggacggccccgagacccacttcgacgagctggaggacgtgttcctgctggagaccgacaaccccagaaccaccctggtgtacggcatcttcaccaccagcagcagcgtgttcaagggcagcgccgtgtgcgtgtaccacctgagcgacatccagaccgtgttcaacggccccttcgcccacaaggagggccccaaccaccagctgatcagctaccagggcagaatcccctaccccagacccggcacctgccccggcggcgccttcacccccaacatgagaaccaccaaggagttccccgacgacgtggtgaccttcatcagaaaccaccccctgatgtacaacagcatctaccccatccacaagagacccctgatcgtgagaatcggcaccgactacaagtacaccaagatcgccgtggacagagtgaacgccgccgacggcagataccacgtgctgttcctgggcaccgacagaggcaccgtgcagaaggtggtggtgctgcccaccaacaacagcgtgagcggcgagctgatcctggaggagctggaggtgttcaagaaccacgcccccatcaccaccatgaagatcagcagcaagaagcagcagctgtacgtgagcagcaacgagggcgtgagccaggtgagcctgcacagatgccacatctacggcaccgcctgcgccgactgctgcctggccagagacccctactgcgcctgggacggccacagctgcagcagattctaccccaccggcaagagaagaagcagaagacaggacgtgagacacggcaaccccctgacccagtgcagaggcttcaacctgaaggcctacagaaacgccgccgagatcgtgcagtacggcgtgaagaacaacaccaccttcctggagtgcgcccccaagagcccccaggccagcatcaagtggctgctgcagaaggacaaggacagaagaaaggaggtgaagctgaacgagagaatcatcgccaccagccagggcctgctgatcagaagcgtgcagggcagcgaccagggcctgtaccactgcatcgccaccgagaacagcttcaagcagaccatcgccaagatcaacttcaaggtgctggacagcgagatggtggccgtggtgaccgacaagtggagcccctggacctgggccagcagcgtgagagccctgcccttccaccccaaggacatcatgggcgccttcagccacagcgagatgcagatgatcaaccagtactgcaaggacaccagacagcagcaccagcagggcgacgagagccagaagatgagaggcgactacggcaagctgaaggccctgatcaacagcagaaagagcagaaacagaagaaaccagctgcccgagagctag

SEQ ID NO: 5041 - DNA, 942 bp, Artificial Sequence
  Description of Artificial Sequence: Synthetic coding sequence
atgcccggctggctgaccctgcccaccctgtgcagattcctgctgtgggccttcaccatcttccacaaggcccagggcgaccccgccagccaccccggcaccaccccccccagctacaaggtgagatggagcaaggtggagcccggcgagctgagagagaccctgatcctgatcaccaacggcctgcacgccagaggctacggccccctgggcggcagagccagaatgagaagaggccacagactggacgccagcctggtgatcgccggcgtgagactggaggacgagggcagatacagatgcgagctgatcaacggcatcgaggacgagagcgtggccctgaccctgagcctggagggcgtggtgttcccctaccagcccagcagaggcagataccagttcaactactacgaggccaagcaggcctgcgaggagcaggacggcagactggccacctacagccagctgtaccaggcctggaccgagggcctggactggtgcaacgccggctggctgctggagggcagcgtgagataccccgtgctgaccgccagagccccctgcggcggcagaggcagacccggcatcagaagctacggccccagagacagaatgagagacagatacgacgccttctgcttcaccagcgccctggccggccaggtgttcttcgtgcccggcagactgaccctgagcgaggcccacgccgcctgcagaagaagaggcgccgtggtggccaaggtgggccacctgtacgccgcctggaagttcagcggcctggaccagtgcgacggcggctggctggccgacggcagcgtgagattccccatcaccacccccagacccagatgcggcggcctgcccgaccccggcgtgagaagcttcggcttccccagaccccagcaggccgcctacggcacctactgctacgccgagaactag

SEQ ID NO: 5042 - DNA, 1089 bp, Artificial Sequence
  Description of Artificial Sequence: Synthetic coding sequence
atggcctggaccttcgagtgcagcagaaccaccagccccgagcccctgagcaccagcccctgcagaaccaccagcagcagaaacagccccaccatgagctgccccgccagcgtggcctgcgagcccagcaccagcaccaccaccagcagcccccccaaggcctgcctgaccagacccagcagccccagccccagctgcagcaccagcgcctggcacaacaagaacaacctgatcagcaaggtgcccagaggcgccctgagcagacagacccagctgagagagctgtacctgcagcacaaccagctgaccgacagcggcctggacgccaccaccttcagcaagctgcacagcctggagtacctggacctgagccacaaccagctgaccaccgtgcccgccggcctgcccagaaccctggccatcctgcacctgggcagaaacagaatcagacaggtggaggccgccagactgcacggcgccagaggcctgagatacctgctgctgcagcacaaccagctgggcagcagcggcctgcccgccggcgccctgagacccctgagaggcctgcacaccctgcacctgtacggcaacggcctggacagagtgccccccgccctgcccagaagactgagagccctggtgctgccccacaaccacgtggccgccctgggcgccagagacctggtggccacccccggcctgaccgagctgaacctggcctacaacagactggccagcgccagagtgcaccacagagccttcagaagactgagagccctgagaagcctggacctggccggcaaccagctgaccagactgcccatgggcctgcccaccggcctgagaaccctgcagctgcagagaaaccagctgagaatgctggagcccgagcccctggccggcctggaccagctgagagagctgagcctggcccacaacagactgagagtgggcgacatcggccccggcacctggcacgagctgcaggccctgcaggtgagacacagactggtgagccacaccgtgcccagagccccccccagcccctgcctgccctgccacgtgcccaacatcctggtgagctggtag

SEQ ID NO: 5043 - DNA, 900 bp, Artificial Sequence
  Description of Artificial Sequence: Synthetic coding sequence
atgctgcaccccgagaccagccccggcagaggccacctgctggccgtgctgctggccctgctgggcaccgcctgggccgaggtgtggcccccccagctgcaggagcaggcccccatggccggcgccctgaacagaaaggagagcttcctgctgctgagcctgcacaacagactgagaagctgggtgcagccccccgccgccgacatgagaagactggactggagcgacagcctggcccagctggcccagggcagccccctgtggaaccccaaccccgagcccggcgtgagacccgtggcccaccccgccagcggcctggagcacgccgccgcccccagagcctggtgccccctgagcaagtggagcctgtggttcgccgagggccagagatacagccacgccgccggcgagtgcgccagaaacgccacctgcacccactacacccagctggtgtgggccaccagcagccagctgggctgcggcagacacctgtgcagcgccggccaggccgccatcgaggccttcgtgtgcgcctacagccccagaggcaactgggaggtgaacggcaagaccatcgtgccctacaagaagggcgcctggtgcagcctgtgcaccgccagcgtgagcggctgcttcaaggcctgggaccacgccggcggcctgtgcgaggtgcccagaaacccctgcagaatgagctgccagaaccacggcagactgaacatcagcacctgccactgccactgcccccccggctacaccggcagatactgccaggtgagatgcagcctgcagtgcgtgcacggcagattcagagaggaggagtgcagctgcgtgtgcgacatcggctacgagcccagcgtgccccccagatgcatcttccccagcacccccgtgacctag

SEQ ID NO: 5044 - DNA, 1047 bp, Artificial Sequence
  Description of Artificial Sequence: Synthetic coding sequence
atgctggacaccaacctgatcctgctgcccctgttccagttcatcgtgcccaaggagtggaacagcaagtacagacccgtgtgcatccacctggccggcaccggcgaccaccactactggagaagaagaaccctgatggccagacccatgatcaaggaggccagaatggccagcctgctgctggagaacccctactacggctgcagaaagcccaaggaccaggtgagaagcagcctgaagaacgtgagcgacctgttcgtgatgggcggcgccctggtgctggagagcgccgccctgctgcactggctggagagagagggctacggccccctgggcatgaccggcatcagcatgggcggccacatggccagcctggccgtgagcaactggcccaagcccatgcccctgatcccctgcctgagctggagcaccgccagcggcgtgttcaccaccaccgacagcttcaagatgggccaggagttcgtgaagcacttcaccagcagcgccgacaagctgaccaacctgaacctggtgagcagaaccctgaacctggacatcagcaaccaggtggtgagccagaagcccgccgactgccacaacagcagcaagaccagcgtgagcgccaccagcgagggcctgctgctgcaggacaccagcaagatgaagagattcaaccagaccctgagcaccaacaagagcggctacaccagcagaaacccccagagctaccacctgctgagcaaggagcagagcagaaacagcctgagaaaggagagcctgatcttcatgaagggcgtgatggacgagtgcacccacgtggccaacttcagcgtgcccgtggaccccagcctgatcatcgtggtgcaggccaaggaggacgcctacatccccagaaccggcgtgagaagcctgcaggagatctggcccggctgcgagatcagatacctggagggcggccacatcagcgcctacctgttcaagcagggcctgttcagacaggccatctacgacgccttcgacagattcctgcacaagtacgccaactag

SEQ ID NO: 5045 - DNA, 1044 bp, Artificial Sequence
  Description of Artificial Sequence: Synthetic coding sequence
atgagagcctgcatcagcctggtgctggccgtgctgtgcggcctggcctgggccgacctgtacagcgcccccaccagctgccagggcagatgctacgaggccttcgacaagcaccaccagtgccactgcaacgccagatgccaggagttcggcaactgctgcaaggacttcgagagcctgtgcagcgaccacgaggtgagccacagcagcgacgccatcaccaaggaggagatccagagcatcagcgagaagatctacagagccgacaccaacaaggcccagaaggaggacatcgtgctgaacagccagaactgcatcagccccagcgagaccagaaaccaggtggacagatgccccaagcccctgttcacctacgtgaacgagaagctgttcagcaagcccacctacgccgccttcatcaacctgctgaacaactaccagagagccaccggccacggcgagcacttcagcgcccaggagctggccgagcaggacgccttcctgagagagatcatgaagaccgccgtgatgaaggagctgtacagcttcctgcaccaccagaacagatacggcagcgagcaggagttcgtggacgacctgaagaacatgtggttcggcctgtacagcagaggcaacgaggagggcgacagcagcggcttcgagcacgtgttcagcggcgaggtgaagaagggcaaggtgaccggcttccacaactggatcagattctacctggaggagaaggagggcctggtggactactacagccacatctacgacggcccctgggacagctaccccgacgtgctggccatgcagttcaactgggacggctactacaaggaggtgggcagcgccttcatcggcagcagccccgagttcgagttcgccctgtacagcctgtgcttcatcgccagacccggcaaggtgtgccagctgagcctgggcggctaccccctggccgtgagaacctacacctgggacaagagcacctacggcaacggcaagaagtacatcgccaccgcctacatcgtgagcagcacctag

SEQ ID NO: 5046 - DNA, 864 bp, Artificial Sequence
  Description of Artificial Sequence: Synthetic coding sequence
atgctgaagaagatcagcgtgggcgtggccggcgacctgaacaccgtgaccatgaagctgggctgcgtgctgatggcctgggccctgtacctgagcctgggcgtgctgtgggtggcccagatgctgctggccgccagcttcgagaccctgcagtgcgagggccccgtgtgcaccgaggagagcagctgccacaccgaggacgacctgaccgacgccagagaggccggcttccaggtgaaggcctacaccttcagcgagcccttccacctgatcgtgagctacgagctgttccccgcccccatcctgagagccgtgcccagcgccgagccccaggccggcagccccatgaccctgagctgccagaccaagctgcccctgcagagaagcgccgccagactgctgttcagcttctacaaggacggcagaatcgtgcagagcagaggcctgagcagcgagttccagatccccaccgccagcgaggaccacagcggcagctactggtgcgaggccgccaccgaggacaaccaggtgtggaagcagagcccccagctggagatcagagtgcagggcgccagcagcagcgccgccccccccaccctgaaccccgccccccagaagagcgccgcccccggcaccgcccccgaggaggcccccggccccctgccccccccccccacccccagcagcgaggaccccggcttcagcagccccctgggcatgcccgacccccacctgtaccaccagatgggcctgctgctgaagcacatgcaggacgtgagagtgctgctgggccacctgctgatggagctgagagagctgagcggccacagaaagcccggcaccaccaaggccaccgccgagtag

SEQ ID NO: 5047 - DNA, 1815 bp, Artificial Sequence; identical to SEQ ID NO: 3505
  Description of Artificial Sequence: Synthetic coding sequence

SEQ ID NO: 5048 - DNA, 1005 bp, Artificial Sequence
  Description of Artificial Sequence: Synthetic coding sequence
atgagaagcgccggcggcagaggcgagatcaaggtgagaagagagctgcagcccagcaagcaggtgagcggcctgaccaaccacgccagaaccggccaggagaagagaaacctgcagagactggtgctggagacccccagccagaacatcttcttcagccccgtgagcgtgagcaccagcctggccatgctgagcctgggcgcccacagcgtgaccaagacccagatcctgcagggcctgggcttcaacctgacccacacccccgagagcgccatccaccagggcttccagcacctggtgcacagcctgaccgtgcccagcaaggacctgaccctgaagatgggcagcgccctgttcgtgaagaaggagctgcagctgcaggccaacttcctgggcaacgtgaagagactgtacgaggccgaggtgttcagcaccgacttcagcaaccccagcatcgcccaggccagaatcaacagccacgtgaagaagaagacccagggcaaggtggtggacatcatccagggcctggacctgctgaccgccatggtgctggtgaaccacatcttcttcaaggccaagtgggagaagcccttccaccccgagtacaccagaaagaacttccccttcctggtgggcgagcaggtgaccgtgcacgtgcccatgatgcaccagaaggagcagttcgccttcggcgtggacaccgagctgaactgcttcgtgctgcagatggactacaagggcgacgccgtggccttcttcgtgctgcccagcaagggcaagatgagacagctggagcaggccctgagcgccagaaccctgagaaagtggagccacagcctgcagaagagatggatcgaggtgttcatccccagattcagcatcagcgccagctacaacctggagaccatcctgcccaagatgggcatccagaacgtgttcgacaagaacgccgacttcagcggcatcgccaagagagacagcctgcaggtgagcaaggtgagctag

SEQ ID NO: 5049 - DNA, 1065 bp, Artificial Sequence
  Description of Artificial Sequence: Synthetic coding sequence
atggcccccgccagaagacccgccggcgccagactgctgctggtgtacgccggcctgctggccgccgccgccgccggcctgggcagccccgagcccggcgcccccagcagaagcagagccagaagagagcccccccccggcaacgagctgcccagaggccccggcgagagcagagccggccccgccgccagaccccccgagcccaccgccgagagagcccacagcgtggaccccagagacgcctggatgctgttcgtgagacagagcgacaagggcgtgaacggcaagaagagaagcagaggcaaggccaagaagctgaagttcggcctgcccggcccccccggcccccccggcccccagggcccccccggccccatcatcccccccgaggccctgctgaaggagttccagctgctgctgaagggcgccgtgagacagagagagagagccgagcccgagccctgcacctgcggccccgccggccccgtggccgccagcctggcccccgtgagcgccaccgccggcgaggacgacgacgacgtggtgggcgacgtgctggccctgctggccgcccccctggcccccggccccagagcccccagagtggaggccgccttcctgtgcagactgagaagagacgccctggtggagagaagagccctgcacgagctgggcgtgtactacctgcccgacgccgagggcgccttcagaagaggccccggcctgaacctgaccagcggccagtacagagcccccgtggccggcttctacgccctggccgccaccctgcacgtggccctgggcgagccccccagaagaggcccccccagacccagagaccacctgagactgctgatctgcatccagagcagatgccagagaaacgccagcctggaggccatcatgggcctggagagcagcagcgagctgttcaccatcagcgtgaacggcgtgctgtacctgcagatgggccagtggaccagcgtgttcctggacaacgccagcggctgcagcctgaccgtgagaagcggcagccacttcagcgccgtgctgctgggcgtgtag

SEQ ID NO: 5050 - DNA, 2685 bp, Artificial Sequence; identical to SEQ ID NO: 4872
  Description of Artificial Sequence: Synthetic coding sequence

SEQ ID NO: 5051 - DNA, 2685 bp, Artificial Sequence; identical to SEQ ID NO: 4872
  Description of Artificial Sequence: Synthetic coding sequence

SEQ ID NO: 5052 - DNA, 2886 bp, Artificial Sequence; identical to SEQ ID NO: 4184
  Description of Artificial Sequence: Synthetic coding sequence

SEQ ID NO: 5053 - DNA, 2559 bp, Artificial Sequence; identical to SEQ ID NO: 4152
  Description of Artificial Sequence: Synthetic coding sequence

SEQ ID NO: 5054 - DNA, 756 bp, Artificial Sequence
  Description of Artificial Sequence: Synthetic coding sequence
atgccccacctggccagcctgttcaccgccagcagcagatgctgcccccaccccctgagacccgagggcagcggcgccatgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagaggcgagtggctgagcttcctgggcatctgcttcctgagcagaggcctggagggcggcgagtgcggcgagtgggccagcagaatccccagccccgccggcaagctgagcctgtag

SEQ ID NO: 5055 - DNA, 726 bp, Artificial Sequence
  Description of Artificial Sequence: Synthetic coding sequence
atgaagttcatcctgctgtgggccctgctgaacctgaccgtggccctggccttcaaccccgactacaccgtgagcagcacccccccctacctggtgtacctgaagagcgactacctgccctgcgccggcgtgctgatccaccccctgtgggtgatcaccgccgcccactgcaacctgcccaagctgagagtgatcctgggcgtgaccatccccgccgacagcaacgagaagcacctgcaggtgatcggctacgagaagatgatccaccacccccacttcagcgtgaccagcatcgaccacgacatcatgctgatcaagctgaagaccgaggccgagctgaacgactacgtgaagctggccaacctgccctaccagaccatcagcgagaacaccatgtgcagcgtgagcacctggagctacaacgtgtgcgacatctacaaggagcccgacagcctgcagaccgtgaacatcagcgtgatcagcaagccccagtgcagagacgcctacaagacctacaacatcaccgagaacatgctgtgcgtgggcatcgtgcccggcagaagacagccctgcaaggaggtgagcgccgcccccgccatctgcaacggcatgctgcagggcatcctgagcttcgccgacggctgcgtgctgagagccgacgtgggcatctacgccaagatcttctactacatcccctggatcgagaacgtgatccagaacaactag

SEQ ID NO: 5056 - DNA, 1536 bp, Artificial Sequence
  Description of Artificial Sequence: Synthetic coding sequence
atggccaagggcctgagcgtgcagaacgacaagcaccccggctaccagcccgccctgctgctgagccccggcgcccccctgttcgccgacggccccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 5057 - DNA, 2067 bp, Artificial Sequence; identical to SEQ ID NO: 4725
  Description of Artificial Sequence: Synthetic coding sequence

SEQ ID NO: 5058 - DNA, 2559 bp, Artificial Sequence; identical to SEQ ID NO: 4152
  Description of Artificial Sequence: Synthetic coding sequence

SEQ ID NO: 5059 - DNA, 1737 bp, Artificial Sequence; identical to SEQ ID NO: 4179
  Description of Artificial Sequence: Synthetic coding sequence

SEQ ID NO: 5060 - DNA, 1326 bp, Artificial Sequence; identical to SEQ ID NO: 4016
  Description of Artificial Sequence: Synthetic coding sequence

SEQ ID NO: 5061 - DNA, 2685 bp, Artificial Sequence; identical to SEQ ID NO: 4872
  Description of Artificial Sequence: Synthetic coding sequence

SEQ ID NO: 5062 - DNA, 216 bp, Artificial Sequence; identical to SEQ ID NO: 4200
  Description of Artificial Sequence: Synthetic coding sequence

SEQ ID NO: 5063 - DNA, 2760 bp, Artificial Sequence; identical to SEQ ID NO: 4172
  Description of Artificial Sequence: Synthetic coding sequence

SEQ ID NO: 5064 - DNA, 447 bp, Artificial Sequence; identical to SEQ ID NO: 4156
  Description of Artificial Sequence: Synthetic coding sequence

SEQ ID NO: 5065 - DNA, 5097 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagtaccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagaggcagcagcacctggctgaccgccttcgtgctgaaggtgctgagcctggcccaggagcaggtgggcggcagccccgagaagctgcaggagaccagcaactggctgctgagccagcagcaggccgacggcagcttccaggacctgagccccgtgatccacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccagcagcttcctgggcgagaaggccagcgccggcctgctgggcgcccacgccgccgccatcaccgcctacgccctgaccctgaccaaggcccccgccgacctgagaggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 5066 - DNA, 1986 bp, Artificial Sequence
  Description of Artificial Sequence: Synthetic coding sequence
atggacctggtgctgaagagatgcctgctgcacctggccgtgatcggcgccctgctggccgtgggcgccaccaaggtgcccagaaaccaggactggctgggcgtgagcagacagctgagaaccaaggcctggaacagacagctgtaccccgagtggaccgaggcccagagactggactgctggagaggcggccaggtgagcctgaaggtgagcaacgacggccccaccctgatcggcgccaacgccagcttcagcatcgccctgaacttccccggcagccagaaggtgctgcccgacggccaggtgatctgggtgaacaacaccatcatcaacggcagccaggtgtggggcggccagcccgtgtacccccaggagaccgacgacgcctgcatcttccccgacggcggcccctgccccagcggcagctggagccagaagagaagcttcgtgtacgtgtggaagacctggggccagtactggcaggtgctgggcggccccgtgagcggcctgagcatcggcaccggcagagccatgctgggcacccacaccatggaggtgaccgtgtaccacagaagaggcagcagaagctacgtgcccctggcccacagcagcagcgccttcaccatcaccgaccaggtgcccttcagcgtgagcgtgagccagctgagagccctggacggcggcaacaagcacttcctgagaaaccagcccctgaccttcgccctgcagctgcacgaccccagcggctacctggccgaggccgacctgagctacacctgggacttcggcgacagcagcggcaccctgatcagcagagccctggtggtgacccacacctacctggagcccggccccgtgaccgcccaggtggtgctgcaggccgccatccccctgaccagctgcggcagcagccccgtgcccggcaccaccgacggccacagacccaccgccgaggcccccaacaccaccgccggccaggtgcccaccaccgaggtggtgggcaccacccccggccaggcccccaccgccgagcccagcggcaccaccagcgtgcaggtgcccaccaccgaggtgatcagcaccgcccccgtgcagatgcccaccgccgagagcaccggcatgacccccgagaaggtgcccgtgagcgaggtgatgggcaccaccctggccgagatgagcacccccgaggccaccggcatgacccccgccgaggtgagcatcgtggtgctgagcggcaccaccgccgcccaggtgaccaccaccgagtgggtggagaccaccgccagagagctgcccatccccgagcccgagggccccgacgccagcagcatcatgagcaccgagagcatcaccggcagcctgggccccctgctggacggcaccgccaccctgagactggtgaagagacaggtgcccctggactgcgtgctgtacagatacggcagcttcagcgtgaccctggacatcgtgcagggcatcgagagcgccgagatcctgcaggccgtgcccagcggcgagggcgacgccttcgagctgaccgtgagctgccagggcggcctgcccaaggaggcctgcatggagatcagcagccccggctgccagccccccgcccagagactgtgccagcccgtgctgcccagccccgcctgccagctggtgctgcaccagatcctgaagggcggcagcggcacctactgcctgaacgtgagcctggccgacaccaacagcctggccgtggtgagcacccagctgatcatgcccggccaggaggccggcctgggccaggtgcccctgatcgtgggcatcctgctggtgctgatggccgtggtgctggccagcctgatctacagaagaagactgatgaagcaggacttcagcgtgccccagctgccccacagcagcagccactggctgagactgcccagaatcttctgcagctgccccatcggcgagaacagccccctgctgagcggccagcaggtgtag

SEQ ID NO: 5067 - DNA, 516 bp, Artificial Sequence; identical to SEQ ID NO: 4756
  Description of Artificial Sequence: Synthetic coding sequence

SEQ ID NO: 5068 - DNA, 1986 bp, Artificial Sequence; identical to SEQ ID NO: 5066
  Description of Artificial Sequence: Synthetic coding sequence

SEQ ID NO: 5069 - DNA, 1737 bp, Artificial Sequence; identical to SEQ ID NO: 4179
  Description of Artificial Sequence: Synthetic coding sequence

SEQ ID NO: 5070 - DNA, 1326 bp, Artificial Sequence; identical to SEQ ID NO: 4016
  Description of Artificial Sequence: Synthetic coding sequence

SEQ ID NO: 5071 - DNA, 447 bp, Artificial Sequence; identical to SEQ ID NO: 4156
  Description of Artificial Sequence: Synthetic coding sequence

SEQ ID NO: 5072 - DNA, 732 bp, Artificial Sequence; identical to SEQ ID NO: 4716
  Description of Artificial Sequence: Synthetic coding sequence

SEQ ID NO: 5073 - DNA, 732 bp, Artificial Sequence; identical to SEQ ID NO: 4716
  Description of Artificial Sequence: Synthetic coding sequence

SEQ ID NO: 5074 - DNA, 1224 bp, Artificial Sequence
  Description of Artificial Sequence: Synthetic coding sequence
atgagactgctggcctggctgatcttcctggccaactggggcggcgccagagccgagcccggcaagttctggcacatcgccgacctgcacctggaccccgactacaaggtgagcaaggaccccttccaggtgtgccccagcgccggcagccagcccgtgcccgacgccggcccctggggcgactacctgtgcgacagcccctgggccctgatcaacagcagcatctacgccatgaaggagatcgagcccgagcccgacttcatcctgtggaccggcgacgacaccccccacgtgcccgacgagaagctgggcgaggccgccgtgctggagatcgtggagagactgaccaagctgatcagagaggtgttccccggcgccttctactgcgagaagctgcccggccccagcggcgccggcagaatcgtggtgctgaacaccaacctgtactacaccagcaacgccctgaccgccgacatggccgaccccggccagcagttccagtggctggaggacgtgctgaccgacgccagcaaggccggcgacatggtgtacatcgtgggccacgtgccccccggcttcttcgagaagacccagaacaaggcctggttcagagagggcttcaacgagaagtacctgaaggtggtgagaaagcaccacagagtgatcgccggccagttcttcggccaccaccacaccgacagcttcagaatgctgtacgacgacgccggcgtgcccatcagcgccatgttcatcacccccggcgtgaccccctggaagaccaccctgcccggcgtggtgaacggcgccaacaaccccgccatcagagtgttcgagtacgacagagccaccctgagcctgaaggacatggtgacctacttcatgaacctgagccaggccaacgcccagggcacccccagatgggagctggagtaccagctgaccgaggcctacggcgtgcccgacgccagcgcccacagcatgcacaccgtgctggacagaatcgccggcgaccagagcaccctgcagagatactacgtgtacaacagcgtgagctacagcgccggcgtgtgcgacgaggcctgcagcatgcagcacgtgtgcgccatgagacaggtggacatcgacgcctacaccacctgcctgtacgccagcggcaccacccccgtgccccagctgcccctgctgctgatggccctgctgggcctgtgcaccctggtgctgtag

SEQ ID NO: 5075 - DNA, 756 bp, Artificial Sequence; identical to SEQ ID NO: 5054
  Description of Artificial Sequence: Synthetic coding sequence

SEQ ID NO: 5076 - DNA, 756 bp, Artificial Sequence; identical to SEQ ID NO: 5054
  Description of Artificial Sequence: Synthetic coding sequence

SEQ ID NO: 5077 - DNA, 456 bp, Artificial Sequence
  Description of Artificial Sequence: Synthetic coding sequence
atggacctggtgctgaagagatgcctgctgcacctggccgtgatcggcgccctgctggccgtgggcgccaccaaggtgcccagaaaccaggactggctgggcgtgagcagacagctgagaaccaaggcctggaacagacagctgtaccccgagtggaccgaggcccagagactggactgctggagaggcggccaggtgagcctgaaggtgagcaacgacggccccaccctgatcggcgccaacgccagcttcagcatcgccctgaacttccccggcagccagaaggtgctgcccgacggccaggtgatctgggtgaacaacaccatcatcaacggcagccaggtgtggggcggccagcccgtgtacccccaggagaccgacgacgcctgcatcttccccgacggcggcccctgccccagcggcagctggagccagaagagaagcttcgtgtactag

SEQ ID NO: 5078 - DNA, 216 bp, Artificial Sequence; identical to SEQ ID NO: 4200
  Description of Artificial Sequence: Synthetic coding sequence

SEQ ID NO: 5079 - DNA, 447 bp, Artificial Sequence; identical to SEQ ID NO: 4156
  Description of Artificial Sequence: Synthetic coding sequence

SEQ ID NO: 5080 - DNA, 447 bp, Artificial Sequence; identical to SEQ ID NO: 4156
  Description of Artificial Sequence: Synthetic coding sequence

SEQ ID NO: 5081 - DNA, 1326 bp, Artificial Sequence; identical to SEQ ID NO: 4016
  Description of Artificial Sequence: Synthetic coding sequence

SEQ ID NO: 5082 - DNA, 2067 bp, Artificial Sequence; identical to SEQ ID NO: 4725
  Description of Artificial Sequence: Synthetic coding sequence

SEQ ID NO: 5083 - DNA, 1326 bp, Artificial Sequence
  Description of Artificial Sequence: Synthetic coding sequence
atggagttcgagttcgacagactgagagccttccaggccatgcaggtgcactgcaacaacatgcacaccctgggcgccagactgcccggcggcgtggagtgcagattcagaagaggccccgccatggcctgggagggcgagcccatgagacacaacctgggcggcaacctgggcgaccccagagccagagccgtgagcgtgcccctgggcggcagagtggccagattcctgcagtgcagattcctgttcgccggcccctggctgctgttcagcgagatcagcttcatcagcgacgtggtgaacaacagcagccccgccctgggcggcaccttcccccccgccccctggtggccccccggccccccccccaccaacttcagcagcctggagctggagcccagaggccagcagcccgtggccaaggccgagggcagccccaccgccatcctgatcggctgcctggtggccatcatcctgctgctgctgctgatcatcgccctgatgctgtggagactgcactggagaagactgctgagcaaggtgctggagagccaccccagaaccagaagccccggcctggtgggcatcagacccaccctgctgcccgtgagccccatggccctgagatgctgcagccccatccagcccaccgccagcttctggcccctgacccccgtgcccctggaggccagagcccccccccacccccccggccccaacccccccacccccagaggcgtgaccggcggcaacacctacgccgtgcccgccctgccccccggcgccgtgggcgacggcccccccagagtggacttccccagaagcagactgagattcaaggagaagctgggcgagggccagttcggcgaggtgcacctgtgcgaggtggacagcccccaggacctggtgagcctggacttccccctgaacgtgagaaagggccaccccctgctggtggccgtgaagatcctgagacccgacgccaccaagaacgccagaaacgacttcctgaaggaggtgaagatcatgagcagactgaaggaccccaacatcatcagactgctgggcgtgtgcgtgcaggacgaccccctgtgcatgatcaccgactacatggagaacggcgacctgaaccagttcctgagcgcccaccagctggaggacaaggccgccgagggcgcccccggcgacggccaggccgcccagggccccaccatcagctaccccatgctgctgcacgtggccgcccagatcgccagcggcatgagatacctggccaccctgaacttcgtgcacttctggggcgagagacacagattcctgcactag

SEQ ID NO: 5084 - DNA, 2559 bp, Artificial Sequence; identical to SEQ ID NO: 4152
  Description of Artificial Sequence: Synthetic coding sequence

SEQ ID NO: 5085 - DNA, 732 bp, Artificial Sequence; identical to SEQ ID NO: 4716
  Description of Artificial Sequence: Synthetic coding sequence

SEQ ID NO: 5086 - DNA, 2760 bp, Artificial Sequence; identical to SEQ ID NO: 4172
  Description of Artificial Sequence: Synthetic coding sequence

SEQ ID NO: 5087 - DNA, 2700 bp, Artificial Sequence; identical to SEQ ID NO: 4183
  Description of Artificial Sequence: Synthetic coding sequence

SEQ ID NO: 5088 - DNA, 447 bp, Artificial Sequence; identical to SEQ ID NO: 4156
  Description of Artificial Sequence: Synthetic coding sequence

SEQ ID NO: 5089 - DNA, 516 bp, Artificial Sequence; identical to SEQ ID NO: 4756
  Description of Artificial Sequence: Synthetic coding sequence

SEQ ID NO: 5090 - DNA, 666 bp, Artificial Sequence
  Description of Artificial Sequence: Synthetic coding sequence
atgaccacccagctgagagtggtgcacctgctgcccctgctgctggcctgcttcgtgcagaccagccccaagcaggagaagatgaagatggactgccacaaggacgagaagggcaccatctacgactacgaggccatcgccctgaacaagaacgagtacgtgagcttcaagcagtacgtgggcaagcacatcctgttcgtgaacgtggccacctactgcggcctgaccgcccagtaccccgagctgaacgccctgcaggaggagctgaagccctacggcctggtggtgctgggcttcccctgcaaccagttcggcaagcaggagcccggcgacaacaaggagatcctgcccggcctgaagtacgtgagacccggcggcggcttcgtgcccagcttccagctgttcgagaagggcgacgtgaacggcgagaaggagcagaaggtgttcagcttcctgaagcacagctgcccccaccccagcgagatcctgggcaccttcaagagcatcagctgggaccccgtgaaggtgcacgacatcagatggaacttcgagaagttcctggtgggccccgacggcatccccgtgatgagatggagccacagagccaccgtgagcagcgtgaagaccgacatcctggcctacctgaagcagttcaagaccaagtag

SEQ ID NO: 5091 - DNA, 447 bp, Artificial Sequence; identical to SEQ ID NO: 4156
  Description of Artificial Sequence: Synthetic coding sequence

SEQ ID NO: 5092 - DNA, 1737 bp, Artificial Sequence; identical to SEQ ID NO: 4179
  Description of Artificial Sequence: Synthetic coding sequence

SEQ ID NO: 5093 - DNA, 1737 bp, Artificial Sequence; identical to SEQ ID NO: 4179
  Description of Artificial Sequence: Synthetic coding sequence

SEQ ID NO: 5094 - DNA, 756 bp, Artificial Sequence; identical to SEQ ID NO: 5054
  Description of Artificial Sequence: Synthetic coding sequence

SEQ ID NO: 5095 - DNA, 1764 bp, Artificial Sequence
  Description of Artificial Sequence: Synthetic coding sequence
atgagacccagaggcctgccccccctgctggtggtgctgctgggctgctgggccagcgtgagcgcccagaccgacgccacccccgccgtgaccaccgagggcctgaacagcaccgaggccgccctggccaccttcggcaccttccccagcaccagaccccccggcacccccagagcccccggccccagcagcggccccagacccacccccgtgaccgacgtggccgtgctgtgcgtgtgcgacctgagccccgcccagtgcgacatcaactgctgctgcgaccccgactgcagcagcgtggacttcagcgtgttcagcgcctgcagcgtgcccgtggtgaccggcgacagccagttctgcagccagaaggccgtgatctacagcctgaacttcaccgccaaccccccccagagagtgttcgagctggtggaccagatcaaccccagcatcttctgcatccacatcaccaactacaagcccgccctgagcttcatcaaccccgaggtgcccgacgagaacaacttcgacaccctgatgaagaccagcgacggcttcaccctgaacgccgagagctacgtgagcttcaccaccaagctggacatccccaccgccgccaagtacgagtacggcgtgcccctgcagaccagcgacagcttcctgagattccccagcagcctgaccagcagcctgtgcaccgacaacaaccccgccgccttcctggtgaaccaggccgtgaagtgcaccagaaagatcaacctggagcagtgcgaggagatcgaggccctgagcatggccttctacagcagccccgagatcctgagagtgcccgacagcagaaagaaggtgcccatcaccgtgcagagcatcgtgatccagagcctgaacaagaccctgaccagaagagaggacaccgacgtgctgcagcccaccctggtgaacgccggccacttcagcctgtgcgtgaacgtggtgctggaggtgaagtacagcctgacctacaccgacgccggcgaggtgaccaaggccgacctgagcttcgtgctgggcaccgtgagcagcgtggtggtgcccctgcagcagaagttcgagatccacttcctgcaggagaacacccagcccgtgcccctgagcggcaaccccggctacgtggtgggcctgcccctggccgccggcttccagccccacaagggcagcggcatcatccagaccaccaacagatacggccagctgaccatcctgcacagcaccaccgagcaggactgcctggccctggagggcgtgagaacccccgtgctgttcggctacaccatgcagagcggctgcaagctgagactgaccggcgccctgccctgccagctggtggcccagaaggtgaagagcctgctgtggggccagggcttccccgactacgtggcccccttcggcaacagccaggcccaggacatgctggactgggtgcccatccacttcatcacccagagcttcaacagaaaggacagctgccagctgcccggcgccctggtgatcgaggtgaagtggaccaagtacggcagcctgctgaacccccaggccaagatcgtgaacgtgaccgccaacctgatcagcagcagcttccccgaggccaacagcggcaacgagagaaccatcctgatcagcaccgccgtgaccttcgtggacgtgagcgcccccgccgaggccggcttcagagccccccccgccatcaacgccagactgcccttcaacttcttcttccccttcgtgtag

SEQ ID NO: 5096 - DNA, 2067 bp, Artificial Sequence; identical to SEQ ID NO: 4725
  Description of Artificial Sequence: Synthetic coding sequence

SEQ ID NO: 5097 - DNA, 303 bp, Artificial Sequence
  Description of Artificial Sequence: Synthetic coding sequence
atgaccacccagctgagagtggtgcacctgctgcccctgctgctggcctgcttcgtgcagaccagccccaagcaggagaagatgaagatggactgccacaaggacgagaagggcaccatctacgactacgaggccatcgccctgaacaagaacgagtacgtgagcttcaagcagtacgtgggcaagcacatcctgttcgtgaacgtggccacctactgcggcctgaccgcccagtaccccggcatgagcgtgcagggcgaggacctgtacctggtgagcagcttcctgagaaagggcatgtag

SEQ ID NO: 5098 - DNA, 705 bp, Artificial Sequence
  Description of Artificial Sequence: Synthetic coding sequence
atgaagaccctggccggcctggtgctgggcctggtgatcttcgacgccgccgtgaccgcccccaccctggagagcatcaactacgacagcgagacctacgacgccaccctggaggacctggacaacctgtacaactacgagaacatccccgtggacaaggtggagatcgagatcgccaccgtgatgcccagcggcaacagagagctgctgaccccccccccccagcccgagaaggcccaggaggaggaggaggaggaggagagcacccccagactgatcgacggcagcagcccccaggagcccgagttcaccggcgtgctgggcccccacaccaacgaggacttccccacctgcctgctgtgcacctgcatcagcaccaccgtgtactgcgacgaccacgagctggacgccatcccccccctgcccaagaacaccgcctacttctacagcagattcaacagaatcaagaagatcaacaagaacgacttcgccagcctgagcgacctgaagagaatcgacctgaccagcaacctgatcagcgagatcgacgaggacgccttcagaaagctgccccagctgagagagctggtgctgagagacaacaagatcagacagctgcccgagctgcccaccaccctgaccttcatcgacatcagcaacaacagactgggcagaaagggcatcaagcaggaggccttcaagtag

SEQ ID NO: 5099 - DNA, 2559 bp, Artificial Sequence; identical to SEQ ID NO: 4152
  Description of Artificial Sequence: Synthetic coding sequence

SEQ ID NO: 5100 - DNA, 2760 bp, Artificial Sequence; identical to SEQ ID NO: 4172
  Description of Artificial Sequence: Synthetic coding sequence

SEQ ID NO: 5101 - DNA, 1737 bp, Artificial Sequence; identical to SEQ ID NO: 4179
  Description of Artificial Sequence: Synthetic coding sequence

SEQ ID NO: 5102 - DNA, 516 bp, Artificial Sequence; identical to SEQ ID NO: 4756
  Description of Artificial Sequence: Synthetic coding sequence

SEQ ID NO: 5103 - DNA, 2067 bp, Artificial Sequence; identical to SEQ ID NO: 4725
  Description of Artificial Sequence: Synthetic coding sequence

SEQ ID NO: 5104 - DNA, 5097 bp, Artificial Sequence; identical to SEQ ID NO: 5065
  Description of Artificial Sequence: Synthetic coding sequence

SEQ ID NO: 5105 - DNA, 726 bp, Artificial Sequence; identical to SEQ ID NO: 5055
  Description of Artificial Sequence: Synthetic coding sequence

SEQ ID NO: 5106 - DNA, 732 bp, Artificial Sequence; identical to SEQ ID NO: 4716
  Description of Artificial Sequence: Synthetic coding sequence

SEQ ID NO: 5107 - DNA, 1986 bp, Artificial Sequence; identical to SEQ ID NO: 5066
  Description of Artificial Sequence: Synthetic coding sequence

SEQ ID NO: 5108 - DNA, 2760 bp, Artificial Sequence; identical to SEQ ID NO: 4172
  Description of Artificial Sequence: Synthetic coding sequence

SEQ ID NO: 5109 - DNA, 216 bp, Artificial Sequence; identical to SEQ ID NO: 4200
  Description of Artificial Sequence: Synthetic coding sequence

SEQ ID NO: 5110 - DNA, 2685 bp, Artificial Sequence; identical to SEQ ID NO: 4872
  Description of Artificial Sequence: Synthetic coding sequence

SEQ ID NO: 5111 - DNA, 273 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagcaccaagatgcagtag

SEQ ID NO: 5112 - DNA, 618 bp, Artificial Sequence; identical to SEQ ID NO: 3886
  Description of Artificial Sequence: Synthetic coding sequence

SEQ ID NO: 5113 - DNA, 30 bp, Artificial Sequence
  Description of Artificial Sequence: Synthetic coding sequence
atgagcttcagcgccaccatcctgttctag

SEQ ID NO: 5114 - DNA, 600 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgccctgggcctggccagagccaacaacgagctgctgaagagactgcaggaggaggtgggcgacctgagacagggcaaggtgagcatccccgacgaggacggcgagagcagagcccacagcagcccccccgaggagcccggccccctgaaggagagccccggcgaggccttcaaggccctgagcgccgtggaggaggagtgcgacagcgtgggcagcggcgtgcaggtggtgatcgaggagctgagacagctgggcgccgccagcgtgggccccggccccctgggcttccccgccacccagagagacatgagactgcccggctgcaccctggccgccagcgaggccgcccccctgctgaacccctag

SEQ ID NO: 5115 - DNA, 633 bp, Artificial Sequence; identical to SEQ ID NO: 4443
  Description of Artificial Sequence: Synthetic coding sequence

SEQ ID NO: 5116 - DNA, 1221 bp, Artificial Sequence; identical to SEQ ID NO: 3821
  Description of Artificial Sequence: Synthetic coding sequence

SEQ ID NO: 5117 - DNA, 600 bp, Artificial Sequence; identical to SEQ ID NO: 3864
  Description of Artificial Sequence: Synthetic coding sequence

SEQ ID NO: 5118 - DNA, 411 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgccctgggcctggccagagccaacaacgagctgctgaagagactgcaggaggaggtgggcgacctgagacagggcaaggtgagcatccccgacgaggacggcgagagcagagcccacagcagcccccccgaggagcccggccccctgaaggagagccccggcgaggccttcaagtag

SEQ ID NO: 5119 - DNA, 252 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgccctgggcctggcctag

SEQ ID NO: 5120 - DNA, 30 bp, Artificial Sequence; identical to SEQ ID NO: 5113
  Description of Artificial Sequence: Synthetic coding sequence

SEQ ID NO: 5121 - DNA, 519 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagcaccaagatgcagatcctggagggcctgggcctgaacctgcagaagagcagcgagaaggagctgcacagaggcttccagcagctgctgcaggagctgaaccagcccagagacggcttccagctgagcctgggcaacgccctgttcaccgacctggtggtggacctgcaggacaccttcgtgagcgccatgaagaccctgtacctggccgacaccttccccaccaacttcagagacagcgccggcgccatgaagcagatctag

SEQ ID NO: 5122 - DNA, 615 bp, Artificial Sequence
  Description of Artificial Sequence: Synthetic coding sequence
atgcccggcggcaagaaggtggccggcggcggcagcagcggcgccacccccaccagcgccgccgccaccgcccccagcggcgtgagaagactggagaccagcgagggcaccagcgcccagagagacgaggagcccgaggaggagggcgaggaggacctgagagacggcggcgtgcccttcttcgtgaacagaggcggcctgcccgtggacgaggccacctgggagagaatgtggaagcacgtggccaagatccaccccgacggcgagaaggtggcccagagaatcagaggcgccaccgacctgcccaagatccccatccccagcgtgcccaccttccagcccagcacccccgtgcccgagagactggaggccgtgcagagatacatcagagagctgcagtacaaccacaccggcacccagttcttcgagatcaagaagagcagacccctgaccggcctgatggacctggccaaggagatgaccaaggaggccctgcccatcaagtgcctggaggccgtgatcctgggcatgtaccccagcagccccgagggcgagggcagcggcctgctgtgggccagcgccagctgcagcgagagcgagggcggcgtgggctag

SEQ ID NO: 5123 - DNA, 1221 bp, Artificial Sequence; identical to SEQ ID NO: 3821
  Description of Artificial Sequence: Synthetic coding sequence

SEQ ID NO: 5124 - DNA, 3837 bp, Artificial Sequence; identical to SEQ ID NO: 4578
  Description of Artificial Sequence: Synthetic coding sequence

SEQ ID NO: 5125 - DNA, 261 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagctag

SEQ ID NO: 5126 - DNA, 906 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagcaccaagatgcagatcctggagggcctgggcctgaacctgcagaagagcagcgagaaggagctgcacagaggcttccagcagctgctgcaggagctgaaccagcccagagacggcttccagctgagcctgggcaacgccctgttcaccgacctggtggtggacctgcaggacaccttcgtgagcgccatgaagaccctgtacctggccgacaccttccccaccaacttcagagacagcgccggcgccatgaagcagatcaacgactacgtggccaagcagaccaagggcaagatcgtggacctgctgaagaacctggacagcaacgccgtggtgatcatggtgaactacatcttcttcaaggccaagtgggagaccagcttcaaccacaagggcacccaggagcaggacttctacgtgaccagcgagaccgtggtgagagtgcccatgatgagcagagaggaccagtaccactacctgctggacagaaacctgagctgcagagtggtgggcgtgccctaccagggcaacgccaccgccctgttcatcctgcccagcgagggcaagatgcagcaggtggagaacggcctgagcgagaagaccctgagaaagtggctgaagatgttcaagaagagatacttccagacctag

SEQ ID NO: 5127 - DNA, 411 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcaccgacgaggagatgcagtacgacatggccaagagcggccaggagaagcagaccatcgagatcctgatgaaccccatcctgctggtgaagaacaccagcctgagcatgagcaaggacgacatgagcagcaccctgctgaccttcagaagcctgcactacaacgaccccaagggcaacagcagcggcaacgacaaggagtgctgcaacgacatgaccgtgtggagaaaggtgagcgaggccaacggcagctgcaagtggagcaacaacttcatcagaagcagcaccgaggtgatgagaagagtgcacagagcccccagctag

SEQ ID NO: 5128 - DNA, 1221 bp, Artificial Sequence; identical to SEQ ID NO: 3821
  Description of Artificial Sequence: Synthetic coding sequence

SEQ ID NO: 5129 - DNA, 618 bp, Artificial Sequence; identical to SEQ ID NO: 3886
  Description of Artificial Sequence: Synthetic coding sequence

SEQ ID NO: 5130 - DNA, 240 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgcctag

SEQ ID NO: 5131 - DNA, 618 bp, Artificial Sequence; identical to SEQ ID NO: 3886
  Description of Artificial Sequence: Synthetic coding sequence

SEQ ID NO: 5132 - DNA, 3789 bp, Artificial Sequence
  Description of Artificial Sequence: Synthetic coding sequence
atgagactgctgctgctggtgcccctgctgctggcccccgcccccggcagcagcgcccccaaggtgagaagacagagcgacacctggggcccctggagccagtggagcccctgcagcagaacctgcggcggcggcgtgagcttcagagagagaccctgctacagccagagaagagacggcggcagcagctgcgtgggccccgccagaagccacagaagctgcagaaccgagagctgccccgacggcgccagagacttcagagccgagcagtgcgccgagttcgacggcgccgagttccagggcagaagatacagatggctgccctactacagcgcccccaacaagtgcgagctgaactgcatccccaagggcgagaacttctactacaagcacagagaggccgtggtggacggcaccccctgcgagcccggcaagagagacgtgtgcgtggacggcagctgcagagtggtgggctgcgaccacgagctggacagcagcaagcaggaggacaagtgcctgagatgcggcggcgacggcaccacctgctaccccgtggccggcaccttcgacgccaacgacctgagcagaggctacaaccagatcctgatcgtgcccatgggcgccaccagcatcctgatcgacgaggccgccgccagcagaaacttcctggccgtgaagaacgtgagaggcgagtactacctgaacggccactggaccatcgaggccgccagagccctgcccgccgccagcaccatcctgcactacgagagaggcgccgagggcgacctggcccccgagagactgcacgccagaggccccaccagcgagcccctggtgatcgagctgatcagccaggagcccaaccccggcgtgcactacgagtaccacctgcccctgagaagacccagccccggcttcagctggagccacggcagctggagcgactgcagcgccgagtgcggcggcggccaccagagcagactggtgttctgcaccatcgaccacgaggcctaccccgaccacatgtgccagagacagcccagacccgccgacagaagaagctgcaacctgcacccctgccccgagaccaagagatggaaggccggcccctgggccccctgcagcgccagctgcggcggcggcagccagagcagaagcgtgtactgcatcagcagcgacggcgccggcatccaggaggccgtggaggaggccgagtgcgccggcctgcccggcaagccccccgccatccaggcctgcaacctgcagagatgcgccgcctggagccccgagccctggggcgagtgcagcgtgagctgcggcgtgggcgtgagaaagagaagcgtgacctgcagaggcgagagaggcagcctgctgcacaccgccgcctgcagcctggaggacagaccccccctgaccgagccctgcgtgcacgaggactgccccctgctgagcgaccaggcctggcacgtgggcacctggggcctgtgcagcaagagctgcagcagcggcaccagaagaagacaggtgatctgcgccatcggcccccccagccactgcggcagcctgcagcacagcaagcccgtggacgtggagccctgcaacacccagccctgccacctgccccaggaggtgcccagcatgcaggacgtgcacacccccgccagcaacccctggatgcccctgggcccccaggagagccccgccagcgacagcagaggccagtggtgggccgcccaggagcaccccagcgccagaggcgaccacagaggcgagagaggcgaccccagaggcgaccagggcacccacctgagcgccctgggccccgcccccagcctgcagcagcccccctaccagcagcccctgagaagcggcagcggcccccacgactgcagacacagcccccacggctgctgccccgacggccacaccgccagcctgggcccccagtggcagggctgccccggcgccccctgccagcagagcagatacggctgctgccccgacagagtgagcgtggccgagggcccccaccacgccggctgcaccaagagctacggcggcgacagcaccggcggcatgcccagaagcagagccgtggccagcaccgtgcacaacacccaccagccccaggcccagcagaacgagcccagcgagtgcagaggcagccagttcggctgctgctacgacaacgtggccaccgccgccggccccctgggcgagggctgcgtgggccagcccagccacgactgggccgccagatggtacttcgtggccagcgtgggccagtgcaacagattctggtacggcggctgccacggcaacgccaacaacttcgccagcgagcaggagtgcatgagcagctgccagggcagcctgcacggccccagaagaccccagcccggcgccagcggcagaagcacccacaccgacggcggcggcagcagccccgccggcgagcaggagcccagccagcacagaaccggcgccgccgtgcagagaaagccctggcccagcggcggcctgtggagacaggaccagcagcccggccccggcgaggccccccacacccaggccttcggcgagtggccctggggccaggagctgggcagcagagcccccggcctgggcggcgacgccggcagccccgccccccccttccacagcagcagctacagaatcagcctggccggcgtggagcccagcctggtgcaggccgccctgggccagctggtgagactgagctgcagcgacgacaccgcccccgagagccaggccgcctggcagaaggacggccagcccatcagcagcgacagacacagactgcagttcgacggcagcctgatcatccaccccctgcaggccgaggacgccggcacctacagctgcggcagcaccagacccggcagagacagccagaagatccagctgagaatcatcggcggcgacatggccgtgctgagcgaggccgagctgagcagattcccccagcccagagaccccgcccaggacttcggccaggccggcgccgccggccccctgggcgccatccccagcagccacccccagcccgccaacagactgagactggaccagaaccagcccagagtggtggacgccagccccggccagagaatcagaatgacctgcagagccgagggcttccccccccccgccatcgagtggcagagagacggccagcccgtgagcagccccagacaccagctgcagcccgacggcagcctggtgatcagcagagtggccgtggaggacggcggcttctacacctgcgtggccttcaacggccaggacagagaccagagatgggtgcagctgagagtgctgggcgagctgaccatcagcggcctgccccccaccgtgaccgtgcccgagggcgacaccgccagactgctgtgcgtggtggccggcgagagcgtgaacatcagatggagcagaaacggcctgcccgtgcaggccgacggccacagagtgcaccagagccccgacggcaccctgctgatctacaacctgagagccagagacgagggcagctacacctgcagcgcctaccagggcagccaggccgtgagcagaagcaccgaggtgaaggtggtgagccccgcccccaccgcccagcccagagaccccggcagagactgcgtggaccagcccgagctggccaactgcgacctgatcctgcaggcccagctgtgcggcaacgagtactacagcagcttctgctgcgccagctgcagcagattccagccccacgcccagcccatctggcagtag

SEQ ID NO: 5133 - DNA, 321 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggccacggcctggccgtgcagagcagcgagcagctgctgcacgtgatctaccagagagtggacaaggccgtgggcctggccgaggccgccctgggcctggccagagccaacaacgagctgctgaagagactgcaggaggaggtgggcgacctgagacagggcaaggtgagctag

SEQ ID NO: 5134 - DNA, 444 bp, Artificial Sequence; identical to SEQ ID NO: 4387
  Description of Artificial Sequence: Synthetic coding sequence

SEQ ID NO: 5135 - DNA, 435 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagcaccaagatgcagatcctggagggcctgggcctgaacctgcagaagagcagcgagaaggagctgcacagaggcttccagcagctgctgcaggagctgaaccagcccagagacggcttccagctgagcctgggcaacgccctgttcaccgacctggtggtggacctgcaggacacctag

SEQ ID NO: 5136 - DNA, 540 bp, Artificial Sequence; identical to SEQ ID NO: 4858
  Description of Artificial Sequence: Synthetic coding sequence

SEQ ID NO: 5137 - DNA, 444 bp, Artificial Sequence; identical to SEQ ID NO: 4387
  Description of Artificial Sequence: Synthetic coding sequence

SEQ ID NO: 5138 - DNA, 600 bp, Artificial Sequence; identical to SEQ ID NO: 3864
  Description of Artificial Sequence: Synthetic coding sequence

SEQ ID NO: 5139 - DNA, 153 bp, Artificial Sequence
  Description of Artificial Sequence: Synthetic coding sequence
atgagcttcagcgccaccatcctgttcagcccccccagcggcagcgaggccagatgctgctgctgcgcctgcaagagcgagaccaacggcggcaacaccggcagccagggcggcaaccccccccccagcacccccatcaccgtgaccggctag

SEQ ID NO: 5140 - DNA, 75 bp, Artificial Sequence
  Description of Artificial Sequence: Synthetic coding sequence
atgcagctgttcctgctgctgtgcctggtgctgctgagcccccagggcgccagcctgcacagacaccacccctag

SEQ ID NO: 5141 - DNA, 633 bp, Artificial Sequence; identical to SEQ ID NO: 4443
  Description of Artificial Sequence: Synthetic coding sequence

SEQ ID NO: 5142 - DNA, 36 bp, Artificial Sequence
  Description of Artificial Sequence: Synthetic coding sequence
atgagcttcagcgccaccatcctgttcagcccctag

SEQ ID NO: 5143 - DNA, 444 bp, Artificial Sequence; identical to SEQ ID NO: 4267
  Description of Artificial Sequence: Synthetic coding sequence

SEQ ID NO: 5144 - DNA, 696 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagcaccaagatgcagatcctggagggcctgggcctgaacctgcagaagagcagcgagaaggagctgcacagaggcttccagcagctgctgcaggagctgaaccagcccagagacggcttccagctgagcctgggcaacgccctgttcaccgacctggtggtggacctgcaggacaccttcgtgagcgccatgaagaccctgtacctggccgacaccttccccaccaacttcagagacagcgccggcgccatgaagcagatcaacgactacgtggccaagcagaccaagggcaagatcgtggacctgctgaagaacctggacagcaacgccgtggtgatcatggtgaactacatcttcttcaaggccaagtgggagaccagcttcaaccacaagggcacccaggagcaggacttctacgtgaccagcgagaccgtggtgtag

SEQ ID NO: 5145 - DNA, 1626 bp, Artificial Sequence
  Description of Artificial Sequence: Synthetic coding sequence
atggccaagttcggcgtgcacagaatcctgctgctggccatcagcctgaccaagtgcctggagagcaccaagctgctggccgacctgaagaagtgcggcgacctggagtgcgaggccctgatcaacagagtgagcgccatgagagactacagaggccccgactgcagatacctgaacttcaccaagggcgaggagatcagcgtgtacgtgaagctggccggcgagagagaggacctgtgggccggcaagggcaaggagttcggctacttccccagagacgccgtgcagatcgaggaggtgttcatcagcgaggagatccagatgagcaccaaggagagcgacttcctgtgcctgctgggcgtgagctacaccttcgacaacgaggacagcgagctgaacggcgactacggcgagaacatctacccctacgaggaggacaaggacgagaagagcagcatctacgagagcgacttccagatcgagcccggcttctacgccacctacgagagcaccctgttcgaggaccaggtgcccgccctggaggcccccgaggacatcggcagcaccagcgagagcaaggactgggaggaggtggtggtggagagcatggagcaggacagaatccccgaggtgcacgtgccccccagcagcgccgtgagcggcgtgaaggagtggttcggcctgggcggcgagcaggccgaggagaaggccttcgagagcgtgatcgagcccgtgcaggagagcagcttcagaagcagaaagatcgccgtggaggacgagaacgacctggaggagctgaacaacggcgagccccagaccgagcaccagcaggagagcgagagcgagatcgacagcgtgcccaagacccagagcgagctggccagcgagagcgagcacatccccaagccccagagcaccggctggttcggcggcggcttcaccagctacctgggcttcggcgacgaggacaccggcctggagctgatcgccgaggagagcaacccccccctgcaggacttccccaacagcatcagcagcgacaaggaggccaccgtgccctgcaccgagatcctgaccgagaagaaggacaccatcaccaacgacagcctgagcctgaagcccagctggttcgacttcggcttcgccatcctgggcttcgcctacgccaaggaggacaagatcatgctggacgacagaaagaacgaggaggacggcggcgccgacgagcacgagcaccccctgaccagcgagctggaccccgagaaggagcaggagatcgagaccatcaagatcatcgagaccgaggaccagatcgacaagaagcccgtgagcgagaagaccgacgagagcgacaccatcccctacctgaagaagttcctgtacaacttcgacaacccctggaacttccagaacatccccaaggagaccgagctgcccttccccaagcagatcctggaccagaacaacgtgatcgagaacgaggagaccggcgagttcagcatcgacaactaccccaccgacaacaccaaggtgatgatcttcaagagcagctacagcctgagcggctggtacgagaacatctacatcagaatctacttcatcttcaagcacaacctgttcctgtag

SEQ ID NO: 5146 - DNA, 1245 bp, Artificial Sequence; identical to SEQ ID NO: 3905
  Description of Artificial Sequence: Synthetic coding sequence

SEQ ID NO: 5147 - DNA, 618 bp, Artificial Sequence; identical to SEQ ID NO: 3886
  Description of Artificial Sequence: Synthetic coding sequence

SEQ ID NO: 5148 - DNA, 516 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcaccgacgaggagatgcagtacgacatggccaagagcggccaggagaagcagaccatcgagatcctgatgaaccccatcctgctggtgaagaacaccagcctgagcatgagcaaggacgacatgagcagcaccctgctgaccttcagaagcctgcactacaacgaccccaagggcaacagcagcggcaacgacaaggagtgctgcaacgacatgaccgtgtggagaaaggtgagcgaggccaacggcagctgcaagtggagcaacaacttcatcagaagcagcaccgaggtgatgagaagagtgcacagagcccccagctgcaagttcgtgcagaaccccggcatcagctgctgcgagagcctggagctggagaacaccgtgtgccagttcaccaccggcaagcagttccccagatgccagtactag

SEQ ID NO: 5149 - DNA, 633 bp, Artificial Sequence; identical to SEQ ID NO: 4443
  Description of Artificial Sequence: Synthetic coding sequence

SEQ ID NO: 5150 - DNA, 537 bp, Artificial Sequence; identical to SEQ ID NO: 4691
  Description of Artificial Sequence: Synthetic coding sequence

SEQ ID NO: 5151 - DNA, 474 bp, Artificial Sequence
  Description of Artificial Sequence: Synthetic coding sequence
atgcagctgttcctgctgctgtgcctggtgctgctgagcccccagggcgccagcctgcacagacaccaccccagagagatgaagaagagagtggaggacctgcacgtgggcgccaccgtggcccccagcagcagaagagacttcaccttcgacctgtacagagccctggccagcgccgcccccagccagagcatcttcttcagccccgtgagcatcagcatgagcctggccatgctgagcctgggcgccggcagcagcaccaagatgcagatcctggagggcctgggcctgaacctgcagaagagcagcgagaaggagctgcacagaggcttccagcagctgctgcaggagctgaaccagcccagagacggcttccagctgagcctgggcaacgccctgttcaccgacctggtggtggacctgcaggacaccttcgtgagcgccatgaagaccctgtacctggccgacacctag

SEQ ID NO: 5152 - DNA, 1035 bp, Artificial Sequence
  Description of Artificial Sequence: Synthetic coding sequence
atgccccccagaatgctggtggcccccctgcccctgcacttcctgctggccgccgtgagcagcgagaacagaagcggcagaagacagtggcagcaggccgtggccgccggcagcggccccggcagaaacagcagcagagccatccactggagcctgcccagagccctggtgcccgccaccggcaccagagccagcggcagccagaagagacagagaccccccaagggccaggaggccctgtggagcagaccccacagcagacacagcgccgagagagccggcggcagccacagcgaccccggcagactgagcgcccccctgggcctgggcctgcccagcggcagaggcagactgaccgccatgcccggcagagcccccctgagaaccgtgcccggcgccctgggcgcctggctgctgggcggcctgtgggcctggaccctgtgcggcctgtgcagcctgggcgccgtgggcgcccccagaccctgccaggccccccagcagtgggagggcagacaggtgatgtaccagcagagcagcggcagaaacagcagagccctgctgagctacgacggcctgaaccagagagtgagagtgctggacgagagaaaggccctgatcccctgcaagagactgttcgagtacatcctgctgtacaaggacggcgtgatgttccagatcgaccaggccaccaagcagtgcagcaagatgaccctgacccagccctgggaccccctggacatcccccagaacagcaccttcgaggaccagtacagcatcggcggcccccaggagcagatcaccgtgcaggagtggagcgacagaaagagcgccagaagctacgagacctggatcggcatctacaccgtgaaggactgctaccccgtgcaggagaccttcaccatcaactacagcgtgatcctgagcaccagattcttcgacatccagctgggcatcaaggaccccagcgtgttcaccccccccagcacctgccagatggcccagctggagaagatgagcgaggactgcagctggtag

SEQ ID NO: 5153 - DNA, 321 bp, Artificial Sequence
  Description of Artificial Sequence: Synthetic coding sequence
ggccagcccaaggccgcccccagcgtgaccctgttcccccccagcagcgaggagctgcaggccaacaaggccaccctggtgtgcctggtgagcgacttctaccccggcgccgtgaccgtggcctggaaggccgacggcagccccgtgaaggtgggcgtggagaccaccaagcccagcaagcagagcaacaacaagtacgccgccagcagctacctgagcctgacccccgagcagtggaagagccacagaagctacagctgcagagtgacccacgagggcagcaccgtggagaagaccgtggcccccgccgagtgcagctag

SEQ ID NO: 5154 - DNA, 672 bp, Artificial Sequence
  Description of Artificial Sequence: Synthetic coding sequence
atgagactgcagagacccagacaggcccccgccggcggcagaagagcccccagaggcggcagaggcagcccctacagacccgaccccggcagaggcgccagaagactgagaagattccagaagggcggcgagggcgcccccagagccgaccccccctgggcccccctgggcaccatggccctgctggccctgctgctggtggtggccctgcccagagtgtggaccgacgccaacctgaccgccagacagagagaccccgaggacagccagagaaccgacgagggcgacaacagagtgtggtgccacgtgtgcgagagagagaacaccttcgagtgccagaaccccagaagatgcaagtggaccgagccctactgcgtgatcgccgccgtgaagatcttccccagattcttcatggtggccaagcagtgcagcgccggctgcgccgccatggagagacccaagcccgaggagaagagattcctgctggaggagcccatgcccttcttctacctgaagtgctgcaagatcagatactgcaacctggagggcccccccatcaacagcagcgtgttcaaggagtacgccggcagcatgggcgagagctgcggcggcctgtggctggccatcctgctgctgctggccagcatcgccgccggcctgagcctgagctag

SEQ ID NO: 5155 - DNA, 408 bp, Artificial Sequence
  Description of Artificial Sequence: Synthetic coding sequence
atgacccccacccccaccgccgcctggaccccccccccccccctgagacccagcgccgccgccgccggcgcccagtgcagaagctgccccttcagaggcggctgcgcccccagcaccgccagaaccccccccgcctgcatgagacccgccggcccctgcgccccccccacctggcccgcccccagcaccaccaccagcacctgcaccagcagaagagccggctgcaccgccagcagcgccagctacagcaccctggccgccgcctgcagcctgagaagaagcggcgtgagatggccccccagcagcgcctacagcacctgggccttcgccagctgctgcgccagcagcgccagctgcagatgctgctgctgctgctgggccgccggcgcctggaccagcgcctggtag

SEQ ID NO: 5156 - DNA, 1542 bp, Artificial Sequence; identical to SEQ ID NO: 4607
  Description of Artificial Sequence: Synthetic coding sequence

SEQ ID NO: 5157 - DNA, 1341 bp, Artificial Sequence; identical to SEQ ID NO: 3757
  Description of Artificial Sequence: Synthetic coding sequence

SEQ ID NO: 5158 - DNA, 936 bp, Artificial Sequence
  Description of Artificial Sequence: Synthetic coding sequence
atgggcgtgatggccatgctgatgctgcccctgctgctgctgggcatcagcggcctgctgttcatctaccaggaggtgagcagactgtggagcaagagcgccgtgcagaacaaggtggtggtgatcaccgacgccatcagcggcctgggcaaggagtgcgccagagtgttccacaccggcggcgccagactggtgctgtgcggcaagaactgggagagactggagaacctgtacgacgccctgatcagcgtggccgaccccagcaagaccttcacccccaagctggtgctgctggacctgagcgacatcagctgcgtgcccgacgtggccaaggaggtgctggactgctacggctgcgtggacatcctgatcaacaacgccagcgtgaaggtgaagggccccgcccacaagatcagcctggagctggacaagaagatcatggacgccaactacttcggccccatcaccctgaccaaggccctgctgcccaacatgatcagcagaagaaccggccagatcgtgctggtgaacaacatccagggcaagttcggcatccccttcagaaccacctacgccgccagcaagcacgccgccctgggcttcttcgactgcctgagagccgaggtggaggagtacgacgtggtgatcagcaccgtgagccccaccttcatcagaagctaccacgtgtaccccgagcagggcaactgggaggccagcatctggaagttcttcttcagaaagctgacctacggcgtgcaccccgtggaggtggccgaggaggtgatgagaaccgtgagaagaaagaagcaggaggtgttcatggccaaccccatccccaaggccgccgtgtacgtgagaaccttcttccccgagttcttcttcgccgtggtggcctgcggcgtgaaggagaagctgaacgtgcccgaggagggctag

SEQ ID NO: 5159 - DNA, 594 bp, Artificial Sequence; identical to SEQ ID NO: 3704
  Description of Artificial Sequence: Synthetic coding sequence

SEQ ID NO: 5160 - DNA, 705 bp, Artificial Sequence
  Description of Artificial Sequence: Synthetic coding sequence
atgaaggtgctgctgctgaccggcctgggcgccctgttcttcgcctactactgggacgacaacttcgaccccggcggcctggactacctggtgctgaaccacatcggcggcgcccccgccggcaccagagccagaagcccccaggccaccagatggctgatgcaggtgaacttcgtgagctacgtgcagctgaccagcagagccctgcccagcctgaccgacagcaagggcagcctggtggtggtgagcagcctgctgggcagagtgcccaccagcttcagcaccccctacagcgccgccaagttcgccctggacggcttcttcggcagcctgagaagagagctggacgtgcaggacgtgaacgtggccatcaccatgtgcgtgctgggcctgagagacagagccagcgccgccgaggccgtgagaagcagcaccagcagacccagacagcccgagcacagaggcgtgcccctgcagagccagaccgccatgttcctgccccccaccgtgcccggcgccagaaccctgaccgagacccccctgagaggctggccccagcccaagatgaagagcagcagacagaagagcaagaccgagaagaacgacggccacctggagcccgtgaccgcctgggaggtgcaggtgcccagagtgagaagactgtgcagaggcctggccagaccccacctgttcggccacgactag

SEQ ID NO: 5161 - DNA, 228 bp, Artificial Sequence
  Description of Artificial Sequence: Synthetic coding sequence
atgaaggtgctgctgctgaccggcctgggcgccctgttcttcgcctactactgggacgacaacttcgaccccgccagcctgcagggcgccagagtgctgctgaccggcgccaacgccggcgtgggcgaggagctggcctaccactacgccagactgggcagccacctggtgctgaccgcccacaccgaggccctgctgcagaaggccggctggaccaccagctgctag

SEQ ID NO: 5162 - DNA, 225 bp, Artificial Sequence
  Description of Artificial Sequence: Synthetic coding sequence
atgcagcccagcgagatggtgatgaaccccaagcaggtgttcctgagcgtgctgatcttcggcgtggccggcctgctgctgttcatgtacctgcaggtgtggatcgaggagcagcacaccggcagagtggagaagagaagagagcagaaggtgaccagcggctggggccccgtgaagtacctgagacccgtgcccagaatcaagccccaggtgagccacgcctag

SEQ ID NO: 5163 - DNA, 861 bp, Artificial Sequence; identical to SEQ ID NO: 3890
  Description of Artificial Sequence: Synthetic coding sequence

SEQ ID NO: 5164 - DNA, 459 bp, Artificial Sequence
  Description of Artificial Sequence: Synthetic coding sequence
atgcaggtgaacttcgtgagctacgtgcagctgaccagcagagccctgcccagcctgaccgacagcaagggcagcctggtggtggtgagcagcctgctgggcagagtgcccaccagcttcagcaccccctacagcgccgccaagttcgccctggacggcttcttcggcagcctgagaagagagctggacgtgcaggacgtgaacgtggccatcaccatgtgcgtgctgggcctgagagacagagccagcgccgccgaggccgtgagaggcgtgaccagagtgaaggccgcccccggccccaaggccgccctggccgtgatcagaggcggcgccaccagagccgccggcgtgttctacccctggagattcagactgctgtgcctgctgagaagatggctgcccagacccagagcctggttcatcagacaggagctgaacgtgaccgccgccgccgcctag

SEQ ID NO: 5165 - DNA, 2856 bp, Artificial Sequence
  Description of Artificial Sequence: Synthetic coding sequence
atgagagtgctggcctgcctgctggccgccctggtgggcatccaggccgtggagagactgagactggccgacggcccccacggctgcgccggcagactggaggtgtggcacggcggcagatggggcaccgtgtgcgacgacggctgggacctgagagacgccgccgtggcctgcagacagctgggctgcggcggcgccctggccgcccccggcggcgccttcttcggcgagggcgccggccccgtgtggctgagcgagctggcctgcagaggcaacgagggccagctgggcctgtgccaccacagaggctggaaggcccacatctgcagccacgaggaggacgccggcgtggtgtgcgccggccagagagtggccaacagcagagacgacagcaccagccccctggacggcgccccctggcccggcctgctgctggagctgagccccagcaccgaggagcccctggtgacccacgcccccagacccgccggcaacccccagaacgccagcagaaagaagagccccagacccaagcaggccaagagcaccagagcccccctgctgaccaccggcgcccccagacaggagagactgagactggtgagcggcccccacagatgcgccggcagactggaggtgtggcacggcggcagatggggcaccgtgtgcgacgacggctgggacctgagagacgccgccgtggcctgcagagagctgggctgcggcggcgccctggccgcccccggcggcgccagattcggccccggcgccggccccgtgtggatggacgacgtgggctgcggcggcggcgagcaggccctgagagactgccccagaagcccctggggcagaagcaactgcgaccacagcgaggacgccggcctggtgtgcaccggccccgcccccagactgagactggccgacggcccccacggctgcgccggcagactggaggtgtggcacggcggcagatggggcagcgtgtgcgacgacgcctgggacctgagagacgccgccgtggcctgcagagagctgggctgcggcggcgccctggccgcccccggcggcgccttcttcggcgagggcagcggccccatcatcctggacgacctgagatgcagaggcaacgagaccgccctgagattctgccccgccagaccctggggccagcacgactgccaccacagagaggacgccggcgccgtgtgcgacggcatgcccctgggctacgtgccccccaccgcccccaccgacagcaacaacagcacccccagagaggccgccagcagaccccccagcaccatgaccagccaggcccccggcaccgccggcgtgagccccccccccgccagccccaccgtgctgtgggagcccggccccgaggccggcagcccccagctgagactggtggccggccccagcaagtgcagcggcagactggaggtgtggcacgaccagagatggggcaccgtgtgcgacgacagctgggacatgagagacagcgccgtggtgtgcagagagctgggctgcggcggcccccagcagcccgaccccgccgccggcagattcggctggggcgccggccccatctggctggacgacgtgggctgcgtgggcaccgaggccagcctgagcgactgccccgccgccccctggggcaagcacaactgcgcccacaacgaggacgtgggcgtgacctgcaccggcccccccggcctggacagcatcagcgaccccttcagctggagctggatccccggcctgggcagagacagagacgcctggctgcccggcgagctggccaccaagcccagcgccagcgtgaccgccagcgtgctggagaagaccaccaccaaggcccccggcaagatgcccaagagcaccaagaagtgggtgaccaagaacgccaagagacccaccacccagccccccgtgatgcccaccaccaagcacagcagagcccagagcccccccgacctgaccagccagaccaccgccgccctgaccaccgaggccagcagaagacccaccagcgagttcaccagaagacccaccaccgaggccccccagagatggaccagccacaccaccgccaccctgaccccccaggcccccagagagagaaccaccaagaccatggccatgctgaccacccagggcccccaggagatgaccagcgagagcaccatcaagagcatcccccaggccagcctggagcccagcgccgagatccccgagggcagccccgagagccccaaggaccccgcccccagccccagcgtgagcaccaccggcgagagcggcctgttcagagtgagactggccgacggccccaacagatgcgccggcagactggaggtgtggcacgccggcagatggggcaccgtgtgcgacgacaactgggacctgagagacgccaccgtggcctgctgggagctgggctgcggcaaggtgagacccagagtgggcaagacccactacggccccggcaccggccccatctggctggacgacatgggctgcaagggcagcgaggccagcctgagcgactgccccagcggcgcctggggcaagcacaactgcgaccacgaggaggacgtgggcctgacctgcaccggctacaccgactacgacgactaccccccctggacctgggaccccaccagcagagaggacctggccaagggcaccaccaccgccggcgtgcccggccacaccctgccctggagaaccaccagaagacccggcagcagcagccccgccatcagaagactgcccgacaccgagcccgaggccggcgcccccagaggcgacgcccccagaagcagaaccgccagagtggccgcccccccctag

SEQ ID NO: 5166 - DNA, 8430 bp, Artificial Sequence; identical to SEQ ID NO: 3614
  Description of Artificial Sequence: Synthetic coding sequence

SEQ ID NO: 5167 - DNA, 291 bp, Artificial Sequence; identical to SEQ ID NO: 4220
  Description of Artificial Sequence: Synthetic coding sequence

SEQ ID NO: 5168 - DNA, 1890 bp, Artificial Sequence
  Description of Artificial Sequence: Synthetic coding sequence
atgcagcaggacggcctgggcgtgggcaccagaaacggcagcggcaagggcagaagcgtgcaccccagctggccctggtgcgcccccagacccctgagatacttcggcagagacgccagagccagaagagcccagaccgccgccatggccctgctggccggcggcctgagcagaggcctgggcagccaccccgccgccgccggcagagacgccgtggtgttcgtgtggctgctgctgagcacctggtgcaccgcccccgccagagccatccaggtgaccgtgagcaacccctaccacgtggtgatcctgttccagcccgtgaccctgccctgcacctaccagatgaccagcacccccacccagcccatcgtgatctggaagtacaagagcttctgcagagacagaatcgccgacgccttcagccccgccagcgtggacaaccagctgaacgcccagctggccgccggcaaccccggctacaacccctacgtggagtgccaggacagcgtgagaaccgtgagagtggtggccaccaagcagggcaacgccgtgaccctgggcgactactaccagggcagaagaatcaccatcaccggcaacgccgacctgaccttcgaccagaccgcctggggcgacagcggcgtgtactactgcagcgtggtgagcgcccaggacctgcagggcaacaacgaggcctacgccgagctgatcgtgctggactggctgttcgtggtggtggtgtgcctggccgccttcctgatcttcctgctgctgggcatctgctggtgccagtgctgcccccacacctgctgctgctacgtgagatgcccctgctgccccgacaagtgctgctgccccgaggccctgtacgccgccggcaaggccgccaccagcggcgtgcccagcatctacgcccccagcacctacgcccacctgagccccgccaagaccccccccccccccgccatgatccccatgggccccgcctacaacggctaccccggcggctaccccggcgacgtggacagaagcagcagcgccggcggccagggcagctacgtgcccctgctgagagacaccgacagcagcgtggccagcgtgagaagcggctacagaatccaggccagccagcaggacgacagcatgagagtgctgtactacatggagaaggagctggccaacttcgaccccagcagacccggcccccccagcggcagagtggagagagccatgagcgaggtgaccagcctgcacgaggacgactggagaagcagacccagcagaggccccgccctgacccccatcagagacgaggagtggggcggccacagccccagaagccccagaggctgggaccaggagcccgccagagagcaggccggcggcggctggagagccagaagacccagagccagaagcgtggacgccctggacgacctgaccccccccagcaccgccgagagcggcagcagaagccccaccagcaacggcggcagaagcagagcctacatgccccccagaagcagaagcagagacgacctgtacgaccaggacgacagcagagacttccccagaagcagagacccccactacgacgacttcagaagcagagagagaccccccgccgaccccagaagccaccaccacagaaccagagaccccagagacaacggcagcagaagcggcgacctgccctacgacggcagactgctggaggaggccgtgagaaagaagggcagcgaggagagaagaagaccccacaaggaggaggaggaggaggcctactacccccccgccccccccccctacagcgagaccgacagccaggccagcagagagagaagactgaagaagaacctggccctgagcagagagagcctggtggtgtag

SEQ ID NO: 5169 - DNA, 591 bp, Artificial Sequence
  Description of Artificial Sequence: Synthetic coding sequence
atgagcaggagatctatgctgcttgcttgggcccttcctagtctgctaaggttgggggccgcgcaagagaccgaggaccctgcatgctgctcccctattgtgccaaggaacgaatggaaagcgctcgcctcggagtgtgcccagcatctgtctttgccactgagatatgtggtggtcagtcataccgcagggtcttcttgcaatacgcctgcgtcttgccagcaacaggcccgcaacgtccagcactaccatatgaagaccttaggttggtgtgatgtcggttacaattttttaataggcgaagatggcctggtttatgaaggcagaggctggaacttcactggcgcgcattccggacacttatggaaccctatgagtattgggatcagcttcatgggcaattacatggatagggtgcccaccccacaagcaatccgggccgcccagggcttactggcctgcggtgtggctcagggtgctctcaggagtaattatgtactgaaagggcacagggacgtccagcgaaccctgtcccctgggaaccagctatatcatctgatccagaattggcctcactacaggagtccttag

SEQ ID NO: 5170 - DNA, 1056 bp, Artificial Sequence
  Description of Artificial Sequence: Synthetic coding sequence
atggaggcgtttgcacttggacccgcacgtagaggccgccgtcggacaagggcagccggttctttgctgagcagggctgccattctgttgttcatatccgcctttctggtgagggtgccttctagtgtagggcaccttgtgcggctgccaagagcctttcgattgacaaaagatagcgtaaaaatcgttggcagcacttctttccctgttaaggcgtacgtgatgttgcaccaaaagtccccccacgtgttgtgtgtgacccagcaactacgtaatgcagaactgatcgatcctagcttccagtggtacggcccgaaaggaaaggtggtgtctgtggagaatcggacggcacagattacgtccactggatccctggtgttccaaaatttcgaggagagtatgtccgggatttatacatgttttcttgagtataaacccaccgttgaggaaatagtgaaaagacttcagctgaagtacgcgatttatgcataccgagagccccactactactatcagttcacggctcgataccacgccgccccatgcaattcgatatacaacatcagcttcgagaagaaacttctccagatcctgtcaaagcttctactcgacctgtcatgcgagattagtcttctgaagtccgaatgtcatcgtgtgaagatgcaacgggcaggcctgcagaacgagctgtttttcgccttttcagtcagttcgctcgataccgaaaagggccctaagagatgcactgaccacaactgtgagccttataagcggcttttcaaggccaagaatctgatcgagaggttttttaaccaacaagtggaaatactgggacggagagccgagcaactcccccaaatatattacattgagggcacactacagatggtctggatcaatcggtgtttccccggctatggcatgaacgtgcagcaacatccaaaatgtccagaatgttgtgtcatctgttccccaggctcatacaaccccagggacggtatacattgtctgcagtgcaattctagtctcgtctacggggccaaaacatgtctttag

SEQ ID NO: 5171 - DNA, 420 bp, Artificial Sequence
  Description of Artificial Sequence: Synthetic coding sequence
atggagaccaacgtgttccacttaatgctgtgcgtaacctcggcgagaactcacaagtcgacgtctctttgtttcggccactttaattcctacccttctttgccattgattcacgacctactccttgagatatcatttcagctgtccgccccacacgaggacgcccgactgacacccgaggagctggaacgggcatcgctgttacagatactgcctgagatgctgggagcagagagaggagacatcctcaggaaagcggactctagtacaaacatcttcaatccccgagggaacctgagaaaatttcaggatttcagcgggcaggatcccaacattctcctctcccacttactagcacgcatctggaagccttacaagaagcgggaaactcctgactgcttctggaagtattgtgtgtag

SEQ ID NO: 5172 - DNA, 606 bp, Artificial Sequence
  Description of Artificial Sequence: Synthetic coding sequence
atggggagcggccgtcgagccctgtccgcagtccccgccgtgctcctggtgctgaccctgcccgggctgcccgtgtgggctcagaacgataccgagcctatcgtgctggaagggaagtgcctcgtagtgtgcgattcaaatcccgcaaccgattcaaaaggttcgtcttcctcacccctaggaatcagtgtcagggctgccaactccaaggtggccttctccgccgtgcgttctaccaaccatgaaccaagcgaaatgagtaataaaacgcgaatcatatatttcgaccaaatactagtaaatgtgggtaatttttttacgctggaatctgtctttgtcgcccctcgaaagggcatatactctttcagctttcatgtgatcaaagtgtaccagagccaaacaatacaggtcaatcttatgttaaatggcaagcccgtaatttccgcgttcgccggggataaggatgtaaccagggaggctgccaccaacggagtcctgctctaccttgacaaggaggacaaggtgtatctgaaacttgaaaagggcaatttggtagggggctggcagtactcaaccttttccggtttcctcgtgtttcctttgtag

SEQ ID NO: 5173 - DNA, 264 bp, Artificial Sequence
  Description of Artificial Sequence: Synthetic coding sequence
atgaaagtcctgcgcgcatggctgttgtgcctgctcatgctgggtctggcgcttaggggggctgcatccaggacccatcgccactcgatggaaatcaggactcccgacatcaatcccgcgtggtatgcctccagaggaatccgaccagtgggccgctttggcagacgccgtgcaaccctaggcgatgtcccaaagcctggtctcagaccccgcctaacctgttttccactggagggaggtgctatgtctagtcaggacggatag

SEQ ID NO: 5174 - DNA, 1098 bp, Artificial Sequence
  Description of Artificial Sequence: Synthetic coding sequence
atgccaggcgggaaaaaggtagccggcggaggatctagcggggccacacctacctcggccgcagctaccgcgcccagcggggtccgccggctcgagactagtgaggggacctccgctcagcgcgacgaggagcccgaagaggagggagaagaggacctgagagatgggggagtaccgttcttcgtcaatcgaggaggtctgccagtcgacgaggcgacgtgggagcggatgtggaaacacgttgcaaaaatccatcctgacggggagaaagttgcccagagaatccggggagctacagatctgcctaagattcctattcctagcgtgcctactttccagccatccacccctgtacctgaacggctcgaagctgtgcagcggtatatacgggaactgcaatacaatcacactggtactcagttcttcgaaatcaaaaaaagccgacctctgacgggcctcatggatctcgcgaaagaaatgacaaaagaagccttgccaatcaagtgtctagaagcagtgattctggggatttacctgacaaactcaatgccaactctggagcggtttcccatatcatttaaaacgtatttctccggtaactactttcgacatattgttctgggtgtgaacttcgccggccgctatggagcgttgggcatgtccaggcgcgaagatctgatgtacaagcccccggccttcaggactctctctgagctggtgttggattttgaggccgcctacgggagatgctggcacgtgctcaaaaaggtgaaactcggccagagcgtctctcacgaccctcattccgttgagcagattgagtggaaacactcggtacttgacgtcgagcggctgggacgtgacgacttccgcaaggagctggagcggcatgccagagacatgaggctgaagattggtaaggggacagggccaccatcacccacaaaggaccgcaaaaaggacgtgagctcacctcagagggcccaaagctctccccatcggaggaactcccggagtgagcgacgcccctccggcgataagaagaccagtgagcctaaagctatgcctgatttaaatggctaccagattcgcgtgtag

SEQ ID NO: 5175 - DNA, 1377 bp, Artificial Sequence
  Description of Artificial Sequence: Synthetic coding sequence
atggcttgggcctctagattagggttacttctggcactgctcctgcccgtggtgggggcgtcaacccctggtacggtcgtccgtttgaataaagcagcattatcatatgtgtcagaaatcggaaaagcccccctgcagagggcactgcaggtgacggtcccacacttcctcgactggagcggggaagcgctgcagcctacgagaatacggatccttaatgtgcatgtgccaagactccatctcaaatttatagccgggttcggcgtgcggctgttagctgcagcgaatttcacattcaaagtgtttagagccccagagccactggaactgactttgcctgtggagctgctagcagacacacgtgtcacacagagttctatcagaacacctgtggtaagcatttccgcgtgttctctgtttagcggacacgcgaatgaattcgatgggtccaattctacctctcacgctctgctggttctagtgcagaagcacatcaaggccgtcttgagcaataaattgtgtttgagtatctctaacctagttcaaggcgttaatgttcacctgggtacccttattggactcaatccagtagggccagaatcacagattcggtactctatggtgtcagtgcctaccgttacctcagattacatttccctcgaggtcaacgccgtcctttttcttctcggcaaacctattatactcccgaccgacgccaccccctttgttttgcctcgccatgtgggcactgaagggtccatggcaacagtcggactatcacaacagctgtttgacagcgctctgcttcttctgcaaaaggccggagcattgaacctcgacattacaggtcagttacggagcgacgacaacctgctgaacacttccgcattgggacggctaatcccggaggtagcgaggcagttccccgaacctatgcccgtggtactgaaggtccggttaggggccactcctgtggctatgcttcataccaacaatgctactctgagactccagccttttgttgaagtcctcgccacagcgtctaatagcgctttccagtctctgttctccttagacgtcgtcgtaaatcttaggctgcaactgagtgtgtccaaggtcaagcttcaggggacaacttcggtgctcggcgacgtccagctgactgtggctagctccaatgtaggcttcatcgatactgatcaggtgcggacactaatgggcacagtctttgagaagcctcttctggaccatctgaatgcacttctggctatggggattgcccttcccggggtggtgaatctgcactatgtggctccagagatcttcgtctatgaaggatatgtcgtgatctcttctggtctcttctaccagtcttag

SEQ ID NO: 5176 - DNA, 1815 bp, Artificial Sequence
  Description of Artificial Sequence: Synthetic coding sequence
atgatgcgagccgtgtgggaggccttggcagcattggctgccgtggcatgtttagttggtgcagttcggggaggcccagggctgtctatgtttgccggtcaagctgctcagccagacccctgtagcgacgaaaatggccacccccggcggtgcataccagactttgtgaacgctgcctttggtaaagacgtgcgggtttcaagtacatgcggcagacctcctgcacggtactgtgtcgtgagcgagcggggcgaagagcggcttcggtcatgccacttgtgcaatgctagcgacccaaagaaggcacacccacccgcttttctgaccgacctcaacaacccacacaacctgacgtgctggcagtctgagaactacttgcagttcccacataatgtgactctaacactttcattaggaaagaaatttgaggtcacctacgtctccctgcagttttgttcgcctcgtccggagtccatggcgatctacaagtcaatggactacggacgaacatgggttccatttcaattttacagtacacagtgtagaaaaatgtataatcgacctcacagagcccccatcactaagcagaacgaacaagaggccgtctgtaccgactctcacacagatatgaggcccctgtcagggggccttatcgccttttctaccctcgatggacggcccagtgcacacgatttcgacaattctccagtgctccaggattgggttacggctactgatattcgggtggcattttcacgtctgcacacattcggggacgagaacgaagacgacagtgagctggctcgagattcttatttttacgctgtgtctgacctccaggtgggaggtcggtgcaagtgtaatgggcatgccgccagatgtgtcagggaccgagacgacagccttgtgtgtgactgccggcacaacactgctgggcctgaatgcgaccggtgtaagcccttccactatgaccgaccatggcaaagagctaccgcacgcgaggcaaatgagtgtgtagcatgcaactgcaatctccacgcccgccggtgcaggtttaacatggaactgtacaaactaagtggccggaaatcaggaggggtgtgtctgaattgccggcacaatacggcagggcgccactgtcactattgtaaagaaggatattaccgggatatggggaagcctattactcatagaaaagcctgtaaggcttgcgactgtcaccctgttggtgccgcaggaaaaacgtgtaatcagactaccggacaatgtccctgtaaggatggagtaactggcataacgtgtaaccggtgtgctaaaggatatcagcagagtcgatcacccatagcaccatgcattaaaatccccgtggcccccccaactaccgcggcctcttcggtggaggagcccgaagactgcgatagctattgtaaggcatcaaaaggcaagctcaaaattaacatgaagaagtattgcaagaaagattacgctgttcagattcacattttaaaggctgataaagccggcgattggtggaagtttaccgttaatatcattagtgtgtacaaacaaggaaccagcaggatccgcaggggggatcagtctttgtggattcgtagccgagacattgcgtgtaaatgcccaaagattaagccgcttaagaagtatctcctgctcggtaacgccgaggactcgcccgatcagtcagggatcgtggccgacaaatcgtcacttgtgatacagtggcgggacacatgggctcgacgccttagaaaattccaacagcgggagaaaaagggcaaatgtaaaaaagcctag

SEQ ID NO: 5177 - DNA, 675 bp, Artificial Sequence
  Description of Artificial Sequence: Synthetic coding sequence
atgcccggtcgggctccactgcgtacagtgccgggagccctcggggcttggctgctgggcggtttatgggcatggactttgtgcggcttgtgttccttgggagccgtgggagcgcctcggccgtgtcaagccccacagcaatgggaggggaggcaggtgatgtatcagcagagctcaggacggaacagtagggcccttcttagttacgacgggttgaaccagagagtgcgcgtgctagacgagcggaaagcactcatcccatgcaagaggctgtttgagtacatcctgctatacaaagatggcgtgatgtttcagatagatcaggccacgaagcaatgctctaagatgacccttactcagccctgggaccccttagacatcccacaaaatagtacttttgaggaccagtattccatcggcgggccacaggagcaaatcaccgtgcaggagtggtctgatagaaagtccgcccggtcatacgagacgtggattggtatatacactgttaaagactgttatccagtgcaagagacatttaccatcaactactcagttatcctcagcacccgattctttgacatccagctagggattaaggacccttctgtgtttacgcctcctagcacctgtcagatggcacaacttgagaagatgtcagaagactgtagctggtag

SEQ ID NO: 5178 - DNA, 5106 bp, Artificial Sequence
  Description of Artificial Sequence: Synthetic coding sequence
atgggcttcttgcctaaattacttttgctcgctagcttctttcccgccggtcaagctagttggggagtttcaagcccccaggatgtccagggcgtaaagggttcctgcttgctcattccatgcatcttctcgtttccagcagatgtcgaggtgcctgacgggatcactgcaatatggtactacgactactcaggtcagcggcaggtcgtgtcccacagcgctgaccctaaacttgttgaagccagatttaggggacgcaccgagtttatgggcaaccctgagcacagggtgtgtaacttgctgttaaaggatttgcagcctgaagatagcggcagttataactttcggttcgaaataagtgaggtgaatagatggtctgatgtgaaggggaccttggtaaccgtgacagaggaacctcgcgtgccaacaatagcttctccagtggagctgctggaaggaacagaagtggattttaactgctcgacgccttatgtgtgcttacaggagcaagtacgtcttcagtggcagggtcaggatccagcgcgatccgtgacatttaactcacagaaattcgaacctacaggtgtcgggcatctcgaaacactgcacatggcaatgtcttggcaggatcatggaaggattttaaggtgccagttgtcagtcgctaatcatcgcgcccagtcggaaattcacctccaagtgaagtacgctccaaaaggagtcaagatactcctaagccccagcgggagaaacatcctgccaggagagctagtgaccctcacgtgtcaggtgaatagctcctatccagcagtttcaagtatcaaatggctgaaggatggagtacggctgcagaccaaaacaggtgtcctccacttgccacaagcagcctggtccgacgccggtgtgtacacttgccaagctgagaatggagttggctcccttgtgtctcccccaatttccctgcacatctttatggctgaggtgcaagtaagtccagccggccccatcctggagaaccagaccgtaaccctcgtgtgcaacacccccaacgaagccccgtcagacctacggtattcctggtacaagaaccatgtgctcttagaggacgcacactcccacaccctgcggctccacctcgctacacgagcagatacaggattttacttttgcgaggtgcagaacgtgcatggcagtgaacgaagcggacccgtatccgtggtggtgaatcacccccccctcaccccagtgctgaccgcttttctggaaacacaggccggtctggtcggtattctgcactgctcggttgtgtccgagcctttggcaactcttgtgctgagccacggcggacacattctggctagcaccagtggcgatagcgatcacagtcccaggttcagcggtacgtcaggtcctaactcactacggttggagatcagagatctggaagagacagatagcggcgagtataaatgctccgccactaactctctgggcaatgctacgtcaactcttgactttcacgcaaacgcggcccgtctactgatcagtccagccgcagaagttgtagaagggcaggctgttacactctcctgtcgttcagggctgagcccaacaccggatgcccggtttagctggtatctcaatggtgccctcctgcacgaaggccctggttcttccctgctcctgccagctgctagctcaactgacgcgggatcttaccactgtcgcgctcgggacgggcattccgccagtggccctagttctcccgccgtcctgacggtgctgtatcctccaagacagcccacatttactacgcggttggacctagacgcagcgggagccggagcaggtagaagaggcctgttgctgtgcagagttgatagtgatccaccagctcggctccagctccttcataaggatcgagttgtggctacctctctcccctccggtggtggttgctccacttgtggcggctgcagtcctcggatgaaggttactaaagctccaaacctgctcagggtagagattcataacccccttttagaggaggaaggcctctatttatgcgaagcctccaacgctctgggcaatgcgagtacgtcagctacattcaacggacaggccaccgtgttagccatagcaccaagtcacacactgcaggagggcaccgaggccaatctcacttgcaatgtgagccgagaagctgctgggagccccgctaacttttcctggttccgcaacggagtactttgggcacagggaccactggaaactgtgactcttctcccagtggccagaacagatgccgccctatatgcatgccgtatactgacagaggcaggggctcagctgagcacacccgtcttgctgagcgtcttgtatccaccagaccggcccaagttgagcgccctgctggacatggggcaaggccatatggccctctttatctgtactgttgactcaaggcctctggctctcctggcgttgttccacggcgagcacttattagctacctctctcggcccacaggtgccctcccatggccgcttccaggcaaaagccgaagccaactccttaaagctggaagttcgggaactgggattgggagatagtggcagttaccgatgtgaggctaccaatgtgctcggtagttctaataccagcctcttcttccaagttaggggcgcttgggtgcaggtgagtccatctcccgaactgcaggaaggccaggctgttgtgctcagctgccaggttcacacgggggtgccagagggcaccagctacagatggtatagagacggtcagcccctccaagaatccacctcagccacacttaggttcgcggcgataactcttactcaagccggtgcctaccactgtcaggcccaggcccccggatctgctacaacgtccctagctgcccctattagtctgcatgtttcatacgcccctaggcatgtgactctgaccactttgatggacaccggtcctggaaggctgggcctgttgctgtgtcgagtggattcagaccctccagcccagcttaggctgctccacggggatagacttgttgccagtacactacaaggagtgggaggaccagagggctccagtcctagactgcatgtggcagtggccccaaacaccctccgtcttgagatccatggggccatgttggaggatgagggagtgtatatttgtgaagccagtaacacactcggtcaggcttcagcgagcgccgatttcgatgcccaagcagtgaacgttcaggtgtggcctggtgctactgtccgtgaggggcagctggttaatctgacttgcctggtgtggaccacgcaccccgcacaactgacatacacctggtatcaggatgggcagcagagactggatgcacacagtatccccctgccgaacgttacggtcagagacgccaccagttatcggtgcggtgtgggcccaccggggagggctcctaggttatctcgacccataacgctcgacgtgctgtacgcccctagaaacctacgccttacttacctcctggaatctcatggtggtcagcttgctctcgtgttgtgcaccgtcgatagcaggccccccgctcagctggccctgtcccacgccgggcgtctgttagcttctagtaccgccgctagcgttcccaatacacttaggttagagcttagagggccccagcctagggacgaagggttttactcctgttccgctcgcagtcccctgggccaagctaacaccagcttggagctgcgccttgaaggcgtaagggtgatcctggcgccagaagcagctgtgcctgaaggggcaccgattaccgtgacctgtgctgacccagccgctcacgcacctaccctctatacgtggtatcataatggccgttggctgcaggaggggccagctgctagcttaagcttcctggtagctacacgtgcacatgcgggagcctacagttgccaggctcaggatgcacagggaactcgctcatcgaggccagctgcccttcaagtactgtacgcccctcaggatgctgtgctcagttcctttagagattcacgcgcccgatctatggctgtcattcagtgtaccgtagattctgagcctcccgccgagcttgcgttaagtcacgacgggaaggtgctcgctacgtctagcggcgtgcacagtctggcctccggcactggacatgtccaagtggccaggaacgctttgcgcctccaggtgcaagatgtgcctgccggggacgacacatacgtctgcacagcgcagaatttgctcggaagcatcagcactattggaagacttcaggtcgagggggcccgggtggtggcggaaccagggctggatgtgcccgaaggcgccgctttaaacctgtcctgtaggttactgggcggacctggcccagtggggaactcaacatttgcttggttctggaatgaccggcgtctgcacgcagagcctgtgccgacactggcttttacacatgtagcccgcgcccaggcaggcatgtaccactgtctagctgagttacccacaggtgctgcggcatccgcgccagtgatgctgcgcgttctctacccgccaaaaacacccaccatgatggtctttgtggaacccgaaggcggattgcggggaattctcgattgcagggtggacagcgaaccactcgccagtctgacactgcacctgggcagtcgactggtcgcctcatcccagccccaaggcgcaccggccgagcctcatatccacgtgctggcctctcccaatgccctccgggttgatatcgaggctctgcgcccctcggatcagggagaatacatttgcagcgccagtaacgtgttggggagtgcctcgacctccacgtacttcggggttagagccctgcataggctgcatcaatttcagcagctgctctgggtactcggcctcctggtggggctgctcttgcttctactaggcctgggagcttgttacacctggtcgtctctgatccttatgcagcctcacgtaagaccgcagcccgtgccccacccttgggcagatcagtggtgctgcctgcccagcgggggtgagtctggtcaaaacttgtag

SEQ ID NO: 5179 - DNA, 708 bp, Artificial Sequence
  Description of Artificial Sequence: Synthetic coding sequence
atgactgtgttggcaccagcttggtcacctacaacgtacctgctactgctgctcttgctatcttctgggctatctggaacccaggattgttccttccagcattcacccatctcctctgattttgccgtgaagattagggagctatctgactacctgctgcaggactatccagtgaccgttgcctccaatctgcaggacgaagagctttgtggggggttatggagactggtgctcgcacagcgttggatggagcggttaaaaactgtcgcgggctctaagatgcaggggctgcttgagcgtgttaacacggagatacattttgtcacgaagtgcgctttccagcccccccctagctgccttcggtttgtgcagaccaacatatctagattgctgcaggaaacatctgagcagctggtcgccctcaaaccctggattaccagacagaacttttctagatgtttggagctccaatgccagcctgattctagcaccctgcctccaccttggtcaccaagacccttagaagctacagcccccacagcgccccagccccccctcctcctgctgttgctcctgcctgttgggctgctgctgctagcggccgcatggtgtctgcactggcagagaactaggaggcggacccctcgccctggagagcaggtcccccccgtcccttctccccaggacctcctcctcgtggaacattag

SEQ ID NO: 5180 - DNA, 3297 bp, Artificial Sequence
  Description of Artificial Sequence: Synthetic coding sequence
atgacgctacaagagttagtgcacaaagctgccagctgctatatggatcgcgtggccgtgtgttttgacgaatgtaacaatcagctgcctgtgtactatacgtacaaaactgtggtgaatgctgctagcgagttaagcaatttcttgttgctccactgcgatttccagggcattcgggaaatcggtttatactgtcagcctggcattgatctgccctcttggatcctcggtatactccaagtgcccgcagcttatgtcccaatcgagcctgactctccccctagcctgtccacccattttatgaaaaagtgcaatctgaagtatatccttgtggaaaagaaacagatcaacaaatttaagagctttcacgagaccttactgaactacgacactttcacagtggaacacaacgaccttgtgctctttcgcctgcactggaaaaatacagaagtgaatctgatgctcaatgatgggaaggagaagtacgagaaggaaaagattaagtccatctcttccgagcatgtaaacgaggaaaaagctgaggagcacatggacctgaggctcaaacattgtctcgcgtacgtactccacactagcggtaccacaggcatcccgaagattgttcgcgtacctcacaagtgtatcgttcctaatatccagcatttccgcgttcttttcgacattacacaagaagatgtcctctttctcgcaagcccgctaacctttgacccttccgtggtggagatctttctcgccctgtcctcgggcgcaagccttctgatcgttcctacttctgttaaactgctgccctcaaaactggcctctgtgctcttctctcatcaccgcgttacagtgctgcaggcaactccaactctgctaagacggtttggatcccagctgataaaatccactgtgctctctgccactacgtccctccgagttctcgcgctgggtggcgaggccttcccctcgctcacagtgctcagatcatggaggggagagggaaataaaacccagatctttaatgtgtacggaattactgaagtgtcgagttgggcaaccatttatcgaatacccgagaagactctcaactcaactttgaaatgtgagcttccagtgcagctcggattccccctgctggggactgtcgtcgaagtgcgggacaccaatggctttactatccaggaggggagtggacaagtctttctagggggtcgaaatcgcgtgtgtttcttggacgacgaggtcactgttccccttggtacaatgcgagccacaggcgattttgtcacagtcaaagacggcgaaattttcttcctgggtaggaaagatagtcagatcaaacggcatggtaagcggctgaacatcgaactggtgcagcaggttgccgaggagctgcagcaggtcgaaagttgcgctgttacgtggtataaccaggagaagctgatcttattcatggtctccaaagacgcatccgtgaaggagtatatctttaaagagctgcagaagtacctccctagccatgccgttcccgacgaattggtgcttattgattctctgccgtttacttcgcacggcaaaattgatgtatcggaattgaacaagatctacttgaattacattaatttgaagtctgagaacaagctgtcaggtaaggaagacctttgggagaagctacagtatctatggaagtccaccctaaatctccctgaggacctgctgcgcgtgccagacgagtctctgttcctgaattccggaggagacagcctgaaatctatccgcctgctatcagagatagagaaactggtgggcactagtgtgccggggctgttagaaatcatactgagcagcagtattctggaaatctacaaccacattctgcagaccgtggtgccagacgaagatgtcacgtttaggaagagttgcgccaccaagagaaagctgtctgacattaatcaggaagaggcctcaggcacatccttgcatcagaaggcgattatgaccttcacatgccacaacgagattaacgccttcgtggtgttgtcccggggatcccagatcttgtccctcaattcaacccggtttcttacaaagctgggccactgttcttcagcctgcccgtcagactcagtgtcccagactaatatacagaatcttaaaggacttaactcgcccgtcctgatcgggaagagcaaagatcccagttgcgtggctaaggtcagcgaggaaggcaagccagcgataggtacacagaagatggagctgcacgtacgctggcgcagtgacacaggcaaatgtgtggacgcttctccattggtcgtcatccctacgttcgacaaaagttctactactgtgtacatcggaagccatagtcacaggatgaaagcggttgatttttatagcgggaaggttaaatgggagcagattttgggtgaccgcatagagtcttcagcgtgtgtctccaagtgcggaaacttcatagtcgtgggatgttataacggacttgtctacgtgctgaagtcaaattcaggcgagaaatactggatgtttactactgaagatgcagtaaaatcctcagcaacgatggaccccactacgggtctcatctacataggctcccacgatcagcacgcctatgcactcgacatctatcgaaaaaagtgtgtatggaaatcaaaatgcggcggaaccgtgttctcctccccctgccttaacctgattccccaccatttgtacttcgccaccttggggggcctgctgctggccgttaaccccgccactggcaacgtcatttggaagcacagttgtggcaagccgctgttctcttcccctcagtgttgctcccagtatatctgcatcggatgcgttgacggcaacctgctgtgtttcacacattttggcgagcaggtgtggcagttttctacgtcaggtcctatcttttccagcccgtgtacctctccctcagagcagaagatattttttggcagccatgattgctttatatactgctgcaatatgaaaggccatttacagtggaagtttgagacgactagtcgggtatacgccacccctttcgcctttcacaattacaacggaagcaacgagatgttgctcgctgctgccagtacggacggaaaggtttggatcttggagtcccaatcaggccagctgcaatctgtctacgaactccctggggaggtattctccagccccgtggtacttgagtctatgctcattataggctgcagagacaactatgtttattgcttggatctgctcggaggcaatcagaagtag

SEQ ID NO: 5181 - DNA, 774 bp, Artificial Sequence
  Description of Artificial Sequence: Synthetic coding sequence
atggctagcaagatcggcagtaggcgatggatgcttcagctcattatgcagctaggatccgtgctgctaacacgatgtccattttggggctgttttagtcagttgatgctgtacgcggagcgcgctgaagcaaggaggaagcctgatattcccgtgccttatctgtactttgacatgggagctgctgtgctctgcgcttcttttatgtccttcggcgtgaagaggcgttggttcgcacttggcgcggcactacagctcgctattagcacttatgccgcatatattggtgggtatgtgcactacggtgattggctcaaggtaaggatgtacagtcggacagtggcgataatcggcgggttcttagtcctcgcttccggcgccggcgagctctatcgccgcaagcccaggagtcggagccttcaatcaactggtcaagtatttcttggcatctacctgatctgcgtggcgtactcccttcagcactcaaaagaagatcgcctggcctacctgaatcacctgccaggaggagagctgatgatccagctcttttttgtgttgtatggaatcttggccctagctttcctgagcggctattacgtgacgcttgctgctcagattttagccgttctgctaccacctgttatgcttcttatagatggtaatgtggcatactggcacaatacccggcgggtggaattctggaatcagatgaagctgctcggggagtccgtgggcatcttcgggacggccgtgattctggccacagacggatag

SEQ ID NO: 5182 - DNA, 2118 bp, Artificial Sequence
  Description of Artificial Sequence: Synthetic coding sequence
atggagaagccaaggtctatcgaggaaacgccaagcagcgagccaatggaggaagaagaagacgacgatctcgaactgttcgggggctacgattcatttaggagttataactcttctgttggttccgaaagcagttcgtacttagaagaaagctcggaagcggaaaacgaagacagggaggccggagagctgccaacctctccgctgcacctattgtccccaggcacccccaggagcctcgatggttccggctcagagcccgcggtctgcgagatgtgtggaattgtgggtacccgcgaggccttcttttccaagaccaaacgattttgctcagtaagctgcagtcgctcctacagctcgaactcaaagaaagcctcaatccttgcccgactgcaggggaagccgccaaccaaaaaagcaaaagtgctgcacaaggctgcctggagtgcgaagattggagccttcttacattctcaggggacaggtcagctggcggacgggacacccactggtcaggacgccctagtgctggggtttgactgggggaagtttctgaaggatcattcctacaaagcagcgccagtttcatgctttaaacacgtcccactctatgatcagtgggaggatgtcatgaaaggaatgaaggtcgaggtgctgaattctgacgccgtgctgccgtcacgagtttactggattgcttcagtgattcagaccgcaggttacagagtattgctccgctatgagggcttcgaaaacgacgccagccatgatttttggtgcaacctgggcacagtagatgtgcaccctatcggatggtgcgccatcaattccaagattctggtgcctcctaggactatccacgcaaaatttaccgattggaagggctatctcatgaaacgtctggtgggcagtagaacgctgccagtggatttccatataaaaatggtggaaagcatgaaatacccttttagacagggcatgagactcgaagtggtggataagagccaggtatctagaacgcgtatggccgtggtagatacagtcatcggaggacgactgcgtctactgtacgaagacggtgacagtgacgatgacttctggtgtcacatgtggagtcccctaattcatccagtaggttggagcagaagggtaggtcatggcattaagatgagcgagaggcggagtgacatggcccatcaccccacattcaggaagatctactgcgatgccgtgccttacctatttaagaaggttcgggcggtctataccgaaggaggttggtttgaggagggaatgaagctggaggccattgacccattaaacttgggaaatatttgtgtggccactgtttgtaaggtgttgctagacggatatctgatgatatgcgttgacggggggccttctactgatggtttggactggttttgctaccatgccagcagtcacgccattttccctgccacattctgtcagaagaatgacatcgagttaacaccccccaagggctatgaggcccagaccttcaactgggagaactatcttgagaaaacaaagagtaaagccgcgccatcccggctctttaacatggactgccccaaccacggcttcaaagtgggaatgaagctggaggctgtagatctaatggaacctcgcctcatctgcgtggcgaccgtgaaaagagtggtgcatcgactgctatcaatccacttcgatggctgggattcagagtatgatcagtgggtggactgtgagtcacctgatatctaccccgtgggctggtgcgaactcaccggctaccaactgcagccaccagtcgcagccgaacccgcgacgccattgaaggcaaaagaggccaccaaaaaaaagaagaagcagtttgggaaaaaacggaaacggattccgcccacaaagacacgccccctgcggcagggcagcaagaagccgctgctggaagacgacccgcagggggcccgcaagatttcctctgagccagttcccggggaaataatagctgtacgggtcaaggaagaacatttagatgtggctagtcccgacaaggcgagttcacctgaacttccagttagcgtggagaatattaagcaggaaacagatgactag

SEQ ID NO: 5183 - DNA, 2103 bp, Artificial Sequence
  Description of Artificial Sequence: Synthetic coding sequence
atgagcagaagaacccgatgcgaagatctggatgagctgcattatcaggacactgattctgatgttcctgagcagcgggacagtaagtgcaaggttaagtggactcacgaggaagatgagcagctgagggccctcgtgcgtcaattcggacagcaggactggaaattcctggcatctcactttcccaatcgtacagaccaacagtgccagtatcgctggctgagagtccttaatccagacctggtgaaagggccttggaccaaagaagaggatcagaaggtaattgagcttgttaagaagtacggaacgaaacagtggactctgattgcaaagcacctcaaagggcgcctggggaagcagtgcagggagcgctggcacaatcatctgaacccagaggttaaaaaatcctgttggacggaggaagaagaccggatcatttgtgaggcccataaggtgttgggcaatcgatgggcagagattgccaaaatgctacccggccggactgataacgccgtcaagaatcactggaattctacaatcaaaagaaaagtggataccggtggattcttaagtgagagtaaggattgtaaaccaccagtctacttgttgttggagcttgaagataaggatgggctccagtcagcccagcccacggagggccaagggtccttgctaactaactggccgtctgtccccccaactatcaaagaggaggaaaactctgaagaggagctcgccgctgccacaacctcaaaagaacaggagcccatcggcaccgatttggacgcagtccggacaccagagcctttagaggaatttcctaaacgtgaggaccaggaaggatctccccctgagacctccctgccttacaagtgggtggtggaagctgccaatttattgatccctgcagtggggagcagcctctcagaagccctggacctcatcgagtctgatcctgatgcgtggtgtgacctgtccaagttcgacctacctgaggagccttcagcagaggattctattaataactctttggtgcagctacaggctagccatcagcagcaggtcctcccccctcggcagccttcagccctggtgcctagcgtcacagagtaccgcctggacggccacactatttctgacctgtcccggtcctctcgaggcgaactgatccccatcagcccctccacggaggtcggaggttctggtatcgggaccccaccaagcgtactcaagagacaacggaagcgccgagtggctctgtccccagtcacggagaattctacatccctgtcttttctggattcctgtaactctctgacccctaagagtaccccggtgaaaacactcccttttagcccgtcccagtttcttaatttctggaataaacaggataccctggagttggagtcgccctccctgacatctacacccgtgtgctcacagaaggtcgtcgtgaccacaccgctgcatagagataagaccccactccaccaaaagcacgcagcgtttgtcactcccgaccagaaatactctatggacaatacacctcacaccccaacccccttcaagaacgctctggaaaagtatgggccgctgaaacctctgccccagactccacacctggaggaggacctgaaagaggtgttgagaagcgaagccggtatcgaactaattattgaagacgacatacgacctgaaaagcagaagcgcaagccaggcttgcgacggtcgcctataaagaaggtaagaaaatcactggccctggatattgtggatgaagacgtcaagctcatgatgtccactctgccgaagtcactgagccttccgactaccgccccaagtaactcctcttccctgactttgtctgggatcaaggaggataattctctgctaaatcagggtttccttcaggccaagcctgaaaaggctgccgtggcccaaaagcctcgctctcactttacaacccctgcccctatgtctagcgcttggaagactgtggcttgcggcgggaccagggaccagctttttatgcaagagaaagcccggcaattactcggtagactgaagccgtcccatacttctcggaccctgatcctgagttag

SEQ ID NO: 5184 - DNA, 528 bp, Artificial Sequence
  Description of Artificial Sequence: Synthetic coding sequence
atgctgcgtaccgaggtccctcggctcccacggagcaccaccgcgatcgtatggagctgccatttaatggcgaccgccagtgcgatggctggcccttcatcagaaactacgtccgaggaacagctcattacccaggagcccaaagaggctaacagcaccaccagtcagaagcaaagcaaacagaggaagcgcggccgtcacggtcccaggaggtgtcattccaactgccggggagatagcttcgccacctacttccgtagagtccttaaacaggtccatcagggccttagtctgagcagggaagctgttagcgttatggacagccttgtgcacgacatactggaccgcattgcgaccgaagccggaaggcttgcccgcagtacaaagcgccagacgattactgcgtgggaaacgcgcatggctgtgagactgctcctgccaggccagatgggaaaactagcagaaagtgaaggcaccaaagcagtgctcagaacgagcttatacgccattcaacagcagagaaagtag

SEQ ID NO: 5185 - DNA, 624 bp, Artificial Sequence
  Description of Artificial Sequence: Synthetic coding sequence
atggcccctttcgagccactcgcgtctggtattctgcttctgctgtggctgattgcgcctagcagggcgtgcacctgtgtgcctccacacccccagaccgctttttgtaactctgaccttgtcatcagagccaaattcgtggggactcctgaagtgaaccagacaacgctttaccaaagatatgaaattaaaatgacaaaaatgtataaggggtttcaagccctgggagacgctgccgacatcagattcgtttacactcctgccatggagtcggtttgcggctattttcaccgctcccacaatcggtccgaagagttcctcattgcgggcaaactccaggatggcctgctgcatattactacatgtagcttcgtggccccctggaattccctgtccttggcgcagagacggggttttacaaagacgtacacagtggggtgtgaggagtgtactgtttttccttgcctctctatcccctgcaagcttcaatcagggacccactgtttgtggaccgatcagctgctgcaaggttcagaaaagggcttccagagtcggcacttagcttgcctgcctcgcgaacctggcctgtgcacctggcagagtctacgaagtcagatcgcatag

SEQ ID NO: 5186 - DNA, 1686 bp, Artificial Sequence
  Description of Artificial Sequence: Synthetic coding sequence
atggcagatcacaaccctgattccgacagcactccgcggactctactcaggagagtcctggacaccgccgatcctagaacgccacgacgcccgaggagtgcccgagccggagcccgccgggccctcttggaaacagcctctcctaggaaactgagcggccagacgcggaccattgcccgcggcagatcacatggggcacgctccgtcggcagatccgctcacatacaggctagtggacaccttgaggaacagacacccaggactctgctcaagaatattctccttaccgcgcctgagtcttctatcctgatgcctgagtctgtggtcaaaccggtgccagccccccaggcagtccagccatctcgtcaggagagtagttgtggttctctggagttgcagctacccgaactggagcccccaacgacactggctccggggctcctggctcctggcagaagaaaacaaaggttacgcctttctgttttccaacagggcgtggaccaggggctgtcactctctcaggagccacaggggaatgctgatgcgagctcactgacacggagtcttaacttgactttcgcgaccccacttcagccgcagagcgtccagaggcccgggctggcacgacgacccccagctcgccgggctgttgacgttggggcttttctccgtgacctacgagatacctctctcgctcctcctaacattgtgttagaggatactcagcctttttctcagcccatggtagggtcccctaatgtgtaccactctttaccctgtacccctcataccggtgccgaagacgctgagcaggcagctggccgcaagactcaaagtagcggacctgggctccagaaaaacagtcctggaaagcctgcccaattcctcgctggagaagcagaggaagtgaatgctttcgccctgggttttctctccacatcttcgggcgtcagcggagaggatgaagtcgaaccactgcacgacggcgttgaagaggccgagaagaaaatggaagaggagggggtcagcgtttcagagatggaggccactggagcccagggcccatcgagggttgaggaagcagaagggcatacagaagtcactgaagccgaagggtcacagggtaccgccgaagctgacggaccaggtgcctctagcggggatgaagatgctagcggcagggccgcttcacctgaaagtgctagctccactccagaatcactccaagcccggcgccatcatcagtttcttgaaccagctcccgcccccggggctgcagtcctgagctccgagccagcggagcctctgctcgtccgtcaccctccccggccaaggacaacaggaccacggccgagacaggatccacacaaggctggtctgtcccattatgtgaaattgtttagtttctacgccaaaatgcctatggaaaggaaggcgctggagatggttgaaaagtgcctcgacaaatattttcagcacctctgcgacgatttggaggtgtttgccgcccacgccggtaggaagactgtaaagcccgaagacctagagctgctgatgaggcggcagggcctagtaacggaccaagtttcactccacgtacttgtggagcggcacctgcccctcgaatatcggcagctgctgatcccatgcgcttacagtgggaatagcgtgtttccggcacagtag

SEQ ID NO: 5187 - DNA, 1134 bp, Artificial Sequence
  Description of Artificial Sequence: Synthetic coding sequence
atgacagatgacgaatctgaatcggttctgagcgactcacatgagggaagcgaattggaactgccagtgattcagctgtgtggacttgtagaggagcttagctacgtaaactccgcactgaaaacggaaacggaaatgtttgaaaaatattacgccaaacttgagccccgagaccagcggcccccacgattgagcgagattaagatatccgccgctgactacgctcaattccgggggagacggcggtctaagtcccgcacagggatggataggggagtgggactgacagctgatcaaaagctcgagctggttcagaaggaagtggccgacatgaaggatgatctgaggcatacccgggccaacgccgaacgtgacctccagcaccacgaggctatcatcgaagaggccgaaatacgttggagcgaggtaagccgggaggttcacgaattcgagaaggacattttaaaggcaatcagtaaaaagaaaggctcaatcctggcgacccagaaggttatgaaatatatcgaggatatgaatcgcagacgcgataacatgaaagaaaaactgagacttaagaacgtgtccctcaaagtccagaggaagaaaatgctgcttcagttaagacagaaggaagaagtcagcgaggctctccacgatgttgattttcagcaactgaagattgaaaatgcccaattcttagaaactatcgaggctaggaaccaggaactgacccagctgaaactgtcttcagggaacaccctccaggtgctcaatgcatacaagtctaagctgcataaagccatggagatctacctgaatctggataaggagattctgctgaggaaagaactcttggagaagatagaaaaggagactctgcaagtggaggaggatcgggccaaggccgaggccgtgaataagagactgaggaaacagctggccgagttcagagcaccacaggttatgacttacgtcagggaaaagatcttaaatgccgatcttgagaaaagcattcgtatgtgggaacggaaagtagagattgccgagatgtcactgaagggacaccgaaaagcatggaataggatgaaaattaccaatgagcagctgcaggctgactatctggcaggcaagtag

SEQ ID NO: 5188 - DNA, 1548 bp, Artificial Sequence
  Description of Artificial Sequence: Synthetic coding sequence
atggaggcacgggaacccggacgaccaacaccgacctaccatctcgttcccaacacctcgcaatcacaggtggaagaggatgtgagcagccctccacaacgtagcagtgagacaatgcagttgaagaaggagataagcttgcttaacggtgttagcctggtcgttgggaacatgattggatccggaattttcgtttcacccaagggcgtccttgtgcacactgcctcttacgggatgagcttgatcgtctgggccatcgggggcctgttctcagtggtgggggccctttgttacgctgagctcggcacaaccatcactaaaagcggcgcctcctatgcatacatcttggaagcattcggaggtttcattgcatttatacgcctttgggtttcattgttggtagtagagcctaccggtcaggctatcatcgccatcacctttgccaactatatcatccagccgagtttcccctcatgcgacccgccatatctcgcgtgcagattgttggcagccgcctgcatttgcctcctgacattcgtgaattgcgcatacgtgaagtgggggactagagtgcaagacacttttacctacgctaaggtagttgcactgatagccatcattgtcatggggctggttaagttgtgccagggacacagcgagcatttccaggacgcctttgagggaagctcctgggacatgggcaatctctccctcgctctgtacagtgccctgtttagctattcgggatgggacaccctcaacttcgtaacagaggagattaagaatcctgaaagaaacttacccctggccattgggattagcatgcctattgtaacccttatctacatcctgacaaacgtggcatattacactgtacttaatatttctgatgtgctgtcaagcgacgccgtggccgtgaccttcgcagaccagactttcggaatgtttagctggacaattccaatagcagtggctctttcatgcttcggaggcctgaacgcatccatattcgcaagttcacgtctttttttcgtaggttctcgagagggacatctaccagatctgctgtccatgatccacatcgagcgcttcacccccatccctgctttattgtttaactgtactatggcactcatttatttaatcgtcgaagatgtgtttcagctaattaactatttttctttttcgtactggttcttcgtgggcctgagcgtggtgggtcagctctatctgcgttggaaggaaccaaagaggccgcggcctcttaaacttagtgttttcttccctattgtgttttgtatctgctctgtttttctagttatcgtgcctctattcacagacactatcaattccctcataggcattggcattgctttatcaggcgtgcccttctatttcatgggcgtgtacctccccgaatctcgaaggcctcttttcattcgtaacgtgctggctgctatcacaagggggacccagcaattgtgcttttgtgtgctcacagaattggatgtagctgaagaaaaaaaggatgagagaaagaccgattag

SEQ ID NO: 5189 - DNA, 1623 bp, Artificial Sequence
  Description of Artificial Sequence: Synthetic coding sequence
atgaatggggaggctatttgtagtgcacttcccacaatcccgtaccacaagctggccgatctgcggtatctctcgaggggagcgtctggcactgtctcctccgcccggcacgccgattggcgggtgcaggtggccgttaagcacctacatattcacaccccattgctggatagcgagagaaaggatgtcctgagagaagctgagatcttacataaagcaagatttagctatattctgcccatcctgggaatatgtaacgagccagaattcctcggaattgtgacggagtacatgccaaatggttcactgaacgagctgttgcaccggaaaacagagtacccggatgtcgcgtggcccctgcgcttcaggatcctgcatgagatcgccctgggcgtgaattacctccataacatgacccctcccctcctgcaccatgatctcaaaacccagaatatcttattagataacgagttccacgtcaaaatcgccgactttggcctctctaaatggcgaatgatgagtttgtcccagagcaggagcagtaaaagcgcacccgaaggtggtacaatcatctacatgccgcctgaaaactacgagccaggacaaaagtctcgcgcatcaattaagcatgacatctatagttatgccgttataacctgggaggtgctttctcggaagcagccttttgaggacgtgacgaatccgctgcagatcatgtattcagtgagccagggacaccgacctgtgatcaatgaagagagcctgccatatgatattccgcatcgcgcgcgcatgatcagcctcatcgagtcagggtgggcccaaaatcccgacgaaagaccctcattcctaaagtgtcttatcgagttagaacctgtcttgcgaacgttcgaagagatcacatttctagaggcagttattcagctaaaaaaaacaaagctacagtctgtttcgtccgccatacacctgtgtgataagaagaagatggagttaagtctgaatatacctgtaaaccacggccctcaagaggaatcctgtggtagttctcagctgcacgaaaactcaggcagtcccgagacctctaggtccctccccgcccctcaggacaacgactttctcagccggaaagcgcaggattgttactttatgaagctgcatcattgcccaggcaatcattcctgggattccacaataagtgggagtcagagggcggccttttgcgaccataaaacgactccctgctcctcagccatcatcaatccactttcaaccgcggggaatagcgagcggctgcagccaggcattgctcaacaatggattcagtctaagagggaggacattgttaatcagatgactgaagcatgtttgaatcaatcattggacgcactgctctctcgcgacttgataatgaaagaggattatgagctagtatccacaaagccgacccgtacaagcaaggtgaggcagctgttagatacaacagacattcagggcgaagaatttgcaaaagttatcgtccagaaacttaaggacaacaagcagatggggttgcagccctatcccgagatattagtagtgtccaggagcccatcactgaacctcctgcagaacaaatcaatgtag

SEQ ID NO: 5190 - DNA, 2079 bp, Artificial Sequence
  Description of Artificial Sequence: Synthetic coding sequence
atgcgggcctgtgctggcagtaccagagaggccgggagtggagcccaggacttatccaccttgctgtgtctagaggaatccatggaagagcaggatgaaaaaccccctgaaccaccaaaggcttgtgcccaggatagcttcctgcctcaggagatcatcatcaaagttgaaggcgaggataccgggtctctgaccattccgtctcaggagggtgtcaacttcaaaatcgtgaccgtggattttacccgcgaggagcagggtacctggaaccccgcgcagcgcaccttggatcgcgacgtgatacttgaaaaccaccgagatctggtcagctgggatctcgctaccgctgtgggcaagaaagattctacttcgaagcagagaatatttgatgaagaacctgctaacggagtgaagatcgaacggttcactcgagacgacccttggctttcctcctgcgaagaagtggacgactgtaaagaccagcttgaaaaacagcaagaaaaacaggagatcctcctgcaggaggtcgcctttacccaaagaaaggcggtaattcatgaaagagtgtgtaaaagcgatgagacgggcgagaagtccggccttaactctagtctgtttagctcacctgtgattccaatccgtaaccacttccacaagcacgtcagccatgcaaaaaaatggcatctcaatgctgctgttaattcacatcagaagatcaatgagaatgaaacgctttacgaaaataacgagtgcggaaaaccaccccagtctatccatttgattcaattcacccgcacgcagaccaaagataaatgttacggtttttctgaccgaatccagagcttctgccacggtacaccccttcacatccatgagaagatccacggtggcggcaaaacgtttgatttcaaagagtgcgggcaggtcctgaaccccaagataagccataatgagcaacagaggattccttttgaggagagccagtacaaatgctctgagacaagtcactcctcctcgctaacacagaacatgcgaaacaacagtgaggaaaaaccattcgagtgtaaccagtgtggtaaaagtttttcctggtcttctcacttagttgcccaccagcgcacacacactggcgaaaagccttacgagtgtagcgaatgtgggaagtccttttctaggagctctcatctggttagccaccagagaacacatacaggagagaaaccttatcgctgtaaccaatgcggaaagagcttctcccaatcttacgtcttggtcgtgcaccagaggacacacacaggcgagaagccatatgaatgcaaccagtgcggtaaatcttttcgacagagttataaacttatcgcccatcaaaggacccacactggcgaaaagccctatgaatgcaaccagtgtggtaagtccttcattcaaagttataaactcatcgcacaccagcgcattcacactggggaaaaaccttatgagtgcaaccagtgtggtaagagtttttctcagagttataagcttgtcgcacatcagcgcacacataccggagagaagccgtttgagtgtaatcaatgtggtaagagtttttcctggtcctctcagctggtggcccaccagcgcacgcacactggggagaagccctacgagtgcagtgagtgcggcaagtcatttaataggagctcacacctggtaatgcatcagaggattcacacaggagaaaagccctacgagtgcaaccagtgtggtaaatcattttcccagtcatacgtccttgtagtgcatcaacgcacacatacaggggaaaaaccctatgagtgttctcagtgtggcaaatcttttcgccagagtagctgcctgacgcagcaccagagaacccacacaggtgagaaaccattcgagtgtaaccagtgtggcaagactttttctctgtcagctcggctgatcgtgcatcaacgtacccacaccggggaaaaaccctttacgtgcatccagtgtggaaaggcctttatcaattcctacaaactaatccgccatcaggccactcataccgaggagaaactgtacgagtgcaactag

SEQ ID NO: 5191 - DNA, 942 bp, Artificial Sequence
  Description of Artificial Sequence: Synthetic coding sequence
atggataacaagaagcgtctagcctacgctatcatacagttcctccacgatcaactgcgtcatggcggactgagctcagatgcgcaggaatcgctcgaggtggcgatccaatgcctcgagaccgcatttggtgtgacggtcgaagatagtgatctcgcgctcccacaaacgcttcccgagatattcgaggcagccgctacgggcaaagaaatgccacaggacctcagatcccccgctcgaacacctccaagcgaggaagattctgcagaagcagaaaggctcaagaccgaaggaaacgagcagatgaaagtggagaacttcgaagctgccgtacacttctacgggaaagctattgagctgaaccctgccaacgctgtgtatttctgtaatagagccgcagcatacagcaagctggggaactacgctggggccgttcaggattgtgaaagagcaatttgtatcgaccccgcttacagcaaggcttatggcaggatgggccttgctctcagctcccttaacaaacacgtggaggctgtcgcatattacaaaaaagcgcttgaattagacccagataacgaaacctataagtcaaaccttaaaatagcagaactcaagctccgcgaagcaccatcacccacgggtggggtcggctccttcgatattgcaggactcttgaataaccccggattcatgagcatggcatctaatctcatgaacaacccgcagatccagcagctcatgtctgggatgatttcgggcggcaacaatcccctggggacccccgggacctccccttcccagaatgatctagcctctctgatccaggccgggcagcagtttgcacagcaaatgcaacaacagaacccggagttgatagagcagctgagaagccagattcgctcaaggactccctcagcctccaatgatgatcagcaagaatag

SEQ ID NO: 5192 - DNA, 1584 bp, Artificial Sequence
  Description of Artificial Sequence: Synthetic coding sequence
atgtatcagcccgaggatgataacaacagtgatgtgacctctgacgatgatatgacgcgcaatagacgcgagtcctcacccccccactctgtgcactccttttcaggagaccgtgattgggatcgcaggggccgatccagggacatggagccccgcgatcggtggagccacactcgaaatccacgatcgagaatgcctccgagagacttaagcttacctgtggtagcaaagacctccttcgagatggatcgggaggatgacagggacagtcgcgcctatgagagtcgcagtcaggacgccgagtcttatcagaacgtagttgaccttgctgaggatagaaaaccccacaacacgatacaggataatatggagaactatcggaaactgctttccctagggttcctggctcaggatagtgtgccagccgaaaagcgaaacacagaaatgctcgacaatctgccatctgcagggagccagttccccgacttcaagcatctggggacattcctcgtgtttgaggagctcgtaacatttgaagatgttctggtggacttttcgcctgaggaattgtcaagtctcagtgcagctcaacggaacctgtaccgtgaggtgatgcttgagaactatagaaatctggtatctcttggccaccagttttcgaaaccagatatcatttcacggcttgaggaggaggaatcttatgcaatggaaacggacagcaggcataccgtcatctgtcaaggcgagtctcacgacgacccactggagccgcatcagggaaatcaagagaaattactgacccccatcaccatgaatgatcccaagacactgaccccagaacgcagttatggatccgatgagtttgaaaggtcttccaatctttccaagcagagtaaggatccactcggaaaagatcctcaggagggcacggctccaggaatctgcacaagtccccaatcagcctctcaagagaataagcataatcgatgcgaattctgtaagcggaccttcagcactcaagtcgcccttaggcgccatgaacggattcacactggcaagaaaccctatgaatgtaagcagtgcgcggaagcgttttacctgatgccacacctaaatcgacatcagaaaacccactcaggtcggaagactagcggatgcaatgaaggccgaaaaccctcggtgcagtgcgccaatctgtgcgaaagagtaaggattcactctcaggaagattatttcgaatgcttccagtgcgggaaagccttcctgcagaacgttcacctgctgcagcatttgaaagctcacgaagctgctagagttcttccccctggattgtcacattcgaaaacctacctgattagataccagagaaagcatgactacgtgggggagcgggcgtgccaatgttgcgactgcgggcgagtgttttcgcgcaactcatatctgattcaacattatcggacccatacccaggaacggccataccagtgccagttgtgtgggaagtgcttcgggcgtccttcatatctgactcaacactaccagttgcacagccaggagaagacagtggagtgtgatcattgctag

SEQ ID NO: 5193 - DNA, 444 bp, Artificial Sequence
  Description of Artificial Sequence: Synthetic coding sequence
atggccctgaagcgaatccagaaagaactgaccgacctgcagagagacccaccagctcagtgcagcgccggcccggtgggggatgacctgtttcactggcaggcaacgataatggggcctaacgactctccatatcagggtggggtgttctttttaaccatccattttccaacagattacccgtttaaaccaccaaaggtggcgttcacaaccaaaatttaccatcccaacataaattccaacggcagcatttgcctggacatccttcgctctcagtggagtcccgcacttacggtgtccaaggtccttctcagcatctgttctctgctttgcgatcccaatcccgatgaccccctcgttccagagattgcgcacacctataaagctgacagagaaaagtataacagactggcccgagagtggactcagaagtacgctatgtag

SEQ ID NO: 5194 - DNA, 3072 bp, Artificial Sequence
  Description of Artificial Sequence: Synthetic coding sequence
atgttccacctccgaacttgtgccgccaagcttaggcccctgaccgccagtcagacggtgaagacttttagccagaatcggcccgctgctgcgaggacctttcagcaaatcaggtgttacagcgcgcctgtggctgccgaaccctttctgtctggcaccagctccaattacgttgaggagatgtactgtgcctggttggagaatcctaagagcgtgcataagtcctgggatatcttttttcggaatacaaacgctggcgccccacctggcacagcctaccaatcgcctctgccattatcacggggttcgctcgcagctgtggcccatgcgcagtcgttggtcgaagcccaacctaacgtggataagctggtcgaggatcacctggcggtgcagtcattgattagggcttatcaaatcagaggccatcatgtggctcagttagaccccctgggcattctggacgccgatttggacagcagtgtacctgccgacatcatctcctcaaccgataaactcgggttctatgggctggacgagtccgaccttgataaggtcttccatcttcctactactacatttattggtggacaggagagtgccctgcctctgcgggaaatcattaggcgccttgaaatggcctactgccagcatataggagtagaatttatgtttatcaatgatttggaacagtgccagtggattcgtcagaaattcgagacaccagggatcatgcagttcaccaatgaggaaaaacggaccctgctggctcggctggtgcggtctaccaggttcgaagaatttttgcaaagaaaatggtcttcagaaaagaggtttggcctcgagggctgtgaagtcctaatccccgctcttaagaccataattgacaagagttctgagaacggggttgattacgttatcatgggtatgccccatcgcgggcggctgaacgtgctggccaacgtgatacgaaaggaattagagcagatcttttgccagttcgactcaaagctggaggctgcagacgagggttccggggacgtgaagtaccacctcggaatgtatcataggaggatcaaccgagttaccgaccgcaacattactctatcactcgtagctaacccgagccacttagaggccgccgatcccgtagttatgggtaagactaaggccgaacagttctattgtggtgacacagaagggaagaaagtaatgagcatcctcctgcatggggatgcagcttttgcagggcaggggatagtttatgagacgtttcacctgagtgacctcccatcttacaccactcacgggacagtgcacgtagtagtcaataaccagattggcttcacgacagaccctaggatggctagatccagtccctacccgacggacgttgcaagggtcgtgaacgctcccatctttcacgtgaattccgacgaccctgaggctgtgatgtacgtctgcaaagttgctgctgaatggcgttcgacctttcacaaagacgttgtagtcgacctagtgtgttaccggcggaatggacataacgaaatggatgagcctatgttcacccagcccttgatgtataagcagattcggaaacagaaacccgtcctgcaaaaatacgctgaactgttggtgagccagggggtcgtgaaccagcctgaatacgaggaagagattagtaagtatgataagatctgcgaagaggcattcgcccgctctaaagacgagaaaattcttcatataaaacactggctggattccccttggccgggcttttttacactcgacggacagccgcgcagtatgagttgcccctctactgggctgactgaagacattttgacccatattggtaacgtggcgagttcggtccccgtggagaatttcaccatccacggcggactctccaggattctgaagacccggggtgaaatggtcaaaaatcgtacggtggactgggctctcgctgaatacatggcttttggaagcctgctgaaggaaggaatccatattagactcagcgggcaagatgtggaaagaggtaccttctctcataggcaccatgtcttgcacgaccaaaatgtggacaagaggacttgtattccaatgaatcatttatggcccaaccaggccccctacaccgtttgtaactctagcctgtcggagtacggcgtgctggggtttgagctcggcttcgcaatggcatcccctaacgctctggtgttgtgggaagcgcaatttggtgattttcacaacactgctcagtgtatcattgatcaattcatctgtccgggccaggcaaagtgggtgagacaaaacggaatcgtgctcttattaccccacgggatggaagggatggggcccgaacacagttcggcgaggccagaacgctttctccagatgtgcaacgacgaccccgatgtcctgcctgatctgaaagaagcaaacttcgacatcaatcagctctacgattgtaactgggtcgtggtaaattgcagcactccaggaaacttcttccacgtgttgcgtcgccaaatacttttgcctttcagaaaaccactgattatattcaccccaaagagtctgctaaggcaccctgaggctaggtcttcttttgacgaaatgctccctggtacccactttcagcgggtaattccggaggatgggcccgcagcacagaatccagagaatgtcaagaggctgctgttttgcacaggcaaggtatattacgacttaacacgcgagcggaaggcacgcgacatggtgggacaggtcgcgattacacggattgaacaactgtctcctttccccttcgatcttctcctcaaagaggttcagaaatatccaaacgccgagctagcttggtgccaggaggaacataaaaaccagggatattacgattacgtgaagcctcggctcaggactactatttcccgggccaagccagtctggtatgcaggacgtgaccctgccgctgcacccgccactggcaacaagaagacccacctcaccgagctgcaaagacttctggataccgcctttgacctggatgtcttcaaaaatttttcctag

SEQ ID NO: 5195 - DNA, 2667 bp, Artificial Sequence
  Description of Artificial Sequence: Synthetic coding sequence
atggaaggggatgattgcgagtttagatatggggatggcacaaacgaggcccaggataacgatttccccactgtggagaggtcccgcttgcaggagatgctgagtctgcttggcctggagacatatcaagttcagaaacttagccttcaggacagcttacagatatcctttgactccatgaaaaactgggccccacaggtgccaaaagaccttccctggaactttcttcgaaagctccaagctctcaatgccgatgcgaggaacactactatggtactcgatgtgctcccagacgcacggccagttgagaaggaaagccagatggaagaagaaattatctattgggatccagccgacgatctggcggcggacatttatagcttttcggagctgcccacacccgacacgccagttaacccactggacctgttgtgtgccttactgctatcttcagactcctttttgcagcaagagatagccctcaaaatggctttatgccagttcgcactgcccctcgtgctgcccgatagtgagaaccattatcatacctttttgctgtgggccatgagaggcatagttcgcacctggtggtcccagcctcctcgcggaatgggtagctttcgagaagatagtgtggtactttcaagagctcccgcattcgcattcgtgcggatggacgtttctagcaatagcaagagccaattgctgaacgccgtcctctcgcctggccaccgacagtgggactgcttctggcaccgagatttgaatttaggcacaaacgcccgggagatttcagatggcctggtcgaaattagctggttctttccctctgggagagaagacctggatatttttcctgaacccgtggccttcctaaaccttcggggagatatcggcagtcactggcttcagttcaagctgttgaccgaaatcagttctgccgtttttattctgactgataatatttccaagaaggagtacaaactactgtactcgatgaaggagagcactactaagtactatttcatactctccccataccgaggcaaaaggaacacaaacctcagatttctgaacaagctgattcccgtactcaagattgatcattcccacgtgctggtcaaagtctcatcgacagattctgacagttttgtgaagagaattcgcgcaatagtcggtaatgtgctccgcgctccgtgtcgacgtgtttctgtcgaggatatggcacacgccgcccgaaaactgggcctcaaggtagatgaggactgtgaggagtgtcagaaagccaaggatcgcatggagcggataacgcgtaaaattaaggacagcgatgcatatcgacgcgacgaactgcgtctgcagggagatccttggaggaaagcggcccaagtggagaaggaattttgccaactccagtgggctgtggaccctccagagaagcatcgtgcagagctgcggaggaggctgttagagctgaggatgcaacagaacggtcatgacccctccagcggcgtacaggagtttattagcggcataagcagcccgtctctgtctgaaaagcagtatttcctgcgatggatggagtggggactggcccgggtggcccagccgagactcaggcaaccccccgagacccttctgacccttcgtcccaagcacggtggcacaactgacgttggcgaacctctctggccagagccattgggggtagaacattttctacgagaaatgggccagttctacgaggccgaaagctgcctcgttgaagccggacgcctgccagccggccagaggcgtttcgcccactttcctggtctagccagtgagctgctccttaccggcttgcccctggagttgattgatggcagtacgcttagtatgcctgtgcgctgggtgacggggttgctgaaagagctgcatgtccgtctggagaggcgcagcagactcgtggtgcttagcaccgtaggtgtgccagggacaggcaagagcaccttgctgaataccatgtttggcctgcgttttgcaaccggtaagagctgtggaccccgcggcgcctttatgcagctgatcaccgtggccgagggattctcccaggacctgggatgtgatcacatcttagtgatcgacagcgggggactgatcggcggcgcccttaccagcgccggagatagattcgaattggaggcatccctagcgactttactgatgggactctctaacgtgaccgtgatctctctggccgagacgaaggacattccagccgctatattgcatgcctttctacggctggagaaaactggacacatgcctaattatcagtttgtctaccagaacctccatgatgtgagcgtgcccggcccacgaccacgcgataagcgccagctgctcgatccaccaggggacctttcccgtgcggctgcccagatggaaaaacagggggatggatttcgagccctcgcaggcctggctttctgcgatcctgaaaagcagcatatctggcatattccaggtctctggcatggagccccgcctatggctgccgtttctctggcgtacagcgaggccatattcgagctcaagagatgcctcctggaaaatatccgcaacggactgtccaatcagaacaaaaatatccaacagcttatcgagctggttagacgcttgtag

SEQ ID NO: 5196 - DNA, 3744 bp, Artificial Sequence
  Description of Artificial Sequence: Synthetic coding sequence
atgatgcgggagtgggtgctcctcatgagcgttctgctctgcggtctcgccggcccaacccacctttttcaaccaagtctcgtgctggatatggcgaaagtgcttctcgacaactactgtttcccagagaaccttttgggcatgcaagaggccattcagcaagccattaaatctcacgagattctcagtatcagtgatccacagaccctagcgtccgtgttgaccgccggagtacaaagctcacttaatgatccccgactggtaatctcctatgagccaagcacccccgagcccccgcctcaagttccggctctgacctccctttccgaggaagaattgctggcctggctgcaacgaggactccgacatgaggtgctggaagggaacgtcggctacttgcgagttgactctgtgcccggacaagaggttctttccatgatgggagagttcctggtggcacacgtttgggggaatctgatggggaccagtgcactggtgcttgacctacgacattgcacagggggacaggtgagcgggattccatacatcatttcttatctgcaccctgggaatacaatcctgcatgtggatacaatttacaatagacctagtaatacaacaaccgagatttggacgctcccccaagtcctcggggagaggtatggtgcggataaagacgtggtggtgctcacaagctctcaaacgcggggtgtggccgaggatattgcacacatcctcaaacagatgaggcgtgcaatcgttgtaggggaacgcactggaggcggcgctctggacctgaggaagctgaggatcggtgagtccgattttttctttactgtacctgtttcaaggtcactcggccccttgggaggggggagccagacctgggaaggctccggagtcctcccttgcgtaggaacacctgctgagcaggccctggagaaggccctggccattcttacattgaggagtgcactcccaggcgtggtgcactgcctgcaagaagtgctgaaggattattacacgctggtcgacagggtccctactctactgcagcacctggcttccatggacttttccacagttgtgtctgaggaggacttggtcactaagcttaatgccggcctgcaggccgcctcggaggacccgcgattgctcgtccgagccattggacccactgagacccctagttggcctgcccctgacgcggctgcagaagattctccaggagtggctccggagctaccggaggatgaagctatcagacaggcattggtggacagtgtctttcaggtgtccgtcttgcccgggaatgtgggctacctgcgctttgacagctttgctgatgcctcagtgctcggcgtccttgctccgtacgtgcttaggcaggtgtgggaacctctgcaggacactgaacatcttattatggacttgagacacaaccctggcgggcccagttccgccgttcccctattgctctcctactttcaggggccagaagctggaccggtccatctgttcaccacttacgacaggaggacaaacattacccaggaacatttctctcacatggaactgccaggtccgcggtactccacccagaggggggtgtatctgttgacctctcatcgcaccgcaactgcggcggaggaatttgcttttctcatgcagtccctcggatgggctactctcgtcggcgaaatcaccgccgggaatctgttgcacacccggaccgtccccctgctggatactcccgaaggctctctcgctctgaccgttcccgtgctgacttttattgataaccatggagaggcttggctgggaggtggagtggtcccagatgccattgtgctcgccgaagaggccctggataaagcccaggaagtccttgagttccaccagagcctcggcgccttagtcgaagggaccgggcatttgctggaggcgcattatgccaggcccgaggtggtgggacagacgtccgccctactacgggccaagttggcgcagggcgcatacagaactgcagttgacctggaaagtctcgcctcacagctgaccgccgaccttcaggaagttagtggggatcatagattactggttttccattcgcctggtgagctcgtcgttgaagaggcccctcctcccccccccgccgtgcccagtcccgaagagctaacctatttaatcgaggccctctttaaaaccgaggtcctgcctggacagctaggctatttgcgattcgacgctatggccgagttggagactgtcaaggcggttggccctcagctcgtacgcttggtatggcagcagcttgtggatacagccgccctagtaatagacctccgatataacccaggtagctacagtaccgccatcccgctgctctgctcttatttctttgaagcagaaccacgacagcatctctatagcgtgttcgatcgcgcaacatcaaaagtcaccgaggtttggacgttgcctcaagtcgcaggccagagatatggctcccacaaggacttgtacattttgatgtcacatacatccggttcagccgctgaagcgttcgcccacaccatgcaggacctgcagcgtgctaccgtgatcggagagcccaccgccggaggagcactatcagttggcatctatcaggtaggaagcagccccctgtacgcttctatgccaacgcagatggcaatgtccgccactacgggtaaggcatgggatcttgcgggcgtggagcctgatatcacagtgccaatgagcgaagccttgtccatcgcacaagatatcgtagcccttagggcaaaagtccctactgtgctccagaccgccggaaagctagtggccgacaactacgcttctgctgagctcggcgcgaaaatggccaccaaactcagcgggctccagtcgcgttactccagggtaacatccgaggtggcgttggccgagatactgggagcagatctgcagatgctatctggtgatccccaccttaaagcagcgcacatccccgaaaacgctaaggatagaattcctggcattgttcctatgcagattccttcccccgaagttttcgaagagctgatcaagttctctttccacaccaatgtgttggaggacaatattggatacctgaggttcgatatgtttggcgacggggagcttctcacgcaggtctcaaggcttttggttgagcacatatggaagaagattatgcacaccgatgctatgatcattgacatgcgcttcaacattggcggacctacatcctccatccctatactgtgcagttacttctttgatgaggggcctccagtgctgttggataagatctattctcggccggatgattccgtaagcgagctgtggacgcatgctcaggtggtgggtgagcggtatggctccaagaagtcaatggtgatcctgacttcaagcgtcactgcaggcaccgccgaggagtttacatatatcatgaagagacttgggcgtgccctcgtaattggcgaggtgacctctggtgggtgtcagccaccccaaacctaccatgttgacgacactaacctatacctgactattccgaccgcccggtcggtgggagcgtcagacggatcaagttgggaaggggtgggcgtgaccccgcacgtggtagtccctgcagaagaagccttagccagggctaaagagatgttacagcataaccagctccgggtgaaacggtctcccggactccaagaccacctgtag

SEQ ID NO: 5197 - DNA, 885 bp, Artificial Sequence
  Description of Artificial Sequence: Synthetic coding sequence
atgaattctgaattggattattacgagaagttcgaggaagtccacggtattttgatgtacaaggactttgttaagtattgggataatgtggaggcattccaggccagacccgacgatttagtgatcgcaacttacccaaagagcggcactacatgggtaagtgagattgtgtacatgatatacaaagagggtgatgtggagaaatgcaaagaagacgtgatcttcaaccgtattccatttctcgaatgcagaaaggagaacctgatgaacggcgtgaaacagctggatgagatgaacagcccccgtatcgttaagacccacctgcccccggagctgctccccgcgtcattctgggagaaggattgcaagatcatctacctgtgccgaaatgcaaaggacgtcgcagtttctttttactatttcttcctaatggtcgccggccaccccaatccagggtccttccccgagttcgtcgagaagtttatgcaggggcaggtcccctatggatcttggtataagcatgtcaaatcctggtgggaaaaaggcaaatccccacgcgtactattcctgttttacgaggacttaaaagaagatattcggaaggaggtaattaagctgatccattttctggagagaaagccctccgaggaactggtggatagaattatccaccacacctcttttcaggaaatgaaaaataatcccagcacgaactatacaacactcccggacgaaataatgaatcaaaagctgtcaccattcatgcgcaagggaataactggtgattggaagaatcactttactgtcgctctgaatgagaagtttgacaagcactacgaacaacagatgaaagagagtacactgaagtttcgcactgagatatag

SEQ ID NO: 5198 - DNA, 1446 bp, Artificial Sequence
  Description of Artificial Sequence: Synthetic coding sequence
atggcttataacgacaccgatcggaaccagacggaaaagttgttgaagcgcgtacgggaattagagcaggaggttcagcgcctgaaaaaagagcaggcaaagaataaggaggactctaacatccgggaaaacagcgccggcgccgggaagaccaagagggcctttgacttcagcgctcacggtcgacgacacgtggccctccggatcgcgtatatggggtgggggtaccagggcttcgcttctcaagagaacacgaacaacactatagaggaaaagctgttcgaagcccttaccaaaacgagactggtggaaagccgacagactagtaattaccatcggtgcggacgaacagataaaggcgtgtccgccttcggacaggttatttcacttgaccttagatctcaattcccccgggggagagactctgaggacttcaatgtcaaagaggaagccaatgctgcagccgaggaaatacgttacacacacatattgaatcgggttctccctccagacatcaggatcctggcttgggcacccgttgaaccttcctttagcgcccgctttagctgtctcgaacgaacgtaccgctatttctttcccagagccgacctcgacattgtgacgatggactatgcggcgcagaagtatgtagggacccacgatttccgcaatttgtgcaagatggacgtcgccaatggagtgataaatttccaacgcacgatcctgagcgcacaggttcagttagtcggccagagccctggcgagggaagatggcaggagccgttccaactgtgccagtttgaggtgacaggccaggctttcctgtaccatcaagtcaggtgcatgatggccatcctatttctcatcggacaggggatggaaaagccagaaattatcgatgagctgctgaacattgaaaaaaacccgcagaaaccccagtattcgatggcagtcgagttccctctcgtcctatacgactgcaaatttgaaaacgtcaagtggatctacgatcaagaggcacaggagttcaacatcacccaccttcagcaactttgggcaaaccatgccgtcaagacccacatgttgtatagcatgctccaggggctcgatactgttccagtgccttgcggtataggcccgaaaatggacggcatgaccgaatggggcaatgttaagccatccgtgatcaagcagacgtctgcgtttgtcgaaggggtgaaaatgagaacctacaagcctctgatggacagacccaaatgtcaaggactggaaagccgcatccagcacttcgtcagaagaggcaggattgagcacccccacctgtttcacgaagaagagaccaaggcaaaaagagactgcaatgataccctagaggaggaaaatacgaatttggagacccctacaaagcgcgtgtgtgtggatactgaaatcaagtctattatctag

SEQ ID NO: 5199 - DNA, 618 bp, Artificial Sequence
  Description of Artificial Sequence: Synthetic coding sequence
atgtctaatttcttgcacctcaaatataatgaaaagagcgtgagtgtcaccaaggcattgacggtacgcttcctgactaaacgcttcattggcgaatatgctagtaatttcgagtctatttacaagaagcacttgtgccttgagaggaagcagctgaacctcgagatctacgacccttgttcacagacacagaaagcgaagttctctctaacttccgagcttcattgggcagatggttttgtcattgtctacgatatttcggacaggtcctctttcgcattcgctaaagcactgatttacaggatccgcgagccgcagacctcccactgtaaacgagccgtggaaagtgccgtgttcttggtagggaacaagcgggatctctgtcacgtgcgagaggtgggttgggaagagggccagaagctggcgctagagaatagatgccagttttgtgaactgtctgcggctgaacagagtctggaagtcgagatgatgtttattagaattattaaggatattcttattaactttaaactaaaggagaagcgcaggcctagtggctccaaaagcatggccaaattgatcaacaacgtattcggtaagcgcagaaagtccgtatag

SEQ ID NO: 5200 - DNA, 1008 bp, Artificial Sequence
  Description of Artificial Sequence: Synthetic coding sequence
atgggtaaagtgaaagtcggagtcaacggcttcggcaggattgggcgcttggtgacgcgggcagcctttaactctggcaaggtggatattgtggcaatcaacgacccatttatcgatctgaattatatggtctatatgtttcaatacgatagcactcacggtaaattccacgggaccgtcaaggccgaaaacggaaagctggtgatcaatggcaatcctattacaatcttccaagagagagatccgtccaagatcaagtggggggatgctggggcggaatacgtggtggaatccaccggagtttttactacaatggaaaaagcaggcgcccacttacagggcggggcaaagcgagtgattatttcggccccttccgccgatgcccccatgttcgtgatgggtgtgaatcacgaaaagtacgataatagtctcaagatcattagcaatgcctcatgcaccacgaattgtttggcccctctcgctaaggtgatacatgataacttcgggattgtcgaggggctgatgacgactgtgcacgcaatcactgccacgcaaaagaccgttgatggccccagcggcaagctctggagagacggtaggggggccctgcaaaacatcatcccagcctctactggcgctgcaaaagctgtgggaaaagtcatcccagagctcaacgggaaactcacgggcatggcctttcgcgttcccaccgctaatgtgagcgtagtggacttgacatgtaggctggaaaagcctgcgaagtacgatgatatcaaaaaggtggtgaaacaggccagtgaaggcccacttaagggaatcctcggttatacggaacatcaggtcgtaagcagtgatttcaacagtgatacgcactcctccacttttgacgctggggctggtattgcccttaacgatcactttgtaaagctgatttcttggtacgataatgaattcggatactccaatagggtggtcgatctgatggcccacatggctagtaaggagtag

SEQ ID NO: 5201 - DNA, 597 bp, Artificial Sequence
  Description of Artificial Sequence: Synthetic coding sequence
atggatagcctgctgatgaataggaggaagtttctgtatcagttcaagaatgtacggtgggccaaaggtcgacgggagacatatctgtgctacgtagtcaagagacgggactcagctactagcttctctctggacttcggctacctcaggaacaagaacggatgccatgttgagctcctgttcctgaggtacatttccgactgggatctcgatccgggtcggtgctaccgggtcacttggtttaccagctggtccccgtgctatgattgtgctaggcatgttgctgacttcctgcgtggaaaccctaatctcagcctgagaatttttactgcaaggttatatttctgtgaagaccggaaagctgaacccgaaggtctgcgcagactccatcgtgcgggagtgcagattgcaatcatgacatttaaagattacttttactgttggaacacatttgtagagaatcatgagaggacatttaaggcctgggaaggcctgcacgaaaactctgtaaggctgagcagacaactgcgcagaatcctcctgcctctctacgaggtggatgacttaagagatgcctttcgcaccctaggcctttag

SEQ ID NO: 5202 - DNA, 5472 bp, Artificial Sequence
  Description of Artificial Sequence: Synthetic coding sequence
atggccctatcttctgcatggagatctgtcctgcccctctggctgctctggtccgcggcctgctctcgcgccgcctcgggcgacgataacgcattcccctttgatattgaggggtccagcgctgtggggcgacaggatccacccgaaacgtctgagccaagagtagcccttgggcggctgccccccgcagcagagaaatgcaacgccggtttttttcataccctgtccggtgaatgcgtgccttgcgactgcaacggtaactccaatgagtgtcttgacgggagtggttactgcgtgcattgtcaaaggaataccacaggagagcactgcgagaaatgtctggacggctatatcggggatagcattcggggagctccacagttttgtcagccatgcccttgtcccctaccccacctcgccaattttgcggaaagctgttatagaaaaaacggcgctgtacgatgcatctgtaatgaaaattatgccggtcctaactgcgagagatgcgctcccggatactatggaaatcccctcctgattggtagtacttgtaaaaagtgtgactgtagcgggaactcagatccgaacctgatttttgaggactgcgacgaggtaaccggccagtgccgcaactgcttacggaataccaccgggttcaaatgcgagcgttgtgccccaggctattatggcgatgcaaggatcgccaagaattgcgcagtttgtaactgcggtggggggccctgtgacagtgtaactggggagtgcctagaagaaggcttcgagccccctactggcatggactgccccacaatttcatgtgataaatgtgtctgggacctgactgacgctttgcgcctcgccgccctgtcaatcgaagagggaaagtccggggtgctgagtgtaagttccggcgccgctgcccaccggcacgtgaatgaaatcaatgctaccatatatcttcttaagacaaaactctctgaacgcgaaaaccagtatgccctgcggaaaattcagatcaataacgccgagaatacaatgaaatccctgctttcagacgtcgaagaacttgtagagaaggaaaatcaggctagtcgtaagggacaactagtgcagaaagaaagcatggacactattaatcacgcctcccagcttgtagagcaagctcacgatatgcgcgataaaatacaagaaattaacaacaaaatgctgtactacggcgaggagcatgagctctcccccaaagagatctctgaaaagctcgtactggcccaaaagatgctggaagagatacggagtcggcaaccattttttactcagcgtgagctggttgacgaggaggctgatgaggcttacgaactgctgagccaggctgaatcttggcagcggctccataatgaaactcggaccctttttcctgtggtcctggagcaactggatgattacaacgccaagctgtccgaccttcaggaagctctggaccaggcgctcaactacgtcagagacgccgaggatatgaatagggctaccgctgcccggcagagagaccacgaaaagcaacaggagagagtgcgagaacaaatggaggtcgtgaacatgagcctctcaacaagcgctgacagcctgacaactcctcggctgaccctgtctgaactcgacgacatcatcaaaaacgcgagcggcatctacgctgagattgatggggcaaagtctgaactacaggtgaaactgtccaacttaagcaacctgtcccatgacttggtgcaggaggcgatcgaccatgcccaggacctgcagcaggaggccaacgaactaagcagaaagctccactcatctgatatgaacgggctagtgcagaaagccctggacgcttcgaatgtgtacgaaaacatcgtcaactacgtcagcgaggctaatgaaaccgctgagttcgctctgaacacaacagataggatttacgacgccgtgtccggcattgacacacagatcatttaccacaaggatgaatctgaaaatctactgaatcaagcaagagagctacaggcaaaagccgaatccagctcagatgaagcagtcgctgataccagtagaagagtgggcggtgctctggcccggaagtccgctcttaagactagactgagcgacgccgtgaaacagctgcaagcagcggaacgcggtgatgcccagcaaagactaggtcagagcagactgatcaccgaagaggccaatcgaaccaccatggaagtccaacaggccacagccccgatggccaacaatctgaccaattggtcacagaatcttcagcacttcgacagctctgcctacaatactgcagtcaacagtgccagagatgccgttcgcaatttgaccgaggtggtcccccagttattggatcagttgagaacagtggagcaaaagagaccggcctcaaacgtatccgcaagcattcagaggatcagggagctgatcgctcaaacccgctccgttgcctccaaaatccaagtttctatgatgtttgatggacagtctgcagtcgaagtgcattcacggacctctatggacgaccttaaggcttttacctcacttagcctgtacatgaagccgcctgttaagaggcccgagctcactgagacagcagatcaattcatcctataccttgggagtaagaatgctaagaaagaatacatggggctcgctatcaaaaacgacaatcttgtgtacgtctataatctgggaaccaaggacgtggaaataccgctggatagcaagccagtgagctcgtggcctgcctatttcagtatcgtaaagatcgagcgggtgggcaagcacggcaaggtattcctcaccgtgccttccctctcaagcaccgccgaggaaaagttcattaagaaaggcgagttctccggcgacgactctctcctggatttagacccagaagataccgtgttttatgtgggcggggtgccttctaattttaaactgcctacgagtctgaaccttcccggcttcgtaggatgcctagagctggcgaccctgaataatgatgtgatcagcctctataatttcaagcacatctacaatatggacccatctactagtgtgccatgtgcgagagataaactggccttcacccaaagtcgtgcggccagttatttcttcgacggctctggttacgcagtggtcagagatatcacccgccggggtaaatttggtcaggtgacccgctttgatattgaagtgcgtacgcccgcagacaacggcctcatcctgctaatggtcaatggctcaatgttttttcgccttgagatgcggaatgggtatttgcacgtgttttatgattttggatttagcggaggtcctgtacatctggaagacacactgaagaaggcccaaatcaacgacgctaaatatcatgaaatctctatcatatatcacaacgataaaaaaatgattctggtggtagacaggcggcatgtgaagtccatggacaacgaaaagatgaaaatcccttttacggatatctacatcggaggcgccccccctgaaatactccaaagtagagccctccgggcgcacctaccactcgatattaatttccggggctgtatgaagggcttccagttccagaaaaaggatttcaatcttttagaacaaactgagaccctcggcgtcgggtatggctgcccagaggactccctgatctcacgccgcgcttactttaacggacagagttttatcgccagcattcaaaagatcagcttttttgacggttttgagggcgggtttaatttcagaactcttcaacctaacggcctcctgttttactatgcatctggctctgatgtctttagcattagtttggataatggaaccgtgatcatggatgtcaaaggcatcaaagtccagtccgtagacaaacagtacaacgacggtctctcccactttgtgatttcctctgtgagtcctaccaggtacgagctcattgtggacaagagtcgagtgggcagtaaaaacccaaccaaggggaagatcgagcagacgcaagcttcagagaaaaagttctatttcggcggttccccaatctcagcccagtatgccaacttcacgggttgtatctcgaatgcctatttcacaagagtagatcgcgacgtcgaggtggaggactttcagcggtatactgagaaggtacacacatcactgtatgagtgccctatcgagtccagtcctttgtttctgcttcacaaaaaaggtaagaacttatcgaagccaaaggccagtcagaataaaaagggaggcaaatccaaggacgccccatcttgggatccagtggctctcaaactcccggagcgcaacacaccacgaaattcacactgccacctatcgaactccccacgtgctatcgaacatgcctaccaatacgggggcacagcaaactcacggcaggagtttgaacacctgaagggggactttggcgcgaaaagccagttctccatccggttgagaactaggagcagtcacggcatgatcttctacgtttctgatcaggaagagaatgatttcatgacacttttcctagctcacggccggctagtgtacatgtttaatgtcggccacaagaagctgaagattcgctcgcaggagaagtataatgatggcctgtggcatgacgtcatctttatccgggagcgctcaagcggaagacttgtgatcgacggcctgagagttctggaggaatctctgccacctaccgaggccacatggaagataaaggggcccatttatctcgggggcgttgccccaggcaaggcagtcaagaatgtccagatcaactccatatatagcttctctggctgcctgagtaacctccagctgaatggcgcctcaatcacatctgcaagccagaccttctcagtaactccttgcttcgagggcccaatggagacaggcacgtatttttccaccgagggagggtatgtggttctagatgagtccttcaatattggactgaagtttgaaattgcctttgaggtcagaccccggtcttcaagcggaacccttgtgcatggccatagcgttaacggggaatacctcaatgtgcatatgaagaatggtcaagttatcgtgaaagtgaacaatgggattagggactttagtacctcagtgactcccaagcagtccttatgtgacgggcgctggcatcgaattacggttataagggactcaaatgtggttcaactggatgtggactccgaagtgaatcacgtggtggggccacttaatcctaaaccaatcgaccaccgggagcctgttttcgtcgggggcgtccccgaaagtctcctaacccctaggctggcaccatccaaaccttttactggctgtattcggcacttcgtgatagatggtcatcctgtttccttttctaaggctgcactggtgtcgggtgctgtctctatcaatagttgccctgccgcgtag

SEQ ID NO: 5203 - DNA, 1434 bp, Artificial Sequence
  Description of Artificial Sequence: Synthetic coding sequence
atgaccagcaagtttctgctggtgagcttcattctggcggccttaagtctatctactacattttcgctgcaaccagatcagcagaaggtgctacttgtctcttttgacggttttcgctgggattacctgtataaggttcctacacctcactttcattacatcatgaagtacggcgtgcacgtgaagcaggtgaccaacgtctttattactaagacctacccgaatcattacaccctggtcaccggcctctttgccgaaaatcatgggattgttgctaacgatatgttcgaccccatcagaaataagtcgttttcgctcgatcacatgaatatttacgacagcaagttctgggaggaagctacgccaatctggataaccaaccagcgcgccgggcacacttctggcgccgctatgtggcccggtaccgacgtaaagatccacaaacggtttcccacacattacatgccctacaacgaatccgtgtcatttgaagatcgtgttgccaagataatagagtggttcacaagtaaggagcccatcaacctcggtctgctgtactgggaggatccagacgatatggggcaccacctcggccccgatagcccattgatgggacccgtgatttccgacattgacaaaaagctcggttacttaatccagatgcttaaaaaggccaaactttggaacactctgaatttaatcatcaccagcgaccacggcatgacacagtgcagtgaagaaaggttaatagagctcgatcagtacctcgacaaggatcactacaccctaatcgatcaaagccctgtcgctgccatcctgcccaaggaagggaaatttgacgaagtgtatgaagccttgactcatgcccacccaaacctgaccgtgtacaagaaagaggatgtacccgaacgctggcattacaagtacaacagtaggatccagcccattatcgccgttgccgacgagggatggcacatactccagaacaagagcgatgactttctacttggtaatcatgggtatgataacgccttggccgacatgcatccaatttttctagcacacggccccgcgttccgtaagaacttctcaaaagaggctatgaactccacagatttgtacccactcctgtgccacctgttgaacattaccgctatgccacacaacgggtccttctggaacgttcaagatttactcaactcggctatgccccgcgtagtgccatatacccagtcaactattttgcttcccggttccgtcaaacctgcagaatatgatcaggaagggtcttacccatattttataggggtcagcctgggtagcataattgtcatcgtgttttttgtcatcttcataaagcatcttattcactctcaaattcctgctcttcaggacatgcacgctgagattgctcagcctcttctgcaagcatag

SEQ ID NO: 5204 - DNA, 1254 bp, Artificial Sequence
  Description of Artificial Sequence: Synthetic coding sequence
atgaggttcgcctggaccgtactgctgttggggcctctgcagttatgtgctctggtgcattgcgctccaccagccgcaggacagcagcagcctccgagggagccacccgcagcccccggggcctggcgtcagcagatccaatgggaaaataatggccaggtgttctccctcctgtctctaggctctcagtaccagccccagaggcgtcgcgatcctggtgccgctgtccctggcgccgccaatgcttcagctcagcagccccgcacacctatcctgctcatacgtgacaaccgcactgccgcagccaggacacggacagctggaagttcaggtgtaaccgccggaagacctcgacccactgcccggcattggttccaggcgggatattcaacctcaagagcgcgagaggcgggcgccagtagggcagagaatcagacagcccccggggaagtccccgcgctcagcaatctgagaccccctagccgggtcgacggcatggtgggtgatgatccttacaacccctataaatatagtgacgacaacccgtattacaactactacgacacatatgagaggccgcgcccgggggggagatatagaccgggatatggcacagggtatttccagtacggcctaccggatctggtggccgacccttactacatccaggcttctacttatgtgcagaagatgtccatgtataacctgaggtgcgccgccgaagagaattgtctggcatccactgcgtaccgcgccgatgtgcgcgattatgatcatcgcgtgttgctccgcttccctcagagggtaaaaaatcagggaacctcagactttctcccatcccgacctcggtattcatgggaatggcacagttgccaccagcattaccatagtatggacgagttttcccactacgacctactggacgccaatacccaacggagggtagctgagggacataaagcctcattctgcttagaggatacttcatgcgactacggctatcataggcgatttgcttgcacagcccatacccaaggcctgtcacctggatgttatgacacctacggggctgatatagattgccagtggattgacattactgacgttaaacccggtaactatattctgaaagtgtcagtgaacccgagttacctagtgcctgaatccgactataccaataacgtcgttagatgtgacatccgatataccgggcaccatgcttatgcctccggctgtacaatttcgccatactag

SEQ ID NO: 5205 - DNA, 879 bp, Artificial Sequence
  Description of Artificial Sequence: Synthetic coding sequence
atgggcgagaagagcgaaaactgcggagtcccggaggacctcctgaacggacttaaggttacagatacgcaggaagccgagtgtgccggcccacctgtccccgaccctaaaaaccaacattcccagagtaaactgctgagagacgacgaggctcatctccaggaggatcagggcgaagaagaatgcttccatgattgcagcgctagctttgaggaagagccaggggccgataaggtcgaaaataagtcaaatgaagatgttaactctagcgagctggacgaggagtacctaattgaacttgagaaaaatatgtctgatgaggagaagcaaaaacgcagagaagagagtactagactgaaggaggaaggcaacgaacaatttaaaaaaggtgactacatagaagctgagtcctcttattctcgagccctggagatgtgtccctcctgtttccagaaggagcgtagtattctgttctctaacagagctgcagcacgcatgaagcaggataaaaaggagatggccataaacgactgtagcaaggctatacagctgaatccgtcctacattagagcaattctgagaagggcagaattgtacgagaaaaccgataagttggacgaggctctggaggattataagagcattctcgaaaaggacccctccatccaccaggcccgcgaagcctgcatgaggttgcctaaacagatcgaggagaggaatgagaggctgaaagaggagatgttgggtaagcttaaggaccttggaaatctggtcctgcgccccttcggcctttcaacagaaaacttccagataaaacaggactcgagtactgggagctactcaatcaattttgtgcagaaccccaacaacaatcggtag

SEQ ID NO: 5206 - DNA, 2316 bp, Artificial Sequence
  Description of Artificial Sequence: Synthetic coding sequence
atgagcggattcttcacttcattagaccccagaagagttcaatggggagctgcgtggtatgctatgcactcacgcattctcagaacaaaaccagttgagagcatgcttgagggcaccgggacaaccacagctcacggcacgaagctcgcccaggtcttgactactgtggatctgatcagccttggagtggggtcttgcgtaggcactggaatgtatgtggtgtcaggcctcgtcgctaaagaaatggccgggcctggagtgatagtcagctttattattgctgctgttgcaagcattttaagcggagtgtgttacgctgagttcggagtccgggtacccaaaacaactggaagcgcatacacgtattcatatgttactgtcggcgagtttgtggcattttttattggctggaacttgatactggaatacctaattggaactgctgctggcgcaagcgctttgtcaagcatgtttgattcactagctaatcatactatctccaggtggatggctgacagcgtgggcactctcaatgggctgggaaagggggaagaaagttatccagatctgcttgctttgttgatcgctgttatagtgactatcattgtggccctgggggtcaaaaatagcatcggcttcaacaacgtcctcaatgtcttaaacctggctgtctgggtattcatcatgatcgcggggcttttcttcataaatggcaaatactgggcggaggggcagtttctgccccacgggtggagtggagtcttgcagggggccgcaacgtgtttctatgcttttatcggatttgatatcatcgccacaactggggaggaagctaaaaacccaaacacttccattccctacgcaataacagcgagcctcgtgatatgcctcactgcgtacgtgtcggtgagcgtcatattgaccctgatggttccctactacactattgacaccgaatctccactgatggaaatgtttgtggctcacggattttatgcagcgaagttcgtggttgccataggaagtgtcgctgggctgaccgtgtctttacttggaagtctcttccccatgccaagggtgatttacgccatggccggcgatgggttactgttcagatttctggctcacgtctctagctacaccgagacacctgtagtggcgtgcatcgttagcggcttcttggcagcgctgctggccctgctagtctcactgcgggacctcatagagatgatgtcaatcgggacacttctggcttacacgttggtttcagtctgcgtactgcttcttaggtatcagcctgagagcgacattgacggtttcgtgaagttccttagcgaagagcacaccaagaagaaggaaggtattctggctgattgcgagaaagaggcatgttccccggtgtccgagggcgacgagttctctgggccagccacaaacacctgcggggctaaaaacctgccatctctcggggataacgaaatgcttattggcaagtcagacaagagcacatataatgtcaatcacccaaactatgggaccgtggatatgactacaggaatcgaagccgacgaatccgagaacatatacttgatcaagttgaaaaaattgattggaccccactactacacaatgagaattcgcctggggctgcccggcaagatggatcgccccactgctgccactgggcatacggtgacaatctgtgttctcctattgtttatccttatgtttattttctgcagcttcataatctttgggagcgattacatatcagagcagtcctggtgggcaattcttctcgtggtcctcatggtgttactcattagcaccctggtatttgtgatcctccagcagccagagaatccaaaaaagctgccatatatggccccatgcttgccatttgtgcctgcctttgccatgctggtgaatatctacctcatgctgaaactcagtacaatcacctggatccgctttgccgtgtggtgcttcgtcggcctgctgatttacttcggctatgggatctggaatagcaccctggagatctcagcccgtgaggaggcacttcatcagtcaacataccagcgctacgacgttgacgatcccttttccgtcgaagaagggttttcatacgccacagaaggggagtcccaggaggactggggtgggcctactgaggacaaaggtttttattaccagcagatgtctgacgccaaggctaatggtaggacctccagtaaagccaaaagcaaatcaaagcataaacaaaattcagaggcactgatcgccaatgatgagttggactactcaccagagtag

SEQ ID NO: 5207 - DNA, 513 bp, Artificial Sequence
  Description of Artificial Sequence: Synthetic coding sequence
atgggtaatgaagcctcctatcccctggagatgtgctcacacttcgacgccgatgaaatcaagcgcctgggtaagcggtttaagaagctggacctcgataattctgggtctctctcggtggaggaatttatgtcccttccggagttacagcagaacccactggttcagagagtgatcgatatatttgacactgacggaaacggagaggtggacttcaaggaattcatcgaaggcgtaagccagttctccgtgaagggcgacaaggagcagaagttacgcttcgcttttcgcatttatgatatggataaagatggatatattagtaacggcgaactgtttcaagttctgaagatgatggtcgggaataatctgaaggacactcaactacaacagatcgttgacaagactattatcaacgctgataaagacggagacggcagaatctcctttgaagagttctgtgcagtggttggtgggcttgacatacataagaagatggtggtcgatgtgtag

SEQ ID NO: 5208 - DNA, 1218 bp, Artificial Sequence
  Description of Artificial Sequence: Synthetic coding sequence
atgtcgtcatcagtgaaaaccccggctctggaagagctggtcccgggaagcgaagagaagcccaaaggacgctctccactgagttgggggagtctcttcggtcacagaagtgaaaagatagtgtttgccaaatctgatggagggactgatgaaaacgtgctgacagttaccatcaccgaaaccaccgtcattgaaagtgaccttggagtatggtcttcacgggccctgctctacctcacgctctggttttttttctcgttttgcactttgttcctgaataaatatatattatcgctcctgggtggcgagccatctatgttgggcgcggtacaaatgctgagtaccacagttatcgggtgcgtcaaaacactggtgccgtgctgtctgtaccaacataaggcaaggcttagctacccccctaacttcttaatgaccatgctctttgtcggtctgatgaggttcgccaccgtcgtgctggggcttgtgagccttaagaacgtcgctgtgtctttcgcggagactgtgaagtcaagtgctccaatattcacagttatcatgtctagaatgatcctgggagagtacaccggcctgctggttaatctttccctgatccccgtgatgggaggattggccctttgcactgctactgaaattagcttcaacgtcctcgggtttagtgccgccctaagcacgaacatcatggactgtttgcagaatgtgttctcgaagaaactcctttccggggataaatatcggttttccgcaccagaactgcagttttatacctctgccgctgccgttgcaatgctcgtgcccgctcgggtgttttttaccgatgtgccggtcatcggacggagcggaaaatcattctcctacaatcaggatgtagtcctcttgctgctgaccgacggagtgttgttccaccttcagagcgtaacagcctatgcactgatgggaaaaatctccccagtcacttttagcgttgctagtacggtgaaacacgccctgtccatttggctgagcgtgatcgttttcggaaacaaaatcacatctctaagtgctgtcggcactgccttagtcacagttggtgtcctgttgtacaataaggcccggcagcaccagcaggaggccttgcaaagcttggcagcagccaccggacgggctcctgacgacactgtggagcccctcctgcctcaggaccctcggcaacatccgtag

SEQ ID NO: 5209 - DNA, 1131 bp, Artificial Sequence
  Description of Artificial Sequence: Synthetic coding sequence
atgcttaaaaaaatctctgtgggcgtggccggcgatctcaacaccgtcacgatgaaactgggctgtgtgttaatggcttgggctctatatctgtctctgggcgttctttgggtggcacagatgctgctggcagcgtccttcgagacccttcagtgcgagggacctgtgtgtacagaggaaagttcatgccatactgaggacgatctgacggatgctcgcgaagcaggatttcaggtgaaggcatatacattttccgagcccttccacctgatcgtgtcctatgactggttgatcttacagggtccggcaaaaccagtgttcgagggagatttactggtgcttaggtgtcaagcctggcaagattggcccttaacgcaagtcaccttttatcgtgatggatctgcactgggtccgcctggacccaatcgcgaattctcgattaccgtcgtgcagaaggctgacagtggtcactatcactgctcggggatctttcagtcgcccggacctggaatcccggaaaccgcttccgtggtcgccatcaccgttcaggaacttttccccgctccaatcttgagagcagttccaagtgccgagcctcaagctgggagtccaatgacccttagttgccaaactaaactgccactgcagcgttccgccgctcggctgctgttctccttttataaagacggacgtatcgtgcaaagtagggggcttagcagcgaatttcaaatccctaccgctagcgaggatcattccggctcttattggtgtgaggcagctactgaagacaaccaggtatggaagcagtcccctcagctggagataagggtccagggcgcctcgtcgagcgcagctccgcccacattaaatcctgccccccagaagtcagcagcgcctggaacagcccccgaggaggccccgggacctctcccacccccaccaacgccaagcagcgaggatccaggcttttcatccccacttggaatgcctgacccccacctgtatcaccagatggggctgctgttgaaacacatgcaagatgtccgagttctcctaggccatctgctcatggaactgagagaattgtctggacacagaaaacctggtacaaccaaagccactgcggagtag

SEQ ID NO: 5210 - DNA, 1572 bp, Artificial Sequence
  Description of Artificial Sequence: Synthetic coding sequence
atggcgcgaaaggcgctaaaactggcttcctggacctcaatggccctagctgctagtgggatttatttctattcaaataagtacctggaccccaacgatttcggggcagtgcgcgttggccgagctgtggccactaccgccgttataagctacgactacttgacctccctgaaaagcgtcccatatggttccgaggagtaccttcagttgaggtcaaaagtacatctaagaagtgctcgcaggctgtgcgagctatgttgcgcaaacagagggacctttatcaaggtaggccaacacctgggcgcacttgattacctgctaccggaagagtacacttccaccctgaaggtgttacatagccaagcgcctcagtccagcatgcaggagatccgacaggtcatccgggaggacctcgggaaggagatccacgatctgttccagtcatttgatgatactcctcttgggactgctagcttggctcaagtacacaaggccgttctgcatgatgggaggaccgtcgccgtgaaagtgcagcaccccaaagtacgagctcaatcctccaaagacatacttctgatggaagtgctggttctcgcagttaaacagctgtttccagagttcgagtttatgtggcttgttgatgaggctaaaaaaaacctgcctctggaactcgacttccttaacgagggacggaatgcagagaaagtctcacaaatgctgcggcattttgacttcctgaaagttcctcgcattcattgggacctttccacggagagggttttactgatggagttcgttgacggtggccaggttaatgaccgcgactacatggagcgcaataagatcgacgtgaacgagatttcaaggcacttgggaaaaatgtatagtgaaatgatttttgtgaacggattcgtacactgtgatccgcaccctggtaatgtgttagtgcgcaaacaccctggcaccggtaaagctgaaatcgtcctgttagatcatggcttgtaccaaatgctgacagaggagtttagactcaactactgtcacctatggcagtctctcatctggacagacatgaagcgagtgaaagaatactcacagaggctgggcgccggggatctctacccgctctttgcctgcatgttaaccgcaaggtcttgggactctgttaatcgtgggattagtcaggcacccgtcactgccaccgaagatcttgagatcaggaataatgcggccaattacttaccccaaattagtcacctgctgaatcacgttccacggcagatgctgctgattctgaagacaaatgatctactgcggggcattgaggctgctctggggacccgagcctccgcttcgagttttctgaacatgtctcggtgttgtattagggcccttgctgagcataagaaaaaaaacacttgtagttttttccgacgcacccagatctcattttccgaggcgttcaatctatggcagataaacctgcatgagttgatcctccgcgtgaaggggcttaagctcgccgatcgcgtactcgcccttatctgttggctctttcccgccccattatag

SEQ ID NO: 5211 - DNA, 1197 bp, Artificial Sequence
  Description of Artificial Sequence: Synthetic coding sequence
atgtggcttctcctgactatggcaagcctgatatcggtcttgggtactactcacggtctctttgggaaactacatcccggatccccggaggtcacaatgaacatcagccagatgatcacctactggggttaccctaatgaagaatacgaagtcgtcacggaggatggatacattcttgaggtaaatcggattccctacggcaagaaaaactccggcaacaccggccagcgacccgtagtcttcctgcaacatggcctgttggcttctgcaacgaattggatttccaacctccccaacaacagcctagcatttatactggcagacgctgggtatgacgtgtggctggggaactcgcggggtaatacatgggcaagacggaatttatactacagtcctgatagtgtcgagttctgggccttttcttttgacgagatggccaagtacgatcttcccgccacgatagactttatcgttaaaaagactgggcagaagcagctacactatgtgggccatagtcagggaactaccatcggttttatcgccttctccacaaatcctagtctcgctaagagaatcaaaaccttctacgcccttgcaccagtggctacggtgaagtataccaagagtctcatcaataagcttcggttcgtccctcagtccctcttcaaatttatatttggagataagatcttctatccccataatttcttcgaccagttcttagctaccgaggtctgctccagagagatgctgaaccttctgtgttctaacgccctgtttattatatgcggcttcgactccaaaaactttaatacatctaggctggatgtctacctcagccacaatcccgccggcacgtcagttcaaaacatgtttcactggactcaggcagtaaagagcggtaaattccaggcttacgattggggatcccccgtccagaatcgtatgcattacgaccagagccagcctccctactacaatgtgaccgccatgaacgttcctatagctgtgtggaatggaggcaaagacctgctggcagatcctcaggatgtaggcctgctgttacctaagctgccgaacctcatttaccacaaagagatacctttctataatcatctcgacttcatttgggccatggatgcaccccaagaggtttacaatgatatcgtaagtatgataagcgaggataagaagtag

SEQ ID NO: 5212 - DNA, 555 bp, Artificial Sequence
  Description of Artificial Sequence: Synthetic coding sequence
atgaggggacagggccgcaaagagtctctgtcagactcccgagacctcgatgggtcttacgaccaactgacggacagcgtggacgacgagtttgagctcagcacggtttgccatcgtccagaaggcctggaacagcttcaggaacagaccaagttcactcgcaaggagctgcaagtgctttaccgaggttttaagaatgaatgtccgtctggcatagtgaacgaagagaactttaaacagatttactcacagttctttcctcagggggacagttccacatacgccacgttcctcttcaacgctttcgacacaaaccacgatggatccgtgtcctttgaggagatgctggacatcatgaaaagcatttacgatatgatggggaagtacacttaccccgcgctgagggaggaagcccccagagagcacgttgagtcctttttccagaaaatggaccgaaacaaggatggcgtcgtgactattgaggagttcattgagtcatgccagaaggtccagcttccagctctctatataactctgacttggacacaggcgtag

SEQ ID NO: 5213 - DNA, 3900 bp, Artificial Sequence
  Description of Artificial Sequence: Synthetic coding sequence
atgtctttacaggagatgtttcggtttcccatggggctgttgttaggaagtgttctgctcgtggcctcggctcctgccacactggagccccccgggtgttctaataaggagcaacaagttaccgtcagccatacgtataagatagatgttccaaaatctgccctggtgcaggtggatgcggacccacaaccgctgtccgacgatggggcttcactgctggcactgggagaagctcgggaagaacagaatattatcttccgccacaacattaggctgcaaaccccgcagaaggattgtgagctcgccggaagcgtccaagacctcctggctcgggtgaagaagctggaagaagaaatggtagagatgaaggagcagtgttccgcacaacgctgttgccagggcgtcaccgacctgagtcggcattgctctggccatgggacgttctctctcgaaacatgttcctgtcactgtgaggaaggaagggaaggcccagcctgcgagaggctcgcatgtcctggggcatgctctggtcatggcaggtgtgtggatggtaggtgtctgtgccacgagccctatgtgggagccgactgcgggtatcccgcttgtcccgagaactgctctggccacggtgagtgtgtacgcggagtctgccagtgccacgaggacttcatgtctgaggattgtagtgagaaaaggtgccccggggactgtagtggccacggcttctgtgataccggagagtgctattgcgaagaaggcttcacggggctggactgcgcccaggtggtgactccacagggcctccaactgttaaagaacaccgaggacagcctcctcgtctcatgggaaccaagttcacaagtcgatcattatctcctctcttactaccccctgggaaaggaactgtccggaaagcaaattcaggttcctaaggagcagcatagctatgagattttgggactgttgcctggaacgaagtatatcgtcacactgagaaacgtgaaaaatgaagtctcaagcagcccgcagcacttattggccactaccgaccttgccgtattaggaaccgcctgggtcaccgatgagactgagaatagccttgatgttgagtgggaaaacccctctaccgaggtggactactacaagttacggtacgggccaatgacagggcaggaggtggcagaggttacagtgcccaaatcctctgatcccaagtctcgatacgatattactgggcttcaccctgggacagaatataagatcactgtggtgccaatgcgcggggagttagagggcaaacctattctcctgaacggccgtacagaaattgactccccgacaaatgtggtgactgaccgtgtgacagaggatacagcgacggtttcctgggatccagtgcaggctgtcattgataaatacgtggtgcgctatacctctgctgatggcgacaccaaggagatggccgttcacaaagatgaaagttccacggtattgaccggactaaaacccggtgaggcgtacaaagtttacgtgtgggctgaacgaggcaatcagggctcaaagaaggccgacaccaacgctctgactgagattgattcccctgcaaatctagtcaccgatcgcgtgacagaaaataccgccacaatttcatgggacccagtgcaagctactatcgataagtacgtggtgaggtacactagtgccgatgaccaggaaactcgcgaggtcctcgttggcaaagaacagtctagcaccgtgcttactgggctgaggcctggggtagaatatactgttcatgtctgggcacaaaaaggcgatagggaaagtaaaaaagctgacaccaatgcccctaccgacatcgactcacctaaaaatctggtgaccgacagggtgaccgaaaacatggccaccgtatcctgggatcccgtccaggcagcaattgataaatacgtagttagatatacatcagccggcggcgaaacccgcgaagtgccagtgggcaaggagcaatcttccaccgttttaactgggctgcgccccggaatggaatacatggttcacgtttgggctcaaaagggggatcaggagtcaaagaaagcagacactaaagctcagaccgacattgattcaccgcagaacctcgtgacagacagagtgactgagaacatggccacagtgtcttgggacccagttcgggctacaattgaccgttatgtagtgaggtacacatcagctaaggatggggaaacacgagaggtgccagtgggaaaagaacagtcctcaaccgtgctgacaggcctcaggcccggcgtggaatacaccgttcatgtttgggcacaaaaaggggcccaggagagcaagaaagcagacactaaagctcaaaccgatatcgacagtccccagaacctggtgacagactgggtaaccgagaacaccgcaaccgtgagctgggaccctgtgcaagccaccatcgatcgatacgttgtgcactatacttccgcgaacggtgagaccagagaggttccagtcggaaaagagcaaagcagcacagttctgacaggacttagacccggaatggagtacaccgttcatgtgtgggcccaaaagggaaaccaagaatctaagaaagccgatacgaaagcacagacagagattgatggaccaaaaaacctggtgaccgactgggttactgagaatatggccactgtatcctgggatcccgtgcaggctactatcgataagtacatggtgaggtacacatccgccgacggcgagacacgagaggtacccgtgggaaaggaacacagcagcacagtacttaccggtctccgcccaggcatggaatatatggtgcatgtttgggctcagaagggtgctcaggagagcaaaaaggccgacaccaaggcccagaccgaattggacccccctagaaacctgcggcccagtgctgtcacccagagtggcggaattctaacgtggacgccaccatccgctcagatccacggctacatcctgacctaccaatttccagacggaaccgtcaaagaaatgcaattaggacgggaagatcaaagatttgcactgcagggcttggaacagggagccacttacccggtgtccctggtggccttcaaaggtggccggagatcccgaaacgtttcaaccacattgtcgacggtgggagcaagattccctcacccctcggattgctcccaagtgcaacagaactcaaatgccgcaagtgggctgtacacaatctatctgcatggcgacgctagtcggccactccaggtttactgtgacatggagacggatgggggaggttggatcgtttttcagcgcagaaacacaggacagttagatttctttaagaggtggcgctcctatgtcgaaggattcggcgatcctatgaaagagttctggttgggcttggacaagctgcataacctgactactggcacccctgccagatatgaggtcagggtcgatcttcagactgccaatgagtccgcctatgccatatacgacttcttccaggtcgcgtcaagtaaggagcgctacaagctgaccgtgggtaaatatcggggcacagcaggtgatgccctgacgtatcacaatggctggaaatttactacgttcgacagggataacgacatcgctctgagcaattgtgccctgacgcatcacggagggtggtggtataagaactgccatttagcaaacccgaacgggcgctatggtgagaccaaacacagcgagggggtcaactgggagccctggaagggccatgagttcagcattccctatgttgagttgaaaattaggcctcacgggtattcaagagagccggtgctaggccggaaaaagcgtaccctgcgcggcaggctgagaaccttctag

SEQ ID NO: 5214 - DNA, 1662 bp, Artificial Sequence
  Description of Artificial Sequence: Synthetic coding sequence
atgactaggggcggacctggtggaagacctggcctgccccaaccaccacctcttctcctcctgctgctgctcctccctcttctgctggtgacggctgagcccccaaagccagctggcgtgtactacgctacagcctactggatgccagctgagaagacagtgcaggtgaagaacgtgatggataagaatggggatgcatacgggttctacaataacagcgtgaaaaccacaggctggggcatactcgagattcgtgctggctacggttcccaaactcttagcaatgagatcatcatgtttgttgcgggatttctggaagggtacctcactgccccccacatgaatgaccactatacaaatctctatccccagctgattactaagccatccatcatggacaaggtacaggatttcatggagaaacaggataagtggactcgtaaaaacattaaggaatacaagacggatagcttctggcgccacactggttatgtcatggcacagatcgatggactgtacgtgggggcaaagaaacgtgctatactagaggggacaaagcctatgacattgtttcaaatccagtttttaaacagcgtgggcgacttgctggacctgatccctagcttgtcccccaccaagaacggttccttgaaagtgttcaaaagatgggatatggggcattgcagcgcacttatcaaagtgcttcctggcttcgagaatatccttttcgctcattcatcatggtacacctacgctgcgatgttgagaatatataagcactgggacttcaacgtaattgacaaggatacctcctcatcaaggctgtcctttagctcataccccgggtttctagaaagcctggatgatttctacatcctaagctctgggctcattctacttcagactacgaacagtgtattcaataaaacactcctcaaacaggtgatcccagagacactcctgtcctggcagagggttcgagtcgccaatatgatggcagattcagggaaacggtgggccgacatcttctctaagtacaactctggcacgtacaataatcaatatatggtactagaccttaagaaggtcaagctcaaccactctctggataaaggcaccctctacatcgtcgaacagataccaacatatgtggagtacagcgagcagaccgatgtgcttaggaagggctactggcccagctacaatgtgcctttccacgagaagatctacaattggtccggatacccgctgctggtgcagaagctcgggctcgattattcctatgatctggcacctagagccaagattttcagacgcgaccaaggcaaggtcactgatactgcaagcatgaagtatatcatgcgctacaataactacaaaaaggacccatacagtaggggtgacccttgcaacactatctgctgcagggaggatctgaatagtcccaatccatctccaggaggctgttacgacacaaaggtggcagacatttacttagctagccagtatacaagttacgctattagcggtcccacagtgcaggggggactccccgtattccgatgggacagattcaataaaaccctgcatcaggggatgccggaagtgtataatttcgactttattaccatgaaaccgattttgaagctggatattaaatag

SEQ ID NO: 5215 - DNA, 2271 bp, Artificial Sequence
  Description of Artificial Sequence: Synthetic coding sequence
atgtctcgccctggaacagccacccctgccctggctcttgtactcttagccgtaactttggctggtgtaggcgctcagggggctgcgctcgaagaccctgactattacggacaggagatttggtctcgggagccttattatgcccgaccggagccagaattggagacattttcgccgcctctccccgccggccccggggaagaatgggagaggcgcccccaagaacctcggcctccaaagcgcgccactaagccaaagaaagcccccaagcgggagaagagcgcccccgaaccgccacccccggggaagcacagcaacaagaaagtgatgaggactaagagttctgaaaaggcagcaaacgacgatcatagcgtgcgggtggcacgggaggacgtcagagaatcttgcccacctctgggcctggaaactctcaaaatcaccgactttcaattgcacgcgtctacagtaaaaaggtacgggctgggggcgcaccggggccgattgaacatccaggccggtatcaatgagaacgatttttacgacggcgcctggtgcgcagggcgaaatgacctgcagcagtggatcgaagtggatgccaggagacttacacgctttaccggagtaattactcaggggcgaaacagcttatggctttctgattgggtgaccagttacaaagtcatggtgtcaaacgatagccatacttgggttactgtgaagaacggcagtggggatatgattttcgagggtaattccgaaaaggagattcctgtgctgaacgaactgccggtgccgatggtcgcacggtatatccgtattaacccccaatcgtggtttgacaatgggagcatttgtatgagaatggagatcctgggctgtcctctgccagaccctaacaattattaccacaggagaaatgagatgaccaccactgatgatctggacttcaagcaccataactataaggagatgagacaactgatgaaggtcgtgaacgagatgtgtcccaatatcacccggatatacaatatcggtaaatctcatcagggactcaaattatacgctgttgagattagtgaccaccctggcgaacatgaggttggggagcccgaattccattatatcgcaggtgcacatggaaatgaggtgctgggccgggagctcctgctgctgctggtccagtttgtctgccaggagtaccttgcacgcaacgccagaattgtacatcttgttgaagagacccgaattcatgttctgccatccctgaaccccgatggttacgagaaggcctatgaaggcggatccgaactcggcgggtggtcactcggcaggtggacacacgatggcattgacatcaataataatttcccagatttgaacactttgctgtgggaagctgaagacaggcagaatgtaccaaggaaagtgccaaaccattatattgccatccctgagtggtttttgagcgaaaacgccacagtggctgccgagaccagagccgtcattgcttggatggagaagattcccttcgtgctgggcggaaacttacaaggaggtgagctggtcgtggcttatccgtacgatcttgtgaggtctccgtggaagacccaggagcacacacccactcctgatgaccacgtattccggtggctggcttacagctatgcttcaacgcaccggctaatgacagatgcaaggcgccgagtttgtcatactgaagatttccaaaaagaggaaggcaccgtcaatggggcgagctggcacacagtggccggctcattaaacgatttctcttatctccataccaactgctttgaactgagtatttacgtgggatgcgacaaatatccgcacgagagccagcttcccgaggagtgggagaacaaccgggaaagccttatagtcttcatggaacaagtgcatcggggcatcaaggggctggtgcgggacagccatgggaagggcattcccaacgccattatatccgtagagggcattaatcatgatattcggacggctaatgacggagactactggcggctgctaaacccgggggaatacgtggtgacagccaaggccgaaggctttacagcctcaacgaagaactgtatggtaggatacgacatgggggcaacgcgctgtgacttcactcttagtaagacaaacatggccagaattagggaaattatggaaaaattcggcaaacagcccgtgtccctgccagctcgtcggctgaaactgagaggccagaagcggaggcaacggggttag

SEQ ID NO: 5216 - DNA, 702 bp, Artificial Sequence
  Description of Artificial Sequence: Synthetic coding sequence
atggccacacctccattcaggctgatcagaaaaatgtttagcttcaaggtgtctcgttggatgggcctggcttgctttagaagtctggctgccagtagccctagtatcaggcagaagaagttaatgcacaagttgcaagaggagaaggccttccgagaggaaatgaagatttttcgggagaagatcgaagacttccgtgaggagatgtggacttttagaggcaagatccacgcctttaggggacagattctaggcttttgggaggaggagaggcccttctgggaggaggaaaaaacattctggaaggaggagaagtcattctgggaaatggagaagtccttccgcgaggaggaaaagaccttctggaaaaaatacaggacgttctggaaagaagataaggcgttctggaaggaggacaacgccctgtgggaaagggaccgcaatctgctccaagaggataaggccctttgggaggaagaaaaagccctgtgggtggaggaacgggctctcctggaaggggagaaggctctctgggaggacaagacctctctttgggaggaagaaaacgctctgtgggaagaagagcgcgctttttggatggagaacaacggtcacatcgctggagagcagatgctggaggacggaccacataacgccaaccgtggacagcggctgctggctttctccaggggacgcgcatag

SEQ ID NO: 5217 - DNA, 696 bp, Artificial Sequence
  Description of Artificial Sequence: Synthetic coding sequence
atgatgctgagctgtctgttcctgctgaaggccctgctggctctcgggagcctggaaagctggatcacggctggggaacacgccaaggaaggtgaatgccccccacacaagaatccttgtaaagagctgtgccaaggagacgaactctgtccagccgagcagaaatgctgcaccactgggtgtggaaggatttgccgggatattcccaagggccgcaaaagggactgcccacgggtgatccggaagcagagttgcctgaagcggtgcattaccgatgaaacttgccccggcgtgaagaaatgttgtacactgggctgtaataagtcttgtgtcgtccccatatcaaaacaaaagctggctgaatttggtggcgaatgtcctgccgatcccctgccgtgtgaagaactttgcgacggggatgcctcttgtccccagggccacaaatgctgcagtaccggttgtggtaggacatgtttaggagacattgagggcggcagagggggagactgccccaaggtgctggttggcctgtgcatcgttggctgtgtaatggatgagaactgccaagccggggagaagtgctgtaaatcaggctgtgggaggttctgcgttccaccagttctgccaccaaagctgactatgaaccctaactggactgtgcggtcggacagcgagttggaaatcccggttccgtag

SEQ ID NO: 5218 - DNA, 1050 bp, Artificial Sequence
  Description of Artificial Sequence: Synthetic coding sequence
atgggccctatctctgccccctcttgtcgttggagaataccctggcaaggacttctgctgacagcttccttgtttacgttttggaacccaccaactaccgcccagctgactatcgaagccgtgcccagtaatgccgccgagggcaaggaggtgttattgttagtgcacaatctgccgcaggatccccgtggctataactggtacaagggcgagacggtggatgccaatcggcggatcattgggtatgtgatctcaaatcagcagattacacccggccctgcctactctaaccgtgaaactatttaccccaatgcttccctgttgatgagaaacgtcacaagaaacgatacagggtcctatacacttcaggtcattaaattgaatctcatgagtgaagaggtgaccggccagtttagcgtgcaccctgaaacccctaagccttccatcagttcaaataactctaaccctgtggaagataaggacgccgtcgcgtttacatgcgaaccagagacacagaacactacatacttgtggtgggttaacggccaatctctgccagtgtcacccaggctgcaactgtctaatggcaacaggactttgacattgctgtctgttactcgcaatgacgtgggcccgtacgaatgcgaaatccagaatcctgcttccgccaacttttccgacccagtgactctaaacgtgctgtacggacccgacgctcctaccatctctccgtccgatacttactatcacgcaggggttaatctgaatctatcatgccacgcggcttctaacccaccatcccagtactcgtggtcggtgaacggcacattccaacaatatactcaaaagttattcatacccaacatcacaactaagaatagtgggagctacgcgtgccataccactaattctgcgacaggacggaaccgcactactgtgcgaatgatcacagtctctgacgctctcgttcaaggctcttctcccggcctctcagcccgcgccacagtttctattatgatcggcgttcttgcgagagtggcattaatttag

SEQ ID NO: 5219 - DNA, 510 bp, Artificial Sequence
  Description of Artificial Sequence: Synthetic coding sequence
atgaccgctggtcgcaggatggagatgctctgcgcggggcgcgttcccgcactgctcctgtgcttgggctttcatctgcttcaggcggtgctgagtacaacagtgatcccctcttgcataccgggcgagagttcggacaactgtaccgcactggtgcaaacagaggataacccaagggtggctcaggtctccataacgaagtgctcttccgacatgaatgggtactgtctccatggtcaatgcatatacttggtggacatgtcacagaattattgtcgttgtgaggtcgggtacacaggggtaagatgtgaacatttttttttaactgtgcaccagccattatcaaaagaatacgtggccctgaccgtcattttgataattctgtttctgattactgtggtcggctctacatattatttttgccggtggtaccgcaatcgtaaatcaaaggaacctaagaaagaatatgagcgggtgactagtggtgaccccgagctcccacaggtatag

SEQ ID NO: 5220 - DNA, 273 bp, Artificial Sequence
  Description of Artificial Sequence: Synthetic coding sequence
atgaaactatctgtctgtctattacttgtaactctggccctgtgttgctaccaggctaacgcagagttctgccctgcactcgtctctgagctcctcgatttcttttttatttccgagcccctctttaagctctcactggctaaattcgacgcaccgcccgaggcagttgcagctaaactgggcgttaagaggtgtaccgaccaaatgagcctgcagaagcgctctctaatcgctgaagttctggtcaaaatcctgaagaaatgctcagtttag

SEQ ID NO: 5221 - DNA, 429 bp, Artificial Sequence
  Description of Artificial Sequence: Synthetic coding sequence
atgccccgctgtagatggctttcactcatactcctcacaattcccctcgcactagtggcacgcaaggatcctaaaaaaaacgaaactggtgtcttgagaaaactaaaacccgtaaatgcctcaaacgctaacgttaaacaatgtctgtggttcgcaatgcaagagtataataaggagtcagaggataagtacgttttcctggttgtcaaaacactgcaagcgcagcttcaggtcacaaacttgttggaatacctgattgatgttgagatcgcccgaagcgattgtaggaaacctttgtccaccaatgaaatttgtgccattcaggagaattccaagttgaagagaaaactgtcatgctcatttttggtcggcgccctaccttggaacggagagttcaccgtgatggagaagaaatgcgaggatgcatag

SEQ ID NO: 5222 - DNA, 438 bp, Artificial Sequence
  Description of Artificial Sequence: Synthetic coding sequence
atgggaataggatgttggcggaacccgctgctactgctgattgccctggtcctgtctgccaagttgggccattttcagcgctgggagggcttccaacaaaaacttatgagtaagaagaacatgaactccacattaaacttctttatccagtcgtacaacaacgcaagcaacgatacatacctctaccgcgtccagaggttgataagaagccagatgcaactcaccactggagtggaatacattgttacagtgaaaatagggtggacaaagtgcaagagaaacgacacatccaattcttcctgtcccctgcaatcaaagaagttgaggaagtccctgatttgtgagtctttaatctacaccatgccatggataaactattttcagctgtggaacaattcctgtctcgaagccgaacatgtcggcaggaacctgagatag

SEQ ID NO: 5223 - DNA, 552 bp, Artificial Sequence
  Description of Artificial Sequence: Synthetic coding sequence
atgaaattactgtttccgattttcgcttcactgatgcttcaataccaagtcaacaccgagtttattggcttgaggcggtgccttatggggttgggtcggtgccgggaccactgtaacgtcgacgagaaggaaatccagaaatgtaagatgaaaaagtgctgcgtaggccccaaggtggtgaaactgatcaaaaattacttgcagtatggtacaccaaatgtgctaaatgaagacgttcaggaaatgctcaagcccgctaaaaacagcagcgccgttatccagcgcaaacacatcctgtcagtcttgccacaaattaaatccacctcatttttcgcaaatacaaatttcgttataattcccaacgccacccctatgaacagtgctaccatctcaacaatgacacctgggcagataacctataccgctacaagcacaaaatccaacaccaaagaatcaagagatagtgctacggcctcaccaccgccggccccacctccgcctaatatcctacctaccccgagcctggagttggaggaggccgaggagcagtag

SEQ ID NO: 5224 - DNA, 609 bp, Artificial Sequence
  Description of Artificial Sequence: Synthetic coding sequence
atgagaggacacccgtcgctactgctgctctacatggcgctcactacttgtttggatacctccccatcagaggagacagaccaggaagtgtttttaggtcctcctgaggcacaaagtttcctgtcctcccatactagaatcccccgcgccaaccactgggaccttgagctcctgactccaggcaacctggagcgagaatgcttggaagaacgctgtagctgggaggaagcaagggagtacttcgaggacaacacattaacagagaggttttgggagtcatatatatacaacggcaagggcgggcgaggtagggtcgacgtggcatccttggcagttggtcttactggaggcattctcctgattgtgctggctggtttgggggcattctggtacctgcggtggaggcaacaccgcggacagcaaccgtgcccgcaggaggcagggcttatatctcccctgtccccattaaatccactcgggcccccaacgcctttgccacctccgccccccccaccaccagggttaccaacttatgagcaggccttggctgccagcggcgttcatgacgccccacctcccccttacacgagcctccgcaggcctcactag

SEQ ID NO: 5225 - DNA, 558 bp, Artificial Sequence
  Description of Artificial Sequence: Synthetic coding sequence
atgcgcttattaattctcacatgcctggtcgccgttgccctcgcacgcccgaaacttcctctgaggtaccctgagcggttgcagaatccctctgagtcatctgaacccataccattagaatcccgcgaggagtacatgaatggcatgaacagacagagaaatatactgagagaaaaacagactgatgaaatcaaagataccagaaacgaatccactcaaaactgcgtcgtggccgagccagagaaaatggaatcgagtatatcctcttcttctgaagaaatgagtctcagtaagtgcgccgagcaattttgtaggctcaacgagtataatcagctccagctgcaggccgcgcatgcacaggagcaaattcggcgcatgaacgagaatagtcatgtccaggtcccctttcagcagctgaaccaactcgctgcatatccttatgctgtatggtactatccgcagatcatgcagtacgtccccttccccccctttagcgacatctctaatcctactgcacacgagaactatgagaaaaacaacgttatgctgcagtggtag

SEQ ID NO: 5226 - DNA, 1410 bp, Artificial Sequence
  Description of Artificial Sequence: Synthetic coding sequence
atgatcaccgagggcgcacaagcacccaggctcctgctgccccctctgctcctgctgctcaccctgcccgccacaggctctgatcccgtattgtgtttcacacaatacgaggagagcagtggaaaatgtaaggggcttctggggggtggcgtcagcgtggaagattgttgtctcaacacggcctttgcataccagaaaagatccggcggtttgtgtcagccctgtcggtcccctcgatggtccttgtggtcaacatgggccccatgctcagtgacatgctcagagggatctcagttgaggtaccgcagatgcgtgggctggaacggccagtgttccggaaaggttgctccaggaaccttggaatggcagctccaggcttgcgaggaccagcagtgctgccctgaaatgggagggtggtctggctggggcccctgggaaccatgctcagtaacgtgttccaagggaacgaggactcgacggcgggcctgcaatcaccctgctcccaaatgcgggggtcattgtcctgggcaagcccaggagtcagaggcttgcgacacccagcaggtttgtcccacacatggggcttgggccacatgggggccctggaccccctgcagtgcatcatgtcacggggggcctcatgagcctaaggaaacccgatcacggaagtgctccgcaccagagccaagccagaagccgcccggaaagccttgtcccggtcttgcctatgaacaacggcggtgcacgggcctgcctccatgcccagtggccggaggttggggaccttggggaccggtatccccctgtcctgtcacgtgtggacttggacaaacaatggagcagcggacatgcaaccaccccgtgccacagcatgggggaccattctgtgcaggcgacgccacccgcacacatatctgtaacacagccgtcccctgcccagtcgatggggagtgggattcctggggagagtggtctccctgtatccgtaggaatatgaaaagcatatcgtgccaagagattcctggtcaacagtcccggggacgcacctgtaggggacggaagttcgatgggcacagatgtgcaggtcaacaacaggatatccggcattgttatagcatccagcattgccccctaaaaggctcatggtccgaatggagcacatggggactgtgtatgccgccctgtggccccaacccaacgagagcaagacagagactctgcacacctctcctgcctaagtatcctcctacagtcagcatggtagagggccagggcgagaaaaacgtaacattctgggggcgacctctcccccggtgtgaagagctgcagggacagaaactggtcgtggaggaaaagagaccatgcctccacgtaccggcttgcaaggaccctgaagaagaagagctgtag

SEQ ID NO: 5227 - DNA, 453 bp, Artificial Sequence
  Description of Artificial Sequence: Synthetic coding sequence
atgctgatcgccacctctttctttcttttcttctcctcagtggtggctgctccaactcattcgagcttctggcagtttcagagaagagtcaagcatattaccggacggtcagccttcttttcctattacgggtacgggtgctattgtgggctgggcgataagggaatccccgtggatgacactgacagcccctctagtccttctccctatgagaagctgaaggaattctcgtgtcagcccgtcctgaattcttaccagttccatatcgtaaatggagctgtcgtctgcggctgtactctgggaccgggtgcctcctgccattgtcgcctgaaggcttgtgaatgtgataagcagtccgtgcattgtttcaaggaaagcctgccaacttacgaaaagaacttcaagcagttcagcagccagcctcgctgtggtagacataagccctggtgctag

SEQ ID NO: 5228 - DNA, 1347 bp, Artificial Sequence
  Description of Artificial Sequence: Synthetic coding sequence
atgagagagtgcatcagtgtgcacgtggggcaggcgggcgtgcaaatgggcaacgcctgttgggagctttactgcctggagcacggcatccagccggacgggcagatgccctccgacaagactatcggggggggtgacgactccttcaccaccttcttttgcgagactggggcagggaaacatgtgccgcgagccgtgttcgtcgaccttgagcccacagtcatcgacgagatacggaacggcccgtaccggcagctgttccatcctgaacagttgatcacagggaaagaggatgcagcaaacaactacgcccgaggacattatacaatcggcaaggaaatcatcgatccggtcctcgaccgcattcgaaagctctcggaccaatgtacagggctgcaggggtttctcgtctttcacagctttggagggggtaccggtagcggattcacatctcttttgatggaacgcctgagcgtcgactacggaaaaaagtccaagctggaattctccatttatccagctccccaagtgagtacagccgtagtcgaaccctataattcaatacttactactcacactactctggaacattccgattgtgccttcatggttgataacgaggccatctatgacatatgccggaggaatctggacattgagcgccccacttacacgaacttaaacaggctaattagccagattgtgagcagcattacagctagcctacggttcgacggggccctgaacgttgacctcaccgagtttcagacaaatctagttccctatccccgtatccacttccctttggccacttacgcccctgtgattagtgcggagaaagcatatcatgaacagctgtcagtcgcagaaattacaaatgcttgcttcgaaccggccaaccagatggtgaaatgtgatcctaggcatggtaagtatatggcgtgttgtctcctgtacagaggcgacgtagtcccaaaagatgttaacgcagcaatagcggcaattaaaacaaagcggtcgatccagtttgtggactggtgtccaactggattcaaagttggaatcaactatcagcctcctactgtggttccaggaggagacctggctaaagtgcaacgggcagtctgtatgctcagtaataccaccgctatcgcagaagcctgggcaagactcgaccacaagtttgatctgatgtacgccaaacgcgctttcgtccactggtacgtgggggaaggcatggaggagggagaattttctgaagcacgtgaggatatggctgctctggaaaaagattacgaggaagtcggtatcgactcctacgaagatgaggacgagggcgaagagtag

SEQ ID NO: 5229 - DNA, 942 bp, Artificial Sequence
  Description of Artificial Sequence: Synthetic coding sequence
atgcgcgtggtcaccatcgtcatccttctatgcttttgcaaggctgctgaactcagaaaggcaagtcccggctccgttcgctccagggttaatcacggaagggctgggggcgggagaagaggtagcaatcccgtgaagagatatgctcctggactcccttgcgatgtgtatacgtacttacatgaaaagtacctcgactgccaggaacggaaactggtgtacgtcctgccaggatggccccaggacctgctgcacatgctgctcgcaaggaataaaatacggacattaaagaacaatatgtttagcaagttcaagaagcttaagtcactggacttgcaacaaaatgaaataagcaagattgaatcagaggccttcttcggcttaaataaactaacgaccttgctgttacaacataaccagattaaggtattgacagaggaggtgttcatctacaccccgctcctgagttatctaaggctctacgataacccgtggcattgtacatgcgagattgagacattaattagcatgctgcagatccctcggaacaggaatctcgggaattatgcaaagtgtgagtcgccacaagagcagaagaacaagaaattacgacagatcaagtctgagcaactgtgcaatgaggaggagaaggaacagctcgacccaaaaccccaagtgagcggccgtcctccagtgataaagcccgaggtggactctaccttctgccacaattacgtattccctattcagacattagactgcaagcggaaggagctaaagaaggtccctaacaacattccaccagacattgtcaaactggacctcagttataacaaaattaaccaactcagacctaaagagtttgaagatgttcacgagctgaagaagttgaatctgagctcgaacggtattgagttcatcgacccaggttctttaagatag

SEQ ID NO: 5230 - DNA, 972 bp, Artificial Sequence
  Description of Artificial Sequence: Synthetic coding sequence
atgcaggctgcttggcttctgggcgcactcgtcgtaccacagctcttaggcttcggacatggcgctagaggggcggaacgcgagtgggagggcggatggggtggggcccaggaagaagagcgggagcgcgaagccttgatgctcaagcatctgcaggaagctttagggctgccagctgggcggggcgatgagaacccagccggaaccgtcgagggtaaagaagactgggaaatggaggaggatcaaggagaagaagaagaggaggaggcgacccccacacctagcagcgggccaagcccctccccaactcctgaggatattgtgacctacatcctgggacgcctggccggcttggacgccgggcttcaccagctgcatgttagactccatgcgctggacactcgtgttgtggaactgacacagggtttaaggcagttgaggaacgccgccggagacaccagagatgccgtgcaggcactgcaggaagctcaggggagggctgaaagagaacacggaagactcgaggggtgcctgaagggcctccggctggggcacaagtgtttcctgctcagccgagattttgaggcccaggctgcagcccaggccaggtgtacagccaggggggggtcactggcacagcctgctgacaggcagcagatggaggccctcacaagatacctccgagcagcgctcgccccctacaactggcctgtgtggctgggcgtccacgatagaagggcggaagggttgtatttgttcgagaatggtcaaagggtatccttcttcgcttggcatcggtcgccaaggcctgagctgggagctcagcctagcgcctctccacatccattgtccccagaccagcctaacggtggcacacttgagaattgtgtggctcaggcctcagatgatggtagttggtgggaccacgactgtcagaggagactgtactacgtttgtgagtttccattttag

SEQ ID NO: 5231 - DNA, 1086 bp, Artificial Sequence
  Description of Artificial Sequence: Synthetic coding sequence
atgaacgggctgagcctgtcggagctgtgttgtttattttgctgccccccatgtcctggaaggatagccgccaagttggcttttttgcccccagaggccacgtactcactggtccccgagcctgagccgggtccaggaggcgccggtgctgcacccctagggacccttagggcaagttctggcgctcctggcaggtggaagttgcacttgactgagagagccgacttccaatactcacagagagagctggacaccattgaggtgttcccgaccaagtctgcgcggggcaatcgggtctcttgcatgtacgtgcggtgcgtaccaggtgcacgccagggtcaccaagcccaagggggtcaccctcagttggcgtgggtcggacggctgggcgattccaataacccagctccgggaggctgtctgttgggcaagtcctgggggaccggtgcagccctcgcatgtgggtacattcatctgcttgctagatacactgtgttattttcccatggaaatgccgtcgacctgggccagatgagctccttctacattggcctgggctcgcgcctgcactgcaatatcttctcttacgactactccggatacggggcgtccagtggcagacctagtgagcgtaatctctacgccgatatcgacgctgcgtggcaagccctccgaaccaggtacgggataagcccggactcaattattctatacggacaaagtatcggtacagtgcctacagtggatttggcaagtcgatatgaatgtgcggccgtggttctccactccccactcacttctggaatgcgcgtagcatttcccgacacaaaaaaaacatactgttttgacgccttccctaacattgagaaggtgtcaaaaataaccagccccgtgctaatcattcacggaactgaagacgaagtaattgatttcagccacggactagcactgtatgagcggtgtccaaaggctgtggagcctctttgggtagaaggtgcagggcacaatgacattgaactgtacagccagtacctagaacgtctgaggagatttataagccaggagctgccctcacagcgggcctag

SEQ ID NO: 5232 - DNA, 1404 bp, Artificial Sequence
  Description of Artificial Sequence: Synthetic coding sequence
atgaggactgctccatcgctgaggcgctgcgtttgtctactgctggccgctatcctggatctcgcacgcgggtatcttaccgtgaatattgagcccctccctcccgtcgtggccggagatgcagtcactttgaagtgtaacttcaaaactgatggaaggatgcgcgagatagtctggtatcgagtgactgacggtggtaccatcaaacagaagatttttactttcgatgccatgttctcgacaaactattctcatatggagaattacaggaagcgggaggatctagtctaccagagtacagtccggctgcccgaagtgcggatcagcgacaacggcccttatgagtgtcatgtcgggatttatgaccgagcaaccagggagaaagtggttctggcctctggcaatatctttttgaacgtgatggccccccctactagcatcgaggttgtggcagccgacacacccgctccattctcgagataccaggcccaaaactttacacttgtgtgtattgtttcagggggcaaaccagcccccatggtgtacttcaagcgggacggagaacccattgatgcagttcctctgagtgaacctccagctgcatcttccggccccctccaggacagccgcccttttagatctctcctacaccgggatctcgacgacactaagatgcagaagtcgcttagcttgctggacgctgaaaacaggggcggaagaccatacaccgaacgcccttctaggggtctcactccagatcccaatatcctgctccaacccacaaccgagaatatacccgagaccgtggtgtctcgtgagtttccacgatgggttcactcagctgagcctacatattttctacgacatagccggaccccatcctcagacgggactgtggaagtacgggctctcctgacttggacactaaaccctcagatcgataacgaggccctgttctcctgcgaagttaagcacccagccttatccatgccgatgcaggctgaagtgacgttggtagcccctaagggtcccaaaatcgtgatgacccccagccgcgctagggtcggagatactgtgcggatactggtgcacggcttccagaatgaggtcttcccagaacctatgttcacctggacccgcgtgggatctcggctactggacggcagcgctgaatttgacggcaaggagctggtactggaacgcgtacctgccgagctcaatggtagtatgtatagatgcaccgcccagaaccccttaggatccaccgatactcacaccagactgattgtatttgaaaacccaaatatcccacgcggcactgaggattccaacgggtccatcggtcccaccggtgctaggcttacactggtcctagccctcacagtcattctggagctgacttag

SEQ ID NO: 5233 - DNA, 783 bp, Artificial Sequence
  Description of Artificial Sequence: Synthetic coding sequence
atggcacgccctggtatggaacgctggcgcgaccgcctggctttggtgaccggcgcgtctggaggcattggggccgcagtcgcccgtgctctagttcagcaaggcctaaaggtggtcgggtgcgctcggaccgttggaaacatcgaggaattggccgccgaatgcaaatccgccggctatccgggcactttgatcccctataggtgcgacctgagtaacgaagaagacatactgtctatgttctccgccattcgatcgcagcattctggagtcgatatctgcattaataacgccggcctcgctcggccagatacgctactcagtgggtcaacctctggctggaaagatatgttcaatgtgaatgtattagcactttcaatttgtacccgggaggcctaccagagcatgaaagaacggaacgtggacgatggacatatcatcaacatcaattcaatgtcgggccaccgggtactgcccctgagcgttacccacttctacagtgccaccaagtacgccgtcactgcccttactgaaggcctcaggcaagagcttcgggaggcccagacacatatcagggctacgtgcatttctcccggcgtagttgagacccagttcgctttcaaactgcacgataaagatccggaaaaggctgctgctacctacgagcaaatgaaatgtcttaaaccagaggacgtcgccgaggccgtcatctatgtgctgtcaactccagcacacatacagattggtgatatacaaatgagacctactgagcaggtaacctag

SEQ ID NO: 5234 - DNA, 1218 bp, Artificial Sequence
  Description of Artificial Sequence: Synthetic coding sequence
atgtctagccccgccctgactgcaggagctagcggcaaggtgatggacttcaataatggaacttatctggtgtccttcacattgttctgggaaggacaggtttctctgagccttctcctaattcacccttcagagggcgcttcagctctgtggagagcccggaaccagggatacgataaaatcattttcaagggaaagttcgtgaacgggacctcacatgtatttactgagtgtggcctgacgctaaatagcaatgctgaactgtgtgagtacctagacgaccgtgatcaggaggccttctattgcatgaagcctcaacacatgccctgtgaagccctcacgtacatgactacacgtaatcgggaggtgtcgtacttgactgataaggagaattctctcttccataggtctaaggttggggttgagatgatgaaggacagaaagcatattgatgttactaattgcaataaacgcgaaaagatcgaagagacatgtcaggtcggaatgaagcccccagtacctggggggtatacactccagggcaaatggataacaaccttttgcaatcaggtccagctcgacactattaagatcaatggctgtctcaaaggcaaactgatttatctcctcggcgactctacccttagacagtggatttactacttcccgaaagttgttaagactctgaaattttttgatttgcatgagacaggtatctttaagaagcacctgctgctggacgctgagagacatacacagatccagtggaaaaaacactcttaccctttcgtaaccttccagttgtatagtcttattgaccatgattacattcctagggagatagaccgactgagcggcgacaaaaacacagcaatagtgataacgttcgggcagcattttcgaccattcccaatagatatcttcattcgccgcgccattggcgtgcagaaagccattgaaagactattcttgagatcacccgccacaaaagtaattattaaaaccgaaaacatcagagagatgcatatcgagacggagcggttcggcgactttcatgggtatattcactatctgataatgaaagacatcttcaaggacctgaatgtaggaatcattgacgcttgggatatgacaattgcctatggcactgacacaatccatcccccagatcatgtcattggcaatcaaatcaacatgtttctgaattacatctgttag

SEQ ID NO: 5235 - DNA, 597 bp, Artificial Sequence
  Description of Artificial Sequence: Synthetic coding sequence
atgcccgtgccagctctgtgtctactgtgggccctcgcaatggtaaccagaccggctagcgccgccccaatgggcggacccgagcttgcccagcacgaggaactaactctcttgttccacggcacactgcagttaggacaggcactgaatggagtgtatcgtactacagagggaaggttgactaaagctcggaactctctgggactttatggacggactattgaactgctgggccaagaggtcagcagagggagagatgctgctcaggagctgcgcgcatccctgctggagactcagatggaagaggatatcctgcagcttcaggcagaagcaacagccgaggtattgggcgaggtcgcccaggcacaaaaagtcttacgggactcagtgcagagactagaggttcaacttcgcagcgcatggctgggccctgcctatcgagagtttgaggtcttaaaagctcacgctgataagcagagccatatactgtgggcgctgacaggccacgtgcagagacagcgccgggagatggtggctcagcagcaccggctgaggcagatccaggagcgattacacaccgcagctctccctgcttag

SEQ ID NO: 5236 - DNA, 1455 bp, Artificial Sequence
  Description of Artificial Sequence: Synthetic coding sequence
atggcaggcccctggaccttcactctgctgtgcggtctcttagccgccacgctgattcaagcgactctcagccctaccgcggtattgatcctgggccctaaagtgatcaaggaaaagctaacacaggaacttaaagatcacaatgccacctctattctacagcagttgcctttactcagcgccatgcgcgaaaagcctgcgggaggaatcccggtgctgggaagtctcgtgaacacggtgcttaaacacattatctggctcaaggtgattacagccaatatcttacagctgcaggtgaaaccaagtgccaacgatcaggagctgcttgtgaagatccctctagacatggtcgcgggcttcaatacacctctggtgaagactattgtggagttccacatgacaacggaggcccaggctaccattcgtatggacacaagcgcctctgggcccacgcggctggttctttccgactgtgcgacatcccatggttcgctccgtattcagttactacacaagctgagcttcctggtaaatgccttagcaaagcaagttatgaacctgttggtaccaagcctccccaatctggtgaagaatcagctgtgccccgtcatcgaggccagttttaacggaatgtatgccgatttgctgcagctcgtcaaggtccctatcagcctttctatagaccgccttgaattcgatctcctataccccgcaatcaagggcgacactatccaattatacctcggagctaagttactagactcgcaagggaaggtgactaaatggttcaacaactccgccgcatccctgactatgcccaccctagataatattccctttagtttgatcgtgtcccaagatgttgtcaaggcggcagtggccgctgtactcagtccggaagaattcatggtcctcctggattcagtgttgcccgagagcgcccaccgccttaaaagctccatagggctgatcaacgagaaagccgctgacaagctggggagcacccagatcgttaaaatactgacacaggataccccagagttctttattgaccagggacacgcaaaggtagcccagctaattgtcctggaggtgttcccgagcagcgaggctctcaggcccctcttcacactcggaattgaagcctcttccgaggcgcagttctacacaaagggcgatcagctgatactgaatcttaataacatctcaagcgatcgtatccaactgatgaattctggtataggctggttccaacccgatgtgctcaagaacatcattacggaaatcatccacagtatcttgttgcctaaccagaatgggaagctgcgatccggtgttccagtgagccttgttaaagccttgggattcgaggcagcagaatcaagcctgacaaaagatgctctggttctgaccccagctagcctgtggaaaccgagctctccggtgtctcagtag

SEQ ID NO: 5237 - DNA, 750 bp, Artificial Sequence
  Description of Artificial Sequence: Synthetic coding sequence
atgctgcagctatggaaactggtcctgctctgtggcgttcttacaggcacaagcgaatccctacttgacaatctcggtaacgatctgtctaacgttgtggacaaactggaaccagttctccacgaaggcctcgaaacggttgataatactctgaaaggcattcttgaaaagctcaaagtcgatttaggggtcctccagaagagttctgcatggcagctcgctaaacaaaaagcgcaggaagcagagaagcttctcaataatgtgatttctaaactcttgccaacgaacacagatatctttggcctgaagatctccaatagcttgattctcgacgtgaaggccgaacctatcgatgacggcaaagggctgaacttgtcttttcctgtcactgcaaatgtaaccgtcgctggaccaattatcggacagatcatcaatcttaaggcatccctagatttgctaaccgcagttaccattgaaaccgatccccagactcatcagcccgtggctgtcctcggagagtgcgcctccgatcctacatctatctcattgtccttgctagacaagcacagccagattattaacaaattcgtcaattctgtgattaataccctgaaaagtactgtgtcctctctgctccagaaggaaatctgtccactgattcgcatcttcatccacagccttgatgttaatgtgatacagcaggtggtggataatccacagcacaagactcagttacagactcttatatag

SEQ ID NO: 5238 - DNA, 1959 bp, Artificial Sequence
  Description of Artificial Sequence: Synthetic coding sequence
atgcagggccccctccttctccccggattatgctttttacttagcctgtttggggcggtgactcagaagaccaaaacgagctgtgccaagtgccctcctaatgcaagttgtgtgaacaatacacactgcacctgcaatcatggctacactagcggttccgggcagaaactctttacctttcccctggagacatgtaacgatatcaacgaatgcactcctccatactccgtctattgtggttttaatgccgtgtgttataacgttgagggctccttttactgtcagtgcgtgcctggctacagacttcatagtggcaatgagcaattttccaacagcaacgaaaacacatgtcaggatacaactagtagcaagaccacagagggtcgcaaggaacttcagaagatcgttgataaattcgagtctttgttaacaaaccagaccctttggcgcaccgaaggacgacaggaaatcagctcaactgctacgacaatcttgcgagacgtggaaagtaaggtcctcgaaactgccctgaaggatccagaacagaaggttctaaaaatccagaatgacagcgtggctatcgagacccaggccataacagacaattgttctgaagagcggaagacctttaatctgaacgtccagatgaacagtatggatatcagatgcagcgacatcatacagggcgatactcaaggacccagtgctatcgctttcattagttacagcagtctgggcaatatcataaatgctaccttcttcgaggaaatggataagaaggatcaagtctaccttaactcccaagtagtgagtgcagcaatcggaccaaaacgcaacgtgtccctgagcaaatctgtgacgttgacgttccagcacgtaaagatgacccctagcacgaagaaagtgttttgcgtgtactggaaatctacagggcagggctcacaatggagcagagacgggtgcttcctgatccatgtgaacaagagccacaccatgtgtaactgtagccatctttcctcctttgctgttctgatggccctgacctctcaggaggaagatccagtgctgacagtcattacttatgtcgggctgtcagtatcactactctgtttactcctggccgccctgacgttcctgctgtgcaaggcaattcggaatacaagcacctcattacatttgcagttgagcctttgtctatttctcgcgcacctgctcttcctcgtggggatagaccggaccgagccaaaagtactctgcagcattatagccggtgcccttcattatctgtatctggccgccttcacctggatgcttctcgagggagtgcatctttttttaacagcacgcaacttaaccgtcgtgaactatagcagcattaaccgactgatgaagtggatcatgttccctgtcggatatggtgtccccgcagtgacagtagcaatctcggccgcctcctggccacacctgtacggtacggccgatcggtgctggctccatctagatcaggggtttatgtggtctttcctcgggccggtgtgtgccatcttttctgcgaatctggtcctctttatccttgtgttttggatcctgaaaagaaagctgtccagtttgaactcggaagttagcactatacaaaacacaaggatgctggcttttaaggccaccgcccaactgtttatactgggctgtacatggtgcctggggttattacaggttggcccagcagctcaggttatggcctatttgttcaccattatcaactccctccaaggatttttcatctttttggtctactgtctcctgagccagcaggtacaaaagcagtatcagaaatggttccgcgagatcgtgaagtctaagagcgaatcagagacatatacactatcatctaaaatgggcccagactctaaacccagtgaaggcgacgtgttcccagggcaggttaagcgtaagtactag

SEQ ID NO: 5239 - DNA, 1263 bp, Artificial Sequence
  Description of Artificial Sequence: Synthetic coding sequence
atgagtccaccccccctgctgcaacctcttctcctcctcctgcctctgctgaacgtcgagcccagcggtgccacactaatccgcatcccgttacatagggtgcagccaggcagacgtatattaaatcttcttaggggctggcgtgagccagcagaactgccaaagctgggagctcccagccctggggacaagccaatctttgtgcctctttcaaattacagggatgtgcagtacttcggagaaattggtctggggacaccacctcagaactttaccgtagctttcgacactggttcctcgaatctgtgggttccctctagacgttgtcacttttttagtgttccatgttggctgcatcacaggtttgatcccaaggccagctcctcttttcaagctaatgggaccaagttcgccatccagtatgggacaggacgtgttgacggtatcctcagtgaggacaaattaactatcggtggaatcaaaggcgcatctgtaattttcggcgaagccctctgggagccaagtttagttttcgctttcgcccacttcgatggcatcctggggctcggattccccatactgtccgtcgagggggtcaggccaccgatggatgtgctggtagagcagggtctgctggacaagcccgtattcagcttctatctcaacagggaccctgaggaacccgatggcggggagctggtcctgggcggctccgaccctgcgcactacattccccccctgacgtttgtacccgtgactgtgccagcgtactggcagattcacatggaaagggtgaaggtgggacccggcttgaccttgtgtgcgaagggctgtgccgccatactcgataccggcactagcctgattacgggtccaacagaggagatcagggccctacatgccgcaatcggtgggattcctttgctggcgggagagtatataatcctctgttctgaaattccaaaactgccagccgtctccttccttctcggaggcgtctggtttaaccttacggcccacgactatgtgattcagacaacgagaaatggggtacggctgtgtctgagtggcttccaagccctcgacgtcccgccacccgctggtccattttggattctcggggacgtgttcctgggcacttatgtggctgtgtttgaccggggtgacatgaagagttcggcgcgagtgggcctggcaagggccaggacccggggtgctgacttaggatggggcgagacagcacaggcacagtttcctggctag

SEQ ID NO: 5240 - DNA, 1293 bp, Artificial Sequence
  Description of Artificial Sequence: Synthetic coding sequence
atggcctggaccttcgagtgttctcgcacaacctcccccgaaccactatccacaagtccctgtcggaccacatcttctaggaactcccctacaatgtcctgccctgcaagtgtagcctgtgagccgtctacaagcaccactacctcctctccacccaaactttcagtggcacctcagtttttgccacggagccttcgcgtggctgacctggccgcgaaccaagtgatggaaatctttccactgacattcggagaaaaacccgctctgagatccgtgtatctgcataacaaccagctgagtaacgccgggctgcccccggacgccttccgagggtctgaggcaatcgctacactcagcttatcgaataaccagctgtcctatctgcccccttctttgcctccttccctggaaagattacacctacaaaacaaccttatcagcaaagttcccagaggagctttaagtcgccagacgcaactccgggaactctatttgcagcacaaccagctcactgattccggcctcgacgcaactactttctccaaacttcattccctagaatacttagatttgagccataaccaactgacgacggttccagcagggctccctcgaaccctggccatactgcacttgggccgcaatcgcattcgacaggttgaggctgctcggctccatggcgctagagggctccgttacctgctgcttcagcataaccagctgggctcttccgggcttccagcaggcgctctccggcccttaagagggctgcacactctgcacttgtatggaaacggcctcgatagagtccccccagccctgcctcgccggttacgagcactggtgcttccacataatcacgtggctgccctcggagccagagaccttgtggcaacccccggactgacggagcttaacctggcttataatagactggcctccgcaagggtacaccaccgggcttttaggcgattaagagccctgcgttcactcgatcttgcaggtaatcagctcacgaggctcccaatgggattaccaacggggctccggaccctgcaattacagcgcaatcaactaaggatgttggaaccggagcccctggcaggcttggaccaactgagagagctttctctagcacataacaggttacgggttggggacattggccccgggacctggcacgaattacaagctttgcaggtgcggcaccggttggtgagccacaccgtccctagggccccgccctccccatgtctgccctgccatgtccctaacatactcgtgagctggtag

SEQ ID NO: 5241 - DNA, 3162 bp, Artificial Sequence
  Description of Artificial Sequence: Synthetic coding sequence
atgtggcaacctcggcgcccctggccaagagttccctggcgttgggccctcgccctgctcgccctcgtgggagccgggctttgtcacgcaggcccacagcctggctaccccgcgcggccctccgctcgcaacaagaattggtgcgcctacatagttaacaaaaacgtctcttgctctgtgctcgaaggatccgaaagttttattcaggcccagtataattgcgcctggaaccagatgccatgtccatcagctttggtttaccgggttaacttcaggccacgctacgtgacaaggtataagaccgttacacagctggagtggagatgctgccccggcttcagaggtggcgattgtcaggagggcccaaaggaccctgtcaagacactgcggcccacaccagctcggccacgcaattcactgaagaaggccactgacaacgagccatcacagttttccgagccacggaaaactttgtcccctactggaactgcccagcccagctggggggtggatccaaaggagggtcctcaagagctgcaggagaaaaaaatccaggtcttggaggaaaaggtgctacgtcttactagaactgtactcgatctgcagagctcacttgcaggtgtatctgaaaacctaaaacacgcaacacaagatgatgcttccagaaccagggccccagggctgagctcacagcacccaaaacctgacacaacagtcagtggagacacggaaacaggccaatcccccggagtgttcaatacaaaggaaagcggaatgaaagatataaaatcggaactcgccgaggtcaaagacaccctgaaaaataagagcgacaagctggaagagcttgacggcaaggttaaaggctacgaaggccagctccggcagctgcaagaagcggcgcagggccctactgtgacaatgacaaccaacgagctgtaccaggcttacgttgattctaaaattgatgcccttcgtgaggaactgatggagggcatggatagaaagctggccgacctgaaaaacagctgcgagtataaactcactggactccaacagcagtgcgacgattatggctcatcgtaccttggcgttatcgagcttattggggagaaggagacttccctacgcaaggaaatcaacaatctgagggctcgcctgcaggagccgtccgcacaggcaaactgttgtgacagcgaaaagaatggcgatattggccagcaaattaaaaccctggaccagaagattgagagggtagcagaggcaacacggatgttaaatggccgtctggacaacgaattcgatcgtttgattgtgccagagccagacgtggacttcgacgccaagtggaatgaattagatgcccggatcaatgtaacagagaagaacgccgaagaacattgcttctacatagaggagaccttgcgcggcgccattaacggcgaagtgggcgatctcaagcagctggtcgaccagaaaatccagtccctcgaggacagattgggatcggtcttgctccaaatgaccaacaacactggggctgagttatcacccccaggggctgccgccctccctggagtgagtggctccggggacgagagagttatgatggagctgaaccacttgaaagataaagttcaggttgtcgaagatatctgtctattgaacatccagggcaaacctcacgggatggagggtgcactgcccaaccgggaagacagagctgttcgggattctttacacctgcttaagagtctgaacgacaccatgcaccgcaagttccaagagacagagcagacgattcagaaactgcagcaggacttttcctttctgtactcccaattgaatcacactgagaatgacgttactcacctgcagaaggagatgtccaattgtcgcgccggagagaacgctgggatgggtcgctttactaaagtaggggagcaggagaggacggtagacaccctcccatcgccacaacatcccgtggcccactgctgttcacagctggaagagcgctggcaacgactgcaatcacaggtcatctccgagcttgatgcctgcaaggagtgtacccagggcgtgcaaagggaggtgtctatggtggaaggccgagtctcacacatggaaaagacatgctctaagctagactctatcagtgggaacctacagcgtatcaaagaagggctcaataagcatgtctcttcactctggaactgcgtacggcaaatgaatgggactttgcggagccactctcgggatatttccgggctgaagaatagcgtgcagcagttttattctcatgtgttccaaattagcacagacctgcaggacctagtgaaattccagccaagcgcaaaggctccctctcctccgcctcccgccgaggctccaaaggagcctctccaacccgagcctgctccccctaggcccagtggaccggccacagcagaggatcccggcaggaggcccgtcctgccacagcggccacccgaagaacgacccccccaaccccctggaagcactggcgtaattgctgagaccgggcaggctggcccacctgccggcgccggtgtaagcggaagaggtctcccgcggggggtagatggtcagaccggatcaggaacagtgcccggcgccgaagggttcgctggggccccaggataccccaaaagtccccccgtggcgagccctggtgctccagtcccatcactcgtatctttctcagccggcctgacccagaaaccctttccaagcgatggcggcgttgtcctgtttaacaaggtcttagttaatgacggggacgtctataacccatccaccggagtatttaccgctccatacgatgggcgatatttgatcactgccactctgacccctgaaagagatgcatatgtggaagccgttctgtctgtatcaaacgcaagtgtggcgcagctacacactgcgggatatcggagggaattcctggagtatcacagaccaccgggcgccctccatacatgtggaggacccggagccttccaccttattgtccacctgaaagcgggtgatgctgtcaacgtggtcgttaccggcggaaaacttgcccacaccgacttcgacgaaatgtattccactttctccggggtattcctttaccctttccttagtcatctgtag

SEQ ID NO: 5242 - DNA, 1548 bp, Artificial Sequence
  Description of Artificial Sequence: Synthetic coding sequence
atggcccagttatttctgcctctactcgccgcgctggtccttgctcaggcaccagctgcacttgcagacgttctggagggggactcttctgaggatagagcctttcgagttaggatcgctggtgatgccccgctacagggcgttcttggaggagccctgaccataccctgtcacgtgcactatttgaggccccccccctctcgcagagctgtcttaggaagtccccgggtcaagtggacgttcctcagtagagggcgggaggccgaggtactagttgccaggggggtgagagtgaaagttaacgaagcgtacaggttccgcgtggcattacccgcctatcccgcatctctcacagacgtctccctggcactttctgagctgcgccctaacgatagcgggatttacagatgtgaagttcagcatggcatcgacgattcatccgacgctgtggaagacagtcaactataccctatccagactccaagggaagcttgttatggggacatggatggctttcccggagtgaggaactacggggtggtggatccggacgacctgtatgatgtgtattgctacgctgaggatcttaatggggagttgttcctcggagatccgcccgaaaaactgaccctggaggaggcccgtgcttactgtcaagagcgtggtgccgaaatcgctaccactgggcagctctacgccgcgtgggacggcggcctggaccactgctcacctgggtggctggcagacggatctgtaaggtaccctatagtgaccccaagccagcggtgcggcggcggcctgccaggggtgaaaaccctgtttctgtttccaaatcagaccggtttccccaataagcacagccgtttcaacgtttactgcttccgcgggtcaacctgcttactgccctcactgcgccccccaacgcaaccacctacacaggacggcttggaggccatagttaccgttacagaaaccctggaagagctccaactgccgcaagaagccacagaatccgaatcacggggggccatatactccatcccaatcatggaagacggaggagggggaagctccacacctgaagatcccgccgaggcacccagaacgctcttggaatttgagactcaatccatggtcccacccaccgggttcagtgaggaagaaggcaaggccttggaagaagaggagaagtacgaggacgaagaggagaaagaagaggaggaggaagaggaggaggtcgaggacgaagccctgtgggcatggccttcagagctctcctcacctggtcctgaggcctctctgcccaccgaaccagcagctcaggaagagagcctctcacaagcgccagcgagagcggtgcttcaacctggagccagccccctgcctgacggcgagtccgaggcttcacgtccaccccgcgtacacgggcctcccactgagaccctccctacgccaagggaacgaaacctcgccagtccttcaccctctacactcgtggaggcaagggaagtgggcgaagcgacgggcggtcctgaactttcaggatag

SEQ ID NO: 5243 - DNA, 1023 bp, Artificial Sequence
  Description of Artificial Sequence: Synthetic coding sequence
atgcccggatggctcaccttgccaaccctgtgtagattcctcctctgggctttcaccatctttcataaggcccagggcgaccccgcttcgcatcctggcccgcactatctgctgcctccgatccatgaggtgattcattcacacagaggagctaccgctaccctgccatgcgtccttggtaccaccccaccatcctacaaagtccggtggtcaaaggtggagcctggtgagcttcgggaaacactgatactgataacaaacggtctgcatgcacggggttacggtcctctcggagggcgcgcccgaatgcgtagaggccatagacttgacgcatccctggtgattgcgggagtgcgcctggaggacgaaggtcgttaccggtgcgaactgattaacggcattgaggacgagtccgtggctctgaccctgagcttagaaggagttgtgttcccctatcaaccaagtaggggcagataccaatttaactattatgaggcgaagcaggcctgtgaggaacaggacggacgcttggcgacttacagccagctctaccaggcctggaccgaaggcctggactggtgtaacgctggttggctgctggagggcagcgtcaggtacccagtgttgacagcccgggccccttgcggaggcagagggcgccccggcatcagatcctacggcccccgggatcggatgcgcgaccgatacgacgcattttgtttcacctccgccttggcgggacaggtgttttttgtccccgggcgactgacactgtccgaggcacacgctgcatgcagacggaggggcgctgtcgtggccaaagtagggcatttatacgctgcatggaagttctctgggctcgatcagtgcgacggtgggtggctcgcggacggttccgtgcgctttccaatcaccacgccccgcccccgatgtgggggattacctgaccccggcgtcagaagtttcggcttcccccggcctcaacaggccgcctacgggacatactgttacgccgagaactag

SEQ ID NO: 5244 - DNA, 690 bp, Artificial Sequence
  Description of Artificial Sequence: Synthetic coding sequence
atggacctcctccaattccttgcttttctgtttgtgctgttgctctcggggatgggggccaccggtacgctgagaaccagtctagacccctcactggagatttacaaaaagatgtttgaagtaaagagacgggagcagttacttgctctcaaaaatctggcccagctcaatgatatccaccaacaatataaaattcttgacgtcatgctgaaggggctctttaaggtgctagaagattcaaggacagtcctgacagcggccgacgtgttacccgatggaccttttccacaagatgagaagttgaaggatgctttctcacatgttgtggagaataccgctttcttcggtgatgtcgtgcttcgattcccacgtattgttcactactactttgaccacaattcgaattggaatctgttgatcagatggggaattagtttttgcaatcagaccggggtgttcaaccagggtcctcatagtcccatactgagcctcatggctcaggaactggggattagcgagaaggattcaaatttccagaatccctttaagattgaccgaacagagtttatccctagtaccgaccccttccagaaagccctgagggaagaggagaagaggcgtaaaaaagaggagaagcgaaaggagatacggaagggtccaagaatctctcggtctcagtccgagctgtag

SEQ ID NO: 5245 - DNA, 465 bp, Artificial Sequence
  Description of Artificial Sequence: Synthetic coding sequence
atgtccgtgggaaccagtttggagcaagctcagatgtcaactctgacatgccccctttttatccctacagtagggcgcaagactgcattgcacagcggtgaggacttccaaactcttcttttcgagcgcgtattcgtgaacctagatgggtgctttgacatggcaacaggccagttcgctgcaccactcagaggcatttatttttttagcctcaacgttcattcctggaactacaaggaaacctatgtgcatataatgcacaaccagaaggaggccgtcatcctctatgcacagccctctgaaaggagcataatgcagtcgcaatccgtcatgctggatttagcatacggagatcgtgtttgggtgaggcttttcaagagacaacgcgagaacgccatctacagtaacgattttgatacatatataacgttttccggccatctcatcaaagcagaagatgattag

SEQ ID NO: 5246 - DNA, 900 bp, Artificial Sequence
  Description of Artificial Sequence: Synthetic coding sequence
atgagaagtgtgggggaaggagcaagagaatggatccgcgagtgccagcatcagtttcggcatcatcgctggaactgcacaactttggatagggaccatacggtttttggtcgggtgatgctccggtcttctcgcgaagccgcctttgtgtacgccatttcatctgccggggtggtacacgccatcaccagggcttgctcacaaggggagctgtcggtgtgctcttgtgatccatacacacgaggccgacatcacgaccaaagaggcgattttgactggggtggatgctctgacaatatacactatggcgtccggtttgctaaggcttttgtcgacgccaaagagaagcgcctgaaggatgcgagagctctgatgaatctgcacaataacagatgcggtcgaaccgccgtccggcgcttcctaaagctggaatgcaaatgtcatggcgtgagtggcagctgcacgctgaggacctgttggcgtgccctgagcgattttaggaggacaggggactacctgcggagaaggtatgatggggcggttcaggttatggccacccaggacggtgccaactttacggccgccaggcagggataccggagggctacccgcacagacttggtttactttgataattcccccgattactgcgtgctagacaaagcagctggttccctagggactgcggggagagtctgctcaaaaaccagcaaaggtacagatggatgtgagatcatgtgttgtgggcggggatacgataccaccagagttaccagggtgactcaatgcgagtgtaaatttcactggtgttgcgccgtgcgctgcaaggagtgcaggaacacagtggacgtccatacctgtaaggctcctaagaaggccgaatggttagatcagacctag

SEQ ID NO: 5247 - DNA, 1710 bp, Artificial Sequence
  Description of Artificial Sequence: Synthetic coding sequence
atgctgcttctcttttcagtgattctgattagctgggtgagcaccgttggtggtgaaggcacgttgtgcgattttcccaagattcaccatggatttctctacgacgaagaggactacaacccattttcccaggtaccgaccggcgaggttttctattacagttgcgaatacaattttgtttctccatccaagtccttctggacaaggatcacgtgcaccgaggagggatggtcaccaacacccaagtgtttgcgcatgtgttctttcccttttgtcaagaacggtcatagcgaatctagcggactgatccacctcgagggggataccgtgcaaatcatttgcaataccgggtactccctccagaataacgagaaaaacattagctgcgttgagcgtgggtggagtaccccacctatttgttcattcaccaaaggagaatgccacgtacctatccttgaggcgaacgtcgatgcacagcccaagaaggagtcatacaaggtgggggacgtcctgaaattctcttgcaggaagaacttgattcgggttggtagcgattcagtacaatgctaccagttcggctggagtcccaacttccctacctgtaaaggacaggtacggtcctgcggcccccctccgcagctgtcaaatggagaggtgaaggagattaggaaggaagagtacgggcataacgaggtggtagagtatgattgtaaccccaacttcataatcaatggtcccaagaagattcaatgcgtcgatggggaatggacgacgcttcctacatgtgtggaacaggtcaaaacctgcggctatatccccgagttggagtatgggtatgtgcaaccctccgtccctccgtaccagcacggagtgagcgttgaggtgaattgcagaaatgaatatgccatgattgggaataatatgataacctgtatcaatgggatttggacggagctccccatgtgtgtggccacgcatcagctcaaaagatgcaaaattgcaggtgtcaatatcaagactttactgaaactgtctggaaaggagttcaaccataattccaggatcagataccggtgttccgacatttttcgctatcgccactcagtgtgcattaacggaaagtggaaccccgaagtggactgcacagagaaaagagaacagttctgtccaccccccccacagattcccaatgctcagaacatgacaactacagtgaattatcaagacggggagaaggtcgcagtgctgtgtaaagagaactacctgttacctgaagccaaggagatcgtttgcaaagatgggcgctggcagtcactccctcgctgtgtggaatccacagcttactgcggcccccctccttctattaataatggtgataccacctcgttcccactgtcggtctatcctccgggcagcactgtgacatataggtgccagtctttctataaactgcaggggtctgttactgtgacctgtcggaacaagcaatggtcagagcccccaaggtgcttagatccctgcgtcgtttccgaggagaatatgaataaaaataatattcaactgaagtggagaaacgacggcaagttgtacgctaaaacgggcgacgcggtagaattccagtgcaaatttccacataaagccatgatctccagtcctcctttccgagccatttgccaggaaggaaagttcgaatatccgatctgtgagtag

SEQ ID NO: 5248 - DNA, 351 bp, Artificial Sequence
  Description of Artificial Sequence: Synthetic coding sequence
atgaaaggtctgaggtccttagcagccaccacgttagccctctttctcgtgttcgtgtttcttggcaattcttcatgtgcaccccagcggcttctggaacgaaggaattggacgccacaggctatgctttacctgaaaggcgcacagggcagaagatttatctccgaccagagcaggcgcaaagatctgagcgaccggccattgcctgaaagacggtcacctaacccccaactgctgacgattccagaggcggccacaattttgctggcctctcttcagaaaagccctgaagacgaggaaaagaattttgaccagacccggtttctggaggacagtttactgaactggtag

SEQ ID NO: 5249 - DNA, 192 bp, Artificial Sequence
  Description of Artificial Sequence: Synthetic coding sequence
atgaagcatgtcctgaacctgtacttactgggggttgtgctcaccctcctctcaatcttcgttagggtaatggaatcgctggagggcctcctggaatctccatcacctggtacttcttggaccacacgcagtcaacttgctaatactgagcccactaaggggctgccagaccacccgagccgaagtatgtag

SEQ ID NO: 5250 - DNA, 567 bp, Artificial Sequence
  Description of Artificial Sequence: Synthetic coding sequence
atggtccccggcgctgccgggtggtgttgtttagttctttggctgcctgcctgtgttgccgcacacggtttccggattcacgactacctttattttcaggtcctgtcccctggcgatatccggtacatctttacagcaaccccagccaaagacttcggcggaatcttccacactaggtacgagcagatccatcttgtaccggcggaaccacccgaggcctgcggtgagctgagcaacggatttttcatccaggaccagatcgctttggtcgagaggggcggctgcagctttctgagcaagactcgggtggtgcaggaacacggggggcgcgccgtgataatctcggacaacgctgtggataacgacagcttttacgtagagatgatacaggacagcactcaacgcaccgctgatatccctgcactgttcttattgggcagagacggttatatgattcgacggagcctcgagcagcacggccttccctgggccattatttccattcctgtgaacgtaactagcattccaactttcgaactgctccagccgccatggacattttggtag

SEQ ID NO: 5251 - DNA, 2559 bp, Artificial Sequence
  Description of Artificial Sequence: Synthetic coding sequence
atgaaaccaatgttaaaggatttttccaatctactgctggtggtactatgtgactatgtcctcggcgaagccgaatatctgcttctgcgtgaaccaggccatgtggctctctcaaacgatactgtatacgtggactttcagtacttcgacggtgccaacggcaccctgaggaatgtgtccgttctcctgttggaagctaataccaaccagaccgtcactacaaagtacctgttgacaaatcagagccaagggactttaaagtttgaatgtttctactttaaagaggcaggggattactggttcacaatgacacctgaggccacagacaactcaacgcccttcccctggtgggagaaatcagctttcctaaaggtggagtggcctgtattccatgtggatctgaacagaagtgctaaagctgcagagggtaccttccaggtgggactgttcacatctcagccattatgcccgtttccagttgacaaaccaaacattgtcgtggacgtcatatttaccaactcactgcccgaagcacggcgtaacagcaggcaaccactggagatccggactagtaaacggactgagctggcacagggccagtgggtggaatttggctgtgcaccactgggcccagaggcttacgtgactgtcgtgttgaagctgctgggacgagactcagtgattacttccacaggccctatcgatctggcacagaagtttggctataaattggtcatggtgcctgaactgacttgcgagtccggtgtcgaggttactgtactgccacccccatgcacgttcgtgcagggagtggtgacagttttcaaagaagccccaagatacccgggaaagcggacaattcacttggccgaaaactctttgcccctgggggagcgacgcactatttttaattgcacattatttgacatgggcaaaaataagtattgctttgatttcggaatctcttctcggtcacatttttctgccaaggaggagtgcatgctgatccagagaaacaccgaaacctggggcctatggcagccatggtcccagtgttctgcgacatgcggcgatggcgtgagggagcggcgaagagtttgtcttacttcattcccgtcctcccctgtttgccctgggatgtctcttgaagcatcgctgtgttccctagaagagtgcgccgccttccagccatcatcacccagccctctccagccacagggtcctgtgaaaagtaacaatattgtaacggtgactgggatcagcttgtgccttttcattattatagcgactgtcctgataacactgtggcggaggtttggcagaccagccaagtgcagtacccccgcaagacataattccatacactcgccctccttccgaaagaatagcgacgaggagaacatctgcgagttgagcgaacagaggggctctttcagtgatgggggagatgggcctacagggtccccaggcgataccggaatccccctcacatatcgaaggtccgggccagtgccgccggaagatgacgcatcgggctctgaaagtttccaaagcaacgcgcagaagatcatacctcctctcttcagttacaggctggctcagcagcaactcaaggagatgaagaaaaaaggtctcacagagaccacaaaagtctaccacgtttctcagtcgccactgacagatactgctatagacgccgctcctagcgcccccctcgacctggagtcccctgaagaggcagccgcaaacaagttcagaattaaatcacctttccccgagcagcctgctgtgagcgctggagagcggcccccttcacgcctcgacctgaatgtcacccaagccagctgcgccatttcgccctcacagaccttaatccgaaagtctcaggccagacacgtgggatcccgcggaggcccatctgagagatcgcacgcccggaacgcacacttccgtaggactgcctcctttcatgaggctcggcaggcccggcctttccgggaacggtccatgagtaccctgactcccagacaggctcctgcctactcatctcgaactcggacctgtgaacaagcggaagatcggtttcgaccccagtccaggggtgcacacctgttccccgaaaaactcgaacatttccaagaggcctccggtacccggggaccattgaaccccctcccaaaatcatacactctcgggcaacccctgcggaagcccgacctaggggatcaccaggcaggcttagttgcgggcattgagcgaactgagccccatcgcgccaggcgcggcccaagcccaagtcataaaagcgtttctcggaaacagtcatcaccaatcagcccaaaagacaattatcagcgcgtatcatcactgtctccttcacaatgtagaaaggataaatgtcaatcttttcccacgcaccccgagttcgcattctatgacaacactagctttgggctgacagaggctgaacagaggatgttggacctgccgggctactttggatccaatgaagaggatgagaccacatccactctttctgttgagaagctggtaatctag

SEQ ID NO: 5252 - DNA, 369 bp, Artificial Sequence
  Description of Artificial Sequence: Synthetic coding sequence
atgggatttcacttttgtatctggattatattcctgctcccacccccgtgcaagaaatgcctgtctcccccaactatgaatctcaggccacccaaatcttgcggaaacgtgttctattgggtgctcgtgctgaatagcggactgctgtacaagttctgccagacaatcaagtgcagggcaaattggaggccggctcgagcgccacgagggtggaacgaggcaacagagcgccaccaggagcgaagaacacagatggaaaccgaaatgggggggatttctaccacttactggcaccgcctgtgtacatgtactgatcgacgggcggaaaaattagtgatggatgggaacaactgttggtttcataaatag

SEQ ID NO: 5253 - DNA, 978 bp, Artificial Sequence
  Description of Artificial Sequence: Synthetic coding sequence
atgcagggtcgcgtcgccggcagctgtgctcctctagggctgcttttagtgtgtctacacctaccaggtctgtttgcccgcagtatcggagtcgtcgaagagaaggtgtcgcagaatcttggcacaaaccttccacagttaggtcagcccagcagcaccggcccaagcaatagcgaacacccgcaacctgcactggacccacgaagtaacgatttggcgagagtgcccctgaaactttccgtgcctgcttccgacggctttccccctgcaggtggttctgccgtgcagcggtggcctccatcttggggcctgccagctatggattcatggcctccagaggatccctggcagatgatggccgctgctgctgaagaccgcttgggcgaggctctaccagaagagttgtcctatctgtcctcagccgccgcactcgcccctggctctgggcccctgcctggcgagagcagccctgatgcaacaggcctttcaccaaaagcaagtcttctgcatcaggacagcgaatcacggcgcttgccaaggtccaatagcttaggtgcgggtggcaagattttgagtcaacgccctccttggtcattaattcaccgagtcttgcccgaccatccctggggcaccttgaatcccagtgtttcatggggagggggaggccctggcacgggatggggaacacgtcctatgcctcacccggaagggatctggggaatcaacaaccaaccacccggcacatcttggggaaatatcaatcggtatcccggcggctcttggggaaacattaaccgttaccctggaggctcttggggcaatataaatcggtatcctggtggttcctggggtaacatccacctataccctggaattaataacccgtttccacccggcgttcttcgacctcccggatcctcgtggaatatacccgctgggttccccaaccctccaagtccccggctgcagtggggatag

SEQ ID NO: 5254 - DNA, 2631 bp, Artificial Sequence
  Description of Artificial Sequence: Synthetic coding sequence
atgggacctgaggcgctctcctctctgcttcttctgctgttggttgcttccggcgatgcagatatgaagggccacttcgacccagctaagtgtaggtatgccttaggaatgcaggaccgtacaatcccggattccgacatttcagccagctccagctggagtgatagtacagctgcacgacactctagactagaatcctccgatggggatggggcgtggtgcccagccggcagtgtgttccctaaagaagaagaatacctgcaggtcgatcttcagcgacttcatctggtcgcacttgtgggaacacaggggaggcacgctggcggactggggaaagagttctccagatcatataggctgcgttatagcagggacgggagacggtggatgggttggaaggaccgatggggccaggaggtgatcagcgggaacgaggatcctgaaggagtagtgcttaaggatctgggccctccgatggtggccagactggttagattttatccacgtgccgacagggtgatgtcagtttgtctcagagtggagctgtatggatgtttatggagggatggcctactgagctatacagctcctgtgggccagaccatgtatctatctgaagccgtttatctgaacgacagcacttatgatggtcacacagtagggggcctacagtacggtggcttaggacagttggctgatggtgtggtgggcctcgatgacttcaggaagtcccaggagctgagggtgtggccgggatacgattatgtggggtggagtaatcacagtttctcttcaggctatgtggagatggagtttgagtttgatcggcttcgcgcctttcaggccatgcaggttcactgtaacaacatgcatactctcggcgccagattacccggaggcgtcgaatgccgatttagaaggggacctgccatggcttgggagggagaacctatgaggcacaatttggggggcaacctgggagacccaagagccagagccgtcagcgtgccactaggtggacgagtcgcaagatttctgcagtgtcggttccttttcgccgggccttggttattgttctccgagatatcttttatatctgatgtcgtaaacaactcatccccagccctgggcggcaccttcccccccgccccatggtggccacctggtccacctcccaccaactttagcagtttagagctcgaaccgcgggggcaacagccagtggccaaggcggaggggagccccacagccatcttgatcggatgccttgtggcgatcatactgctcctccttcttatcattgctttgatgctgtggcgcctccattggcgccggttgctgagtaaagccgaaagacgcgtgctggaggaagaactcaccgtgcacctgtccgtccccggagacacgatactgattaacaatagaccagggcctcgcgaaccgcccccatatcaggaaccccgcccccggggtaatcctccccattctgcaccgtgtgtgcctaatggctctgcttactccggagactacatggaacccgagaaacccggtgccccgttactgccaccccccccacaaaactcagtgcctcattatgccgaggcagatattgtgactttacaaggcgtcacaggcggcaatacctacgcggtccctgcccttcctcccggcgccgtgggagatggaccccccagggttgacttccccaggtcaagactcaggttcaaagaaaagctgggagagggccagtttggcgaggtgcacttgtgtgaggtagacagtccccaggacctggttagtctcgatttccccctgaacgttcgaaagggccatcctttgctggtggctgtaaagatccttcggccggacgcaacgaaaaacgcccggaacgatttcctgaaagaggtgaaaataatgagtcgcttaaaggatcccaacattatccgcctgctgggcgtctgcgtgcaggatgaccccttatgcatgataactgattacatggaaaacggggatctcaatcagtttctctctgcccatcagcttgaggataaggccgcagagggagccccaggcgatggacaggctgcacaaggaccgactattagctacccaatgttgttgcatgtagcggcgcaaatcgcctctggaatgaggtatctggccacactgaactttgtacatcgcgatttagccacaagaaactgcctagtcggggaaaatttcacaattaagattgcagattttgggatgagtcggaatttatacgccggagactattatcgagtacaaggccgcgcagtgctccctatccgctggatggcctgggagtgtattcttatgggcaaattcactaccgcctccgatgtctgggcgttcggtgtgacgctctgggaggtgctcatgttgtgcagggcacaaccatttggacagctaactgatgagcaggtcatcgaaaatgccggtgaattctttagggaccaaggaagacaggtgtacctgtctcgccctccagcatgcccccaaggactgtacgagctgatgctaagatgttggagtcgggagtccgaacagaggccaccattctcacagttacaccggttcctcgccgaggatgctctgaacacagtgtag

SEQ ID NO: 5255 - DNA, 672 bp, Artificial Sequence
  Description of Artificial Sequence: Synthetic coding sequence
atgaagtttgtcccatgcctgttactggtcactctgtcttgcttgggaacacttgggcaggcaccccggcagaagcagggcagtactggcgaggagttccacttccagaccggcggccgggatagttgtacaatgcggccgtcatcgctgggacagggcgccggggaggtgtggttgagggtggattgccggaacacagaccagacatattggtgcgaatatagggggcaaccctcgatgtgccaggcctttgctgctgacccaaagccttactggaatcaggccctgcaggaactccgacgtttacaccacgcatgccaaggggccccagtcctgaggccttcagtgtgtagggaggctggcccacaggcccatatgcagcaggttactagtagtctgaaaggctctccagagccaaaccagcagcccgaggccggcacccccagtctgcgcccaaaggctactgtcaagttaaccgaagcaacacagctcggtaaggatagcatggaggagctaggaaaggccaaaccaactacgcggccgaccgccaagcctacacaacccggcccccggcccggtggcaacgaggaggcgaagaagaaggcctgggaacactgttggaagccattccaggctctgtgcgcctttctcatctcttttttccgcgggtag

SEQ ID NO: 5256 - DNA, 585 bp, Artificial Sequence
  Description of Artificial Sequence: Synthetic coding sequence
atgacgatgcgacacaattggacaccagatctctctccactctgggtgttactactctgcgcccacgtggtgacccttcttgtgagggccacccccgtttcacagacaactaccgccgctactgcgtccgtgcggagtaccaaagacccctgccctagtcagcctcccgttttcccggcagcaaagcagtgcccagcactggaagtgacctggccagaagtcgaagtgcccctgaatgggactctgtccctcagttgcgtggcttgttcccggtttcccaatttcagcatcttgtactggcttggtaacggatcatttatcgagcatcttccaggacggttgtgggaaggatcaacaagccgagaacgtggctcaaccgggacccaactgtgtaaggctttggtgctggagcagcttactccagctttgcactctacaaacttctcttgcgtactggttgatccagagcaagtcgttcagagacacgttgtgctggcgcagttatgggcagggctcagagcaactctgccccccactcaggaggccctcccctcttcccactcgtcacctcagcagcagggttag

SEQ ID NO: 5257 - DNA, 777 bp, Artificial Sequence
  Description of Artificial Sequence: Synthetic coding sequence
atgattgccatctccgctgtaagtagcgccttgctgttttctcttctctgcgaagcttccaccgtggtgctcctgaattccacagattctagcccccccacaaataatttcaccgacatagaagccgccctgaaggcacagctcgattccgccgatatcccgaaagctcgtaggaaacgatatatatcccagaacgatatgattgcaattttagactatcacaaccaggtgcggggcaaggtgttccctccagcggcgaacatggaatacatggtgtgggatgaaaacctggccaagagcgctgaggcttgggcagccacatgtatatgggaccacggacctagctacctgctgagattcctcggccagaatctcagtgtaagaacaggcaggtaccgcagtattttacaacttgttaagccatggtatgatgaagtgaaggactacgcttttccttaccctcaagattgcaaccccagatgccccatgcggtgcttcggcccgatgtgtactcattatacacagatggtgtgggcaacctctaatcggatcggctgcgctatccacacttgtcaaaatatgaatgtgtggggatctgtatggcgtcgtgctgtttatttagtttgtaattatgctcctaagggcaactggattggcgaagcaccctataaggttggagtcccatgcagtagctgtcccccttcctacggagggtcatgtactgataatctttgctttccgggagtgacatcaaactacttgtactggttcaagtag

SEQ ID NO: 5258 - DNA, 906 bp, Artificial Sequence
  Description of Artificial Sequence: Synthetic coding sequence
atgctgcccttgacgatgaccgtactgatactgttactgttgccgactgggcaagcagcaccgaaagacggcgtgacacggccagactctgaggtgcaacatcagctgcttccgaaccctttccagcccggccaggaacagttgggactgttgcaaagctatctcaaggggttgggccgaacagaggtccaactggaacacctctccagagagcaggtccttctctacctattcgccctgcacgactacgatcagagtggccaattggatggcttggaactcttatcaatgctgacagccgccctggctcctggagctgcaaacagtcctacaacaaatcctgtaattcttattgttgacaaggtgttagaaacccaggacctaaatggagatggtcttatgaccccagctgaattgatcaatttcccaggggtcgccctgcggcacgttgagcccggagagcccttggctccctcaccccaggagccccaggccgtgggccgccagagtctcttagccaagagcccactccgccaagagacacaagaggctcctgggcctagagaggaagccaaaggacaggttgaggccagaagagagtctttagatcccgtgcaggaaccaggtgggcaagctgaagcggatggtgacgtaccaggtccccggggtgaagctgaggggcaagccgaggccaaaggtgacgcaccggggccaagaggggaagccggaggccaggctgaagcagaaggagatgctcctggcccacggggggaggctggcgggcaggccgaagcacgagagaatggcgaggaggccaaggaactccccggcgagactctcgagagtaagaacactcagaatgattttgaggtgcatatcgtacaagtggagaatgatgaaatttag

SEQ ID NO: 5259 - DNA, 969 bp, Artificial Sequence
  Description of Artificial Sequence: Synthetic coding sequence
atgaaaacactggctggattagtcctgggactcgtcatctttgatgccgcagttacagcacccactctggagtctattaactatgactcagagacttacgatgcgacccttgaggacctggacaacttgtacaactacgagaatattcccgttgataaagtagaaatcgagatcgccaccgtgatgcccagtggtaatcgagaactgctcacacctccgccgcagcccgagaaagcgcaggaagaggaggaggaagaggaatccaccccacggctgattgatggctctagtcctcaggagcctgagtttacaggggttctggggccacacaccaatgaggatttccccacttgcctactatgcacctgcatcagcactacagtgtattgtgacgaccacgaactggacgccattcctcccttacccaaaaataccgcttatttttactcacgatttaacagaatcaagaagattaataaaaatgacttcgcctcattgagcgatctgaaaagaatagacctaacctccaatttgatttccgagattgacgaggacgcattcaggaaacttccacagctgcgcgagctggttctgagggataataaaatacgacagctgccagagcttcccaccacattgacattcatcgatatcagtaacaatcgcctgggacgaaagggcatcaagcaggaggcattcaaagatatgtacgacttgcatcacctttacctgacagacaacaatctcgatcacatccccttgcctcttcctgagaatctccgggccctgcacctacagaataataacatcctggagatgcatgaggacactttctgcaacgtgaaaaacctgacttacatcagaaaggccctggaggatatccgtctggatggcaacccgatcaatctttcgaagacacctcaggcttacatgtgtttgcctcggttacctgtgggaagcctggtgtag

SEQ ID NO: 5260 - DNA, 618 bp, Artificial Sequence
  Description of Artificial Sequence: Synthetic coding sequence
atggtgaacctggctgccatggtctggcgacgcttgttacggaagagatgggtgctggcccttgtcttcggtctgagtctggtttattttctgtccagcacttttaaacaggaggagagagcggtgagggacaggaatctcttgcaagtgcacgaccacaaccagcctatcccctggaaggtgcaatttaatctggggaatagctcccggcccagtaaccagtgccggaatagtattcagggaaagcatttgattactgacgaactgggatacgtgtgcgagagaaaggacctactagtcaacggatgttgtaacgttaacgtgcccagcacaaaacagtactgctgcgatgggtgctggcccaacgggtgctgttctgcctatgaatattgcgtcagctgttgtctgcagccgaacaagcaacttctactggagaggtttctgaatcgggcggctgtggcattccagaacctgtttatggccgtcgaggaccatttcgagctgtgcttagccaagtgcaggacaagttctcagtccgtgcagcacgagaacacataccgagatcccatcgccaaatattgttacggcgaatccccccctgaacttttcccagcttag

SEQ ID NO: 5261 - DNA, 3057 bp, Artificial Sequence
  Description of Artificial Sequence: Synthetic coding sequence
atggtttcccactttatgggctcgctgagtgttctgtgctttctgctgctgctgggatttcaattcgtttgcccacagccatccacacagcatagaaaagttccacagaggatggcagcggagggcgcccctgaggatgacgggggcgggggggcgcctggggtgtggggtgcatggggcccctggtccgcttgctccaggtcatgtagcgggggtgtgatggagcagacccggccctgtctgcctaggagctatcgcctgaggggcgggcagcgaccaggcgctcctgcgagggccttcgctgaccacgttgtgtcagccgtcaggacctccgtgccgctccataggtcccgagacgagacacccgccttggctggaaccgacgcctctagacagggccccactgttctgcgtggctcccggcacccccagccgcaggggcttgaggtcaccggtgatagacgaagtaggacccgagggacaatcggtccagggaagtatggatatggcaaagcaccttacattctcccattgcaaacagataccgctcatacgccacagcgcttgaggcggcagaagctgtcatcacggcacagtagaagtcagggcgcgtcctcggcgagacacgggtactcctcccccgctcatcaagtgccccagcacggccctctttaccagtccgacagcggccctcggtctggtctgcaggcagcggaagcgccgatctatcagctgcctcttactcatgaccagggctatcctgccgcctcaagcctctttcactcccctgagaccagcaacaatcatggcgtagggacccacggtgccactcaatctttctctcagcccgccagatcaactgcgatttcttgcatcggcgcctataggcagtataaactgtgcaacactaacgtatgtccagagtcttctcgttccatcagagaggtacagtgcgcaagctataacaataagcctttcatgggtaggttctatgaatgggaaccttttgctgaggtgaaaggaaaccggaagtgcgagcttaattgtcaggccatggggtacaggttctacgttaggcaggccgagaaggtcattgacggcactccctgtgatcagaacggcaccgcaatttgcgtctcaggacagtgtaaatctatagggtgcgacgactacctgggatcagacaaggtggtagacaaatgcggcgtctgcgggggcgacaacaccggctgccaagttgtgtcgggggtcttcaaacatgcattgaccagcctggggtatcatcgcgttgtcgaaatccctgagggagccacaaagatcaacatcaccgaaatgtacaagagtaataactacctggcgctccggagcagatccggcagatcaatcatcaatgggaattgggcaatcgacaggcctgggaaatacgagggcggcggtaccatgttcacctacaagcgaccaaatgagattagttccacggcaggtgagagcttcctggctgaggggcctaccaatgaaattttggacgtttatatgatccaccagcaaccaaaccctggcgtacactacgagtacgtgatcatgggaactaatgccatttccccccaggtgccgccgcaccggagaccaggagaaccatttaatggacagatggtgaccgagggtcgcagtcaggaggaaggcgaacaaaaaggacgcaacgaggagaaagaggatttgcgcggcgaggccccagagatgtttacgagtgagtcggctcagacctttcccgtgcgacatcccgataggttcagccctcaccggcctgacaatctcgtgccaccagcacctcagccacctcggagatcccgtgatcataactggaaacagctcggaacaactgagtgttcaacgacatgcggcaaggggtcccaataccccattttccgctgcgtccatcgcagcacccatgaggaggcccctgagtcgtactgtgattcatccatgaagccaacaccagaggaagagccatgtaacatctttccgtgccctgcattctgggacatcggggagtggagcgaatgctctaaaacctgcgggttgggaatgcaacaccgccaggtactctgccggcaggtttatgccaatcgctctttaacagtccaaccttatcggtgccagcatctcgaaaagccggaaactactagtacttgtcagttaaagatctgtagtgagtggcagattcgcaccgattggacaagttgctcagtgccatgcggggttggccagcggacccgagacgttaaatgtgtgagtaatataggagacgtcgtggatgacgaggagtgcaatatgaagctgcggcctaatgacattgagaattgtgatatgggaccatgcgccaagagctggttcctcactgagtggtcagagcgttgttctgctgaatgcggagccggagtccgaacgaggagcgtggtttgcatgaccaaccatgtgtcgagcctcccactggaaggctgtgggaataacaggccagcggaggccactccttgcgacaacggcccatgtaccgggaaagtggagtggtttgccgggagttggagccagtgtagcatcgagtgcgggagcggaacacagcaaagagaagtgatctgtgtccgcaaaaatgccgataccttcgaggtgcttgacccatccgagtgcagcttcttagaaaaacccccttctcagcagtcatgtcatctaaaaccatgcggtgccaaatggttttccaccgagtggtctatgtgcagtaaaagctgtcagggaggatttcgagtaagggaggtgcgttgtttatcagatgatatgaccctgagtaacttatgtgatccacagcttaaacctgaggagcgcgagagctgtaatcctcaggattgcgtccccgaggtggacgaaaattgcaaagacaagtattataactgcaatgtggtcgtgcaagctaggttgtgtgtctacaattactacaagaccgcttgctgcgccagctgtacccgggttgccaatcgacagacagggttccttgggtcacggtag

SEQ ID NO: 5262 - DNA, 1503 bp, Artificial Sequence
  Description of Artificial Sequence: Synthetic coding sequence
atgaaatgcacagcacgagagtggctccgtgtaaccacggtgttattcatggcccgtgcgattcctgcaatggtcgtgcctaatgccaccctcctagagaagcttctggagaagtacatggatgaagacggtgaatggtggattgccaagcagagggggaaacgcgccattacagacaatgatatgcagtccatcctcgacctgcacaataagctgcgatcacaggtgtaccccacagcctccaatatggagtacatgacctgggacgtggaattggagcggtccgctgaaagttgggctgagtcttgcctgtgggagcacggtcccgcatcattgttaccctctatcggccagaacctgggggcccactggggacggtacaggccgcctaccttccacgtgcagtcatggtatgatgaagtgaaggacttctcttacccgtacgagcacgagtgcaatccttactgccccttccgctgtagcgggcctgtctgcacacattacacgcaggttgtgtgggctacatccaacagaatcgggtgtgctatcaatctctgtcacaatatgaacatctgggggcaaatttggccaaaagctgtctatctggtatgcaactatagccccaaaggcaactggtgggggcacgcgccgtataaacacggtagaccttgcagtgcttgtccaccttctttcggcggcggttgccgcgagaatctttgctataaagaggggtcggaccgttactacccaccacgtgaagaagagactaatgaaatcgagcggcagcagtcacaggtgcatgatacccacgtcagaaccagatcagatgattcttcgcggaatgaagtgattagtgcacaacagatgtcccagatcgtgtcgtgcgaagttagactgagagatcagtgcaaggggacaacttgtaaccggtatgagtgtcccgcaggctgtctcgattcgaaagccaaggtcatcggatctgttcattatgagatgcagtcctccatttgcagggctgctatccattacggaataattgataatgacggcggatgggtcgacatcaccagacagggccggaagcattacttcatcaaaagtaatcggaacggaatccagacgatcgggaagtaccagagtgctaactcattcactgtaagtaaggttactgtacaggccgttacatgtgaaaccaccgtggaacagctgtgccccttccataagcctgcttctcactgtcctagggtgtattgtccaagaaactgtatgcaagcgaatcctcattatgctcgcgtaattggaacccgcgtgtatagcgacctgagcagtatctgccgggccgcggttcacgcaggggtggtgagaaaccacggggggtatgtcgacgttatgcccgttgacaaacggaagacatacatcgccagcttccagaacggcatttttagtgaatccctacagaaccctcccggcgggaaggcttttagggtttttgcagtagtgtag

SEQ ID NO: 5263 - DNA, 2070 bp, Artificial Sequence
  Description of Artificial Sequence: Synthetic coding sequence
atgaagttcggggcggtgaccagaatcggaggccctccattagggaatcagagcccatcatcttgcagcctgcttcatgagaaagaccccccgaccacaagcggaccacagaccgaccaacctaaaaagcatcttaccaattttaagtctgccactcgtagagttgctcgaacacaatggctgacagccgatcgccagacatgggcgtctatctcgtctgtcccttgggctcagacgatcagcgaaaagaaacctggcggaagcctgtgggagacccgatcatctccacctacaacagccgggactgaagaggctatgaatacaactagcctacttgctcccgctgcggaaataatggccacaccggggtccccaagccaggcctctcctacactcggtgcctttacccacgggacccaaaccccaagccccactaaggccacagctccaaggtaccctcaaacaggcgatctctctgccgagtggcctttcaccgctggcgaagagccagtgctcgtgccacgccctcaccaggtctcacgggtcaggagctcttgttgcctaagccccattctgtgctccccagccatgatagctttcctactaacctctgtattgatgataccacatgctggcgggcatccactggatactccccacctcccccaggagctgccacctggactgcccaacaatatcaacattacctttttttcagggatgttcaagaatgtcgaatctgtggcagaaatcttcgactgtctcggcccacatttcacctggctgcaggccgtgtttacaaatttcccagtgctgatacagttcgttaacggaatgaaatgtgtggccgggctttgtccacgggatttcgaggactatggctgtacatgccgatttgagatggagggactcccagtggacgagagcgactcatgttgtttccagcacaggcggtgctacgaagaggctgccgagatggactgcctccaagatcccgccaagctgagcacagaagtaaattgtgtatctaaaaaaatcatatgcgagtcaaaagacaattgtgaacacctcctctgcacttgtgataaagcagctatcgagtgtctggcacggagtagcttaaatagcagcctgaatttgttggacacgtccttttgtctggctcagacccccgaaactacaatcaaggaagacctgacaactctgttaccccgcgtcgtacccgtggagcccactgacacatccttgaccgctctgtcaggggaagtggccgctgagacggaggccgataggcttattactctgtcaaagaagaaagcaggccatgaccaagagggcgtgggggcagccagagccacatccccccctggctcagccgaaatcgtggcaaccagggtgactgccaagatagtcacattggtgccggccggaatcaagtccctgggactggccgtgagctccgtggaaaacgaccccgaggaaacgactgagaaggcctgcgacaggttcacttttctacatctgggctctggggacaatatgcaggtaatgccacagctgggcgaaatgctgttctgcctcacatctaggtgtcctgaggaattcgagtcttatgggtgttattgtggacaggagggcaggggtgagcctcgcgacgatttagaccgatgctgtctgtcacatcactgttgtctagaacaggtgcgccggctcgggtgtctgctggagcggctgccttggagccccgtggtatgtgttgaccacacccccaagtgtggcggccaatcattatgcgagaagctcctctgcgcatgcgatcagacagccgctgagtgtatgacttccgcatcttttaatcagtcactcaagagtccatctcgccttggctgtcctggccagcctgccgcctgtgaggatagcctccacccagtaccagcggctcctaccctcggctctagcagtgaggaagattccgaagaggaccctcctcaggaggaccttggcagggccaagcggttcctgaggaaaagcctgggaccactcggaatcggccctcttcacggtaggtag

SEQ ID NO: 5264 - DNA, 1359 bp, Artificial Sequence
  Description of Artificial Sequence: Synthetic coding sequence
atggagctggcgctgcgaagatcacctgtgccacggtggttactgcttctgcctctcctgcttggactgaatgcaggcgctgtgatagactggcctacagaggaaggaaaagaggtttgggactacgtgacagtcagaaaagacgcctacatgttctggtggctatactacgcaaccaactcttgtaagaactttagcgaactacctctggtgatgtggttgcaggggggacccggcggctcatcaaccggattcggaaattttgaggagattggacccctcgattctgatctgaagcccaggaagacaacttggctgcaggccgcctcactcttgtttgtcgacaaccccgtggggaccggattctcatatgttaacggcagcggggcttacgccaaagacttagctatggtggcatcagatatgatggtcttactgaagacattcttctcctgtcacaaggaatttcaaaccgtgcctttttacatcttctccgagagttacgggggtaaaatggctgctggaatcggacttgaattatacaaagcaatacagagaggcacaattaagtgtaatttcgccggagtcgccctgggtgactcatggatctccccagtggactcagttctgtcttggggcccatacctgtactccatgtccctgctggaagacaaagggctggccgaggtgagtaaagtggcagagcaagttctgaacgccgtgaataaagggctgtatagggaggcaacagagctgtggggcaaagcggagatgatcatagagcagaacacagacggcgtgaatttctacaatattctgaccaagtctacccctacatccactatggagtcttccttggagttcacccaatcccacctggtatgtctgtgtcagagacacgtgcgacatctgcaaagggacgccctgtctcagttaatgaacggaccaattagaaagaaactgaagattattcctgaggaccagagctggggggggcaggcgaccaatgtcttcgtgaatatggaggaagatttcatgaagccagtcatatcaattgtagacgaactactcgaggcaggaatcaatgtgactgtctataatggtcaactggacctcattgtggataccatgggccaagaagcttgggtgcgaaaactcaagtggccagagctgcctaaattctcacaactgaagtggaaggccctgtatagcgacccaaaaagtctcgaaacttcagcgtttgtgaagtcctataaaaacttagccttttattggatcttgaaggcaggtcatatggtaccctctgatcaaggtgacatggcactgaaaatgatgcggcttgtgacacagcaggagtag

SEQ ID NO: 5265 - DNA, 1395 bp, Artificial Sequence
  Description of Artificial Sequence: Synthetic coding sequence
atggtgaggcttgcagcagagctgctcctgcttctgggacttctgctgttaacactccacatcactgtgttgcgtgggtcaggtgccgcagacggtcctgacgccgccgccggaaatgctagccaggcccagctgcagaataacctgaacgtcgggtccgacacgaccagtgaaactagcttctccctcagcaaggaggctcctcgggagcatctggaccaccaggcagctcatcaacccttcccaagaccgaggttcaggcaggaaacaggtcatccctctctgcagcgcgactttcccaggtcgttccttctggatcttcctaattttcctgatctcagcaaggctgacattaacggacagaacccaaacatacaggtgacaattgaggttgtggacggacctgacagtgaggccgacaaagatcagcatcccgagaacaaaccgagctggtctgtgccctctcctgattggagagcatggtggcagcgcagcctgtctctggcgagagcaaactccggcgatcaggactacaaatacgatagcacgtccgatgactcaaacttcctcaatccccccagagggtgggatcacaccgccccaggccaccggaccttcgaaaccaaggaccagcccgaatacgacagtactgacggggagggcgactggtctctctggtcagtctgcagtgtgacgtgtgggaacggaaaccaaaaacggactaggtcctgtggatacgcatgcaccgctactgaaagcaggacatgtgacagacccaattgcccagggattgaggatacttttagaactgccgccacagaagtgagcttgctagccggctcagaggagtttaacgccacaaaattgttcgaagtggatacagacagttgtgaaaggtggatgtcttgcaaatctgagtttcttaagaaatacatgcacaaggttatgaacgaccttccgtcatgtccatgctcttacccaacggaagtagcatacagcaccgcagacatcttcgatcgaatcaaacgcaaggatttccgttggaaggatgcatctgggcccaaggagaagttggaaatctataagcccacggcaaggtactgcattaggagtatgctctccttggagtcaacaacccttgccgcccagcactgctgttatggtgacaacatgcagctgataacccgcggaaaaggggccgggactcctaacctcatctctactgagttctcagctgagctccactataaagtggacgttcttccttggattatttgcaagggtgactggtctcgatacaatgaggctaggccacccaataacggtcagaagtgcaccgagtcaccttccgatgaggactacatcaagcagttccaggaggctagggaatactag

SEQ ID NO: 5266 - DNA, 1536 bp, Artificial Sequence
  Description of Artificial Sequence: Synthetic coding sequence
atgctggtcgatggtccgtctgagagaccagccctgtgctttctactgctcgccgtcgccatgagcttcttcggcagtgccctatctatagacgaaacccgagctcatcttcttttgaaggagaagatgatgagattaggagggcgtctggtgcttaacacaaaggaggaattagctaatgagcgcctgatgaccctcaagatcgccgagatgaaagaggcgatgagaaccctgatcttccccccctctatgcacttttttcaggcaaagcacctgatcgagcgatctcaagtttttaatatcctaagaatgatgccgaaaggagcagccttgcatctgcatgacatcggcatcgtgaccatggattggctggtcagaaatgtgacttatcggccacactgccacatttgttttacgccccgagggattatgcagtttagattcgcccaccctactccccgcccatcagagaagtgtagcaaatggattctccttgaagactaccgaaagcgagttcagaatgtaaccgaattcgatgactcgttactgcgcaattttactcttgttactcagcatcccgaagtcatctacaccaatcaaaacgttgtgtggtctaagttcgaaaccatcttctttacgatttctggcctcatccactacgcccctgtcttcagggactatgtgttcaggagcatgcaggaattttatgaggacaacgtactttacatggagatccgggccagattactgcctgtatatgagctgtccggtgagcaccacgacgaggagtggagcgttaaaacataccaggaggtagcccagaagttcgttgaaacacacccagagtttattggcatcaaaatcatctattcggatcacagaagcaaggatgtagctgtgatcgccgagtctattagaatggctatgggcttgcgcataaaatttcccacagtggtggccgggttcgacctggtgggacatgaagacaccgggcatagccttcatgattacaaggaagccctcatgatacccgccaaggacggcgtcaagctgccctatttcttccacgcaggcgaaaccgattggcaaggcacctctattgaccgaaatattctggatgccctcatgctcaatacaactcggatcggacacggattcgcgctgtctaagcaccccgctgtgagaacatatagttggaagaaggacatcccaatcgaggtgtgtcctatcagcaaccaggtgctcaaactggtttctgacctgagaaatcatcccgtggcgaccctcatggccacaggccaccccatggtcatttctagcgatgaccctgccatgtttggagccaagggcctgtcctacgacttctatgaggtgttcatgggcattggaggaatgaaggccgacctacgaacacttaaacagttagctatgaacagtattaagtactctacactgctggaaagcgagaaaaacacatttatggagatctggaaaaagcgttgggacaaatttattgccgacgtggccacaaaatag

SEQ ID NO: 5267 - DNA, 777 bp, Artificial Sequence
  Description of Artificial Sequence: Synthetic coding sequence
atgaaacaaattctgcaccccgctttggagacgacggccatgacactcttcccggtgctccttttcctggttgcgggattgcttcctagtttccccgcaaatgaagacaaagaccctgcattcactgccctcttgactacccaaactcaggtccagagagagatcgtcaacaagcataacgagttacgtcgagcagtgtcccccccggctaggaatatgctcaaaatggaatggaataaggaagcggcagccaatgcccagaagtgggccaaccagtgtaattaccgacacagtaaccccaaggatcgcatgacgtcacttaaatgcggggagaatctgtacatgtcatcagcatcatcatcctggtcacaggcaatccagagttggtttgacgaatataatgatttcgacttcggggtcggccctaagacaccgaacgccgttgtgggccactatactcaggttgtgtggtactcctcttacctggtgggatgcggaaacgcctactgccctaaccagaaagtgcttaagtattactacgtgtgtcagtactgtcccgcagggaactgggccaatcgactgtatgtgccatatgaacaaggagctccatgtgctagttgccctgataactgtgatgatggtctgtgcacaaacggctgtaagtacgaagatttgtattcaaattgcaagagtctcaaacttacactgacttgcaagcatcagctggtgcgagattcttgcaaggctagctgtaactgctccaactccatttactag

SEQ ID NO: 5268 - DNA, 714 bp, Artificial Sequence
  Description of Artificial Sequence: Synthetic coding sequence
atggtcactccaccaccccctcccgtctttagcttactaaagatctcacaaaggatcgtgtgtctggtactcgacaaatcgggcagtatgggaggcaaggatagactaaatagaatgaaccaagcagccaagcacttcttgctacagactgtagaaaacggtagctgggtcggaatggttcactttgactcgactgcgacaatcgtcaacaagctgattcagatcaaaagctccgacgaaagaaacactttgatggctggactaccaacatatccccttggaggaacttcaatctgtagtggaatcaagtatgcttttcaggtgattggtgaactgcatagccagttggatggcagtgaggtgctcctgttgacagacggtgaggataatactgccagctcatgtatagatgaggtaaagcagagtggcgccattgttcatttcattgctctaggaagagccgccgatgaggccgtgatcgaaatgtccaaaatcacgggcggaagtcacttctacgtgtctgacgaagcccaaaataacgggctaatcgacgcctttggtgcccttacttcaggaaatactgacctctcccagaagtcattgcaagtgcgggtcttaattccttgggttttcatgtttacattcgctaccaggaagaaccatcttgtggtcatcagcttcgaattccatatatttctgaaagtgaatttttag

SEQ ID NO: 5269 - DNA, 459 bp, Artificial Sequence
  Description of Artificial Sequence: Synthetic coding sequence
atggataatgtacagcccaagatcaagcatagaccattttgcttttccgtcaagggacacgtgaaaatgttgcgcctggcgctgactgtaacaagcatgacattctttatcatcgcccaagcaccggagccttacatcgtcatcactggattcgaggtgaccgttattttgttcttcatactcctctatgtcctgcgcttagatcggctgatgaaatggcttttttggcctctcttggacatcatcaacagcttagtcactacggttttcatgttaatcgtgtcggtcctcgcacttattcccgaaaccactacacttacggttggcggaggagtgtttgctctcgtgactgccgtttgctgcctggcagatggcgccctgatttataggaaattgctctttaacccctctgggccctaccagaagaaaccggtacatgagaagaaagaggtgttgtag

SEQ ID NO: 5270 - DNA, 3744 bp, Artificial Sequence
  Description of Artificial Sequence: Synthetic coding sequence
atgttggcctccagtagccgcattagggcagcttggacccgagctttattactgcccctgctgctcgccgggccagtgggctgcctgtcccgtcaggagttgtttccctttggcccagggcagggcgacctcgaactcgaggatggagatgactttgtctcacctgccttagagctcagcggtgccttgcgtttctatgaccggtcagatatcgacgctgtctacgtgacaaccaacggcattatcgccacaagcgaaccaccagcgaaggagtctcaccccggcctctttccccccacattcggtgcggttgccccttttctggcagatcttgatacaaccgatggactgggaaaggtttattacagagaggacctgtctccctccattactcagagagctgcggaatgcgttcacagaggattccctgaaatttcatttcaaccgtcaagtgcagtggtggttacatgggagtcagtggccccataccagggtccctcaagagaccctgaccaaaaagggaaacgcaatacattccaggctgtgcttgcatcatcagattctagctcctacgccatcttcctttatccagaagatggcctgcagtttcatacaaccttctctaaaaaggagaacaaccaagtgccggcggtggtcgcttttagtcagggcagcgtgggtttcttatggaagtctaacggggcgtacaacatctttgccaacgacagagaaagcgttgagaacctcgcaaagtcaagtaacagcggtcaacagggcgtctgggtcttcgagataggatccccggcaacaaccaatggcgtggtgcccgccgatgtgattctgggtacagaggatggggcagagtacgacgacgaggatgaggattacgacctggccaccaccagactgggcttggaggatgtagggactacaccattttcatataaagccctccggcggggtggtgccgatacatactctgttcctagcgtcctgtcaccgcgcagagcggcgacagagcgcccgcttgggccacctactgaacgcaccagatcctttcagctcgcggttgagacttttcaccagcagcaccctcaggtgattgacgtggacgaagtggaggaaactggggttgtatttagctataatactgactcccgccagacttgcgctaataaccgccatcagtgctccgtgcacgccgaatgccgtgattatgccaccggtttctgttgcagttgcgtcgccggctacaccggaaatggccgtcagtgcgtggccgaaggctccccgcaacgcgttaatggcaaggttaaagggcgcatctttgttggcagcagccaagtaccaatcgttttcgaaaacactgaccttcattcctatgttgtcatgaatcatggccgaagctatactgccatctctactatcccggagaccgtgggctatagcttactcccactagccccagtgggggggataattgggtggatgttcgctgtggaacaagacggattcaagaatggcttctctatcacgggaggcgagttcaccaggcaggctgaggtaacatttgtggggcatcccggaaacttggtgatcaagcagaggtttagcggcatagacgagcacgggcatctcacaatcgatactgaactggagggtcgcgtcccccagattccgttcgggagcagcgtgcatatcgagccatacactgaattataccactattctaccagcgtgatcacaagttctagcaccagggagtacacagtaactgagccagaaagggacggggcgtcacccagcagaatttatacctaccagtggagacagacaataacctttcaagagtgcgtacatgatgactcccgcccagccctgcctagcacacagcagctttctgttgactccgtgttcgtgctgtacaaccaagaggaaaagatacttcgatatgctctctctaattccattggacccgtccgcgagggatcccccgatgccctccagaacccctgttacatcggtacccacggatgtgatacaaacgctgcatgtaggcccggcccccgcacgcagttcacttgtgaatgcagcatcgggttcagaggtgacgggaggacttgttatgatatcgacgagtgcagcgagcagccctcagtgtgtggctcacataccatttgtaataaccatcctggtactttccgatgcgaatgcgtcgaaggttatcaattttctgacgagggaacctgcgttgcggtggttgatcagcgccctattaactattgcgagaccggcttacataattgtgatattccgcagcgcgcacagtgcatatacacaggcggcagcagttatacatgtagctgcctgcccgggttcagcggagacggccaggcctgccaggacgtagacgagtgccaaccaagtagatgccatcccgatgccttttgctacaacactccagggagtttcacctgtcagtgcaaacctgggtatcagggagacggtttccggtgtgtcccaggcgaagttgaaaaaacacgttgccaacacgagagagaacatattcttggcgccgccggtgccacagatccccaacggcctatccctccgggcttatttgtgccagaatgcgatgcacatggacactacgctccaacacaatgccacggaagcacaggctactgctggtgcgtagatagagatgggcgggaggtggagggaacacggactagacccggaatgacacctccatgtctgtccaccgttgccccgcccatccaccaaggcccagcagtgccaactgccgtgatccccctgccccctggcactcatctgctcttcgcacagactggcaagatagaacgcctgccattggagggtaatacaatgcgcaaaacagaagccaaggctttccttcacgtcccagctaaggtgataatcgggctcgccttcgattgcgtagacaaaatggtttattggaccgatatcactgaaccgtctataggccgggctagtctacacgggggcgaaccgacaaccattatcagacaagacctgggaagcccagaggggatcgctgtcgaccacttaggtcgcaacatcttctggaccgactctaatctggatagaatcgaggtcgcaaagctcgatggtacccaacggcgggtcttgtttgagacagacctcgtgaacccccggggtatcgtaactgatagtgtgcgcggcaacttatattggactgactggaatcgtgacaaccctaagattgaaaccagttacatggacggcactaatcgacggattcttgtgcaggatgatctgggccttccaaacggcctgactttcgatgcctttagtagccagctgtgttgggtggatgccggaaccaacagggctgagtgtctgaaccctagccagccatcacggcgcaaggccctggagggcctacagtatccgttcgccgtcacctcttacgggaagaatctctattttacagattggaaaatgaactccgtggtagccctggacttagccattagcaaagagacggatgcttttcagccccacaaacagacgcgattgtacggaatcacaaccgccttgagccagtgcccacaaggacacaactattgttcggttaacaacggcggatgcacacatctgtgtctggccacgcctggttcacgcacatgtcggtgccctgataatactcttggcgtggactgcatcgagcagaaatag

SEQ ID NO: 5271 - DNA, 525 bp, Artificial Sequence
  Description of Artificial Sequence: Synthetic coding sequence
atgctgcggactgaatcatgccgacccaggtcccctgccggccaggtcgcggccgcaagcccgcttctcctgctgctgctgctgttagcatggtgcgccggagcctgcaggggggctcccatcctgcctcagggactccaacctgagcaacagcttcagctatggaatgaaattgatgatacctgctcgtcatttctctctatcgactcacagccccaggcctcaaacgctcttgaggaactctgttttatgattatgggtatgttgcccaagccacaggagcaagatgaaaaagataatacaaagaggtttcttttccactacagtaagactcagaagctgggtaagtccaacgtagtctcgagtgtggtgcacccactgcttcaactggtgcctcacctgcacgagcgacgaatgaaaagattcagagtagatgaagaattccagtctcctttcgccagccagagccgaggctattttcttttcaggccaagaaacgggcggagaagtgccggctttatctag

SEQ ID NO: 5272 - DNA, 1218 bp, Artificial Sequence
  Description of Artificial Sequence: Synthetic coding sequence
atggacaccatttttttatggtcactcctgctcctcttctttgggtctcaggcttcacgttgtagcgcacagaagaatactgaatttgctgttgatctgtaccaagaggtctccctgtctcacaaggataacattattttttctcctttgggtataacactggtgctggagatggtgcagttgggagcaaaaggtaaagcacaacagcagataaggcaaaccttgaagcagcaggagacatccgcaggcgaggagttttttgttttaaaatcatttttctccgccatttccgagaagaaacaagaatttactttcaatctggctaatgctctgtatctccaagaagggttcactgtgaaggagcagtatttgcacgggaacaaggagtttttccaaagcgctattaagcttgttgacttccaggacgccaaggcgtgcgccgagatgatttcaacctgggttgagaggaaaaccgatggaaaaattaaggacatgtttagcggggaggagtttggacctctgactcgcctggtcttggtgaatgctatctattttaagggcgactggaagcagaaatttcggaaggaggatacgcagctcataaatttcaccaaaaagaacggaagtaccgttaaaatcccgatgatgaaagcactgctgcggaccaagtatggttacttttcggagtcatctctgaattaccaggtgttagagttgtcttacaaaggtgatgagttctctctcataattatcctccctgccgagggaatggatatcgaagaggttgagaaactcatcaccgctcagcagatcctgaagtggttgagcgaaatgcaagaagaagaagtggagatcagtctcccaagatttaaagtagagcagaaagtggattttaaagatgtcctgtacagcttaaacatcactgagattttcagcggaggctgcgatttatcaggaatcaccgattcttctgaagtctacgtatcccaggtgacacagaaggttttttttgagataaatgaggacggctcggaagcggctacaagtactggtattcacatacctgtgataatgagtctagcgcagtcccagttcatcgccaaccatccctttctatttattatgaagcacaacccgacagagagtatcctgttcatgggcagggtaacgaatcctgatactcaggagattaaggggagagacctggacagcctgtag

SEQ ID NO: 5273 - DNA, 3687 bp, Artificial Sequence
  Description of Artificial Sequence: Synthetic coding sequence
atgaagggcgctcgactgttcgttctccttagcagcctgtggtccgggggtatcggcctcaataatagcaagcactcttggaccattcctgaggacggcaacagccagaaaactatgcctagtgctagcgtgccacccaacaaaatacagagcttacagatccttccaactacgagagttatgagcgctgagatcgccacaacacctgaagcgcgcacgagcgaagactccttgcttaaatctaccctccctccgagcgaaaccagtgcacctgccgagggtgtgagaaaccaaaccctgacatccaccgagaaagccgaaggtgtggtcaagcttcaaaatcttacccttcccactaacgcttctatcaagttcaatcccggcgccgaatcagtggtattatccaattctacgttgaaatttctgcaatctttcgcccgcaagtctaatgagcaggctaccagtctgaacactgtaggcggaaccggagggattggtggggtgggcggcactggcggcgtcggaaacagggcccctcgggaaacctatttgagccgaggcgactccagtagttcgcaacgcacagattatcagaaaagcaacttcgaaaccacccgtgggaaaaattggtgtgcttacgtgcatacaagactctcacctaccgttattttagataatcaggtgacctacgtacccggaggcaaagggccatgcggatggactggagggtcttgccctcaaaggagccagaagatctctaacccagtctataggatgcaacataagatagttacatcccttgactggaggtgttgtccgggatactcaggacctaaatgtcagttgcgagcgcaggaacagcagtccctgatccataccaaccaagccgagtcccacactgcggtggggaggggggtcgccgagcagcagcagcagcagggatgtggagacccggaagtgatgcagaaaatgacggaccaggtgaactaccaagccatgaagctgactctcctgcagaaaaaaatcgataatatctccctcaccgttaatgacgtgcggaacacctacagttctttggaggggaaggtttccgaagataagtcaagagaattccagtcactgctgaagggcctcaagtcaaagtccattaacgtgctgataagagacatcgttagagaacaatttaagatcttccagaacgacatgcaggagactgttgctcaactttttaagacagtgtcctctttatccgaagatttggaatcaacgcggcagatcatccagaaagtcaatgaaagcgttgtcagcattgccgcccagcaaaagtttgtacttgtgcaggagaacaggcccacattgactgatattgtagagttgagaaatcacattgttaacgttcggcaggagatgactctaacttgcgaaaagcccataaaggagctggaagtcaagcaaacccacttagagggcgccctcgagcaagaacattcacgttctatcttatactacgaaagtctaaacaaaactttatcaaaactaaaggaggtgcatgaacagcttctaagcactgaacaggtgagtgaccaaaagaatgccccggccgctgaaagcgtgagtaataacgttacggagtacatgagcactttgcatgagaatattaagaaacaaagtctgatgatgctgcaaatgttcgaggaccttcatatccaggaatccaaaatcaataacctgacggtgagccttgaaatggagaaggagtcactgagaggagaatgtgaggacatgctctctaaatgtcggaatgattttaagtttcagctgaaggacaccgaagaaaaccttcatgtgctcaaccaaacattagcggaggttctgttccctatggataataaaatggacaagatgtcagagcagttaaatgacctcacttatgacatggaaatactgcaacctctgttggagcaaggtgcttccttgagacaaactatgacatatgaacagcccaaagaggcaattgtaattagaaaaaaaatcgaaaatctgacgagcgccgtgaactccctcaacttcattatcaaggagctcaccaagaggcataacttgttgcgcaatgaagttcagggacgagacgatgctctagagcgacggatcaacgagtacgccctggaaatggaagatggcctcaacaaaaccatgactattatcaacaatgccatcgacttcatccaggataactatgctctcaaggagactctgtccaccataaaagacaactctgaaattcatcacaagtgcacctctgacatggagactattctcactttcattcctcagttccatcgtcttaacgacagcatacaaacattagtgaacgacaaccagcgctataatttcgtgctccaggtagcgaagacacttgctgggattcctcgagacgagaagctcaatcagtctaattttcaaaaaatgtatcagatgttcaatgaaacgacatcccaggtacgcaagtatcagcagaatatgtcccatttagaagaaaagcttctcttaacaactaagatttctaagaacttcgagacacggctgcaggacatagagtccaaagtaacccagactttgatcccctactatatcagcgtgaagaaggggagcgtggtcactaacgagagggaccaggccctgcaattacaggtgctgaatagtcgatttaaggctctggaggcaaaatcaatccacctctctatcaacttcttctccttgaacaagactctgcacgaggtgctgactatgtgtcataacgcgagcacatcagtcagcgagcttaacgccacaatccccaaatggatcaaacattctctacctgatatccagctgttgcagaaagggctgaccgagttcgtcgaaccgatcatacagattaaaactcaggccgcccttagtaatcttacctgctgtattgacagatcccttcccgggagcctggcgaacgtggtcaaatcacagaagcaggtgaagagccttcccaagaagattaacgccttgaagaagccaacagtgaatttgaccaccgttcttataggcaggacccaacgaaatacagacaatattatatatcctgaagagtactctagttgttctaggcatccatgccagaatggcggcacctgcataaacggcagaacaagctttacatgcgcctgtagacatccttttactggggataactgcacaatcaagctcgtcgaggagaatgcgcttgccccggacttctcaaaagggtcttatcgatacgcccccatggttgcgtttttcgccagccatacctatggtatgactattccaggaccaatcctgtttaataaccttgatgtgaattacggagctagctacaccccacggactggcaaattcaggatcccttatctgggcgtctatgtgtttaaatataccatcgaatctttctcggcgcacatctctgggtttttagtcgtcgacggaatcgacaaattggcctttgagtcagaaaacatcaacagcgagatccattgtgatcgggtacttaccggagatgctcttttagagctgaattacggccaggaggtgtggctgagactcgcgaaaggaactatccctgctaaattcccaccggtgactacatttagtggatatcttctatatcgcacatag

SEQ ID NO: 5274 - DNA, 1365 bp, Artificial Sequence
  Description of Artificial Sequence: Synthetic coding sequence
atgtggcctctgaccgttcccccccccttattactcttgctgtgtagtggtttggctggccaaacactgtttcaaaaccctgaggagggttggcaactctacacctccgcacaggctccagacggtaagtgtatctgtaccgcagtgatcccagcccagagcacttgctctcgggacggacgtagtcgcgaactgaggcagctaatggaaaaggtgcagaacgtgtctcagtctatggaagtcctcgagctgagaacatacagggatctgcaatacgtgcgcgggatggaaacgcttatgcgatcactcgatgctcgacttagagctgccgacggaagcctgagtgctaagtcctttcaagaactgaaggaccggatgacggagctgttgcccctgagtagtgtcctggagcagtataaggcggataccagaaccattgtgcgattgagagaagaagtgcgcaacttgagtggttccctggccgctattcaggaggaaatgggcgcttacgggtatgaggatttacaacagagggtgatggcactcgaggcaaggctgcacgcatgcgcacagaaactgggatgtgggaaactgaccggcgtgagcaaccctattacggttcgggcaatgggctcaaggtttgggtcctggatgacggacaccatggcaccctccgccgactcaagggtttggtatatggatggttactataaagggcgtcgcgtgctggagttccgcacgctgggagacttcattaagggtcagaattttatacaacatcttcttccccaaccatgggcgggcacaggacacgttgtctacaatggtagtcttttctacaacaagtatcagagtaacgtggtggtgaagtaccacttccgctcgcgaagcgtgctcgttcagaggtctttgccgggtgctggatacaacaacacattcccctactcttggggcgggttcagtgacatggattttatggtggacgaatctggcttatgggccgtgtacactaccaaccaaaatgctggaaatattgtggtgagtaggctagacccacatacactggaggtgatgcgctcatgggatacaggctaccctaagcgctccgccggagaggcattcatgatatgtggagtgctgtacgtcacaaatagtcacctggccggggcaaaagtgtactttgcctacttcaccaataccagctcatacgagtacactgacgttccctttcataatcagtactcacatataagcatgctcgattacaacccgagggagcgggcattatatacttggaataacggacaccaggtgttgtacaatgtcacactgtttcatgtgatctcaacaagtggagatccatag

SEQ ID NO: 5275 - DNA, 909 bp, Artificial Sequence
  Description of Artificial Sequence: Synthetic coding sequence
atgtgcgcagaacgcctcgggcagttcatgactctggcactcgtgctcgcaaccttcgacccagcaaggggaaccgatgcaactaatccccccgagggcccgcaggataggagcagccagcagaaaggcagattgtccttgcaaaatacagcagagatccagcattgcctggtgaatgctggagacgtcggatgtggcgtgtttgaatgtttcgagaataacagctgtgagattcgcggtttacacggaatctgtatgacttttctgcacaacgccggcaaatttgacgctcagggcaagtccttcattaaagatgctttgaaatgcaaagcccatgccctgcggcaccgcttcggctgcatttcacgaaagtgtcccgctatccgggagatggtgagtcagctccagagggagtgttacctgaaacatgacctgtgcgcagccgcccaggagaacacccgggtgattgttgaaatgattcattttaaggacttattgcttcatgaaccctatgtagacctggttaacctgctcttaacctgcggagaagaggtgaaggaggcaatcacccacagcgtgcaagtccagtgcgaacagaactgggggagtctgtgctcgatactgtctttctgtacatccgccattcagaagcctccaacggcgcccccggaacggcaacctcaagtcgaccggactaaactcagtagggcacatcacggggaggccgggcaccaccttcccgaaccatcttcaagggagaccggacgtggcgcaaaaggcgagcgaggttccaagagtcacccaaatgctcacgcgcgcggccgcgttgggggtttgggcgcacagggtccctccggaagtagtgagtgggaagatgagcagtccgaatactctgatattcgcagatag

SEQ ID NO: 5276 - DNA, 2529 bp, Artificial Sequence
  Description of Artificial Sequence: Synthetic coding sequence
atgaaaccaggaggattctggttgcatctcacccttctgggggcatctctgcctgccgcactcggatggatggatcctgggacgtcccggggtcctgatgtcggggtcggggaaagccaggccgaagaaccacgcagcttcgaggtgacaaggcgagaggggctgtcatcacacaacgagttgctggcctcgtgtggcaagaagttctgtagcaggggatctcgctgcgtgctgagccggaagaccggggaaccagaatgccagtgcctggaagcatgcagaccttcttacgttccggtgtgcgggtctgatggcagattttacgaaaaccactgtaaactgcaccgcgctgcctgccttctgggcaagcgcatcaccgtgattcactcaaaggattgcttcttgaaaggggacacatgtaccatggccggctacgcaaggttaaaaaacgtgctgctggcgctgcaaacccgactgcagcctcttcaggagggggattcccgccaagaccccgccagtcagaaacgtctgctggtcgaatcactgtttagagatttggatgctgatggtaatggacacctctcatcttctgagctggcacaacacgttctcaagaagcaggatctggacgaagatctcctggggtgttctcctggggacttgctccgctttgatgattataactctgattccagtttgaccctgagggagttctatatggctttccaggttgttcagctgagtctcgcgcctgaagatcgggtcagtgtgactactgtgaccgtgggcctgtcgactgtattaacttgtgccgtgcatggggacctgaggccgcctattatctggaaacgaaatggcctaacactcaatttccttgatctcgaggatataaacgattttggagaagatgacagcctctatatcactaaggttacaacgatacatatgggaaactacacatgccacgcgtccggacatgaacagttatttcagacccatgtcctgcaggtcaacgtgccaccggtgatcagagtatatcctgagtcacaggcacaggaaccaggagtcgctgcttctctgaggtgccacgctgagggtattcctatgccgagaattacctggctgaagaatggagtggacgtctccacccagatgagtaagcaactgtctctcctggcgaatggctccgagctccacatcagctcagtacgctacgaagataccggggcttatacatgtattgccaaaaatgaggtaggagtagatgaggacattagcagcctgttcatcgaggattcagcccgcaagaccctagcaaatattctgtggcgcgaggagggcctttcagtgggcaatatgttctacgtgttttccgatgatggcattattgtcatccatcccgtcgattgtgaaattcagaggcatctgaagccaacagagaagatatttatgagctacgaggagatctgcccgcagcgggagaaaaatgctacacaaccctgtcagtgggtgagcgccgtcaatgtgcgcaatcgatacatatatgtggctcaaccagcactctcacgcgtgctcgtggtggacatccaagcccagaaggtattgcaaagtattggggtggatcctctcccagcaaaactgtcctacgataaaagccacgaccaggtttgggtactatcttggggagatgtacacaaatctcggccgtcacttcaggtgatcaccgaggcttccactgggcagagccaacacctcatacgaacccctttcgcaggggtcgacgattttttcatcccccctacaaacttgattataaaccacatacggttcggattcatctttaataaatccgatcccgcggtgcacaaagtagacttagagaccatgatgcccctaaagacaatagggctacatcaccacggctgcgtgccgcaagctatggctcatacacatctgggtgggtatttcttcattcaatgccgccaggatagcccggcttctgcagcaagacaactgctcgtggattcagtgactgattcagtgctgggccccaatggggatgttacgggtacgcctcatacatccccagacggaaggtttattgtgagcgctgctgcagatagtccttggctgcacgtgcaggagatcacggtaagaggcgaaatccagacgctgtatgacttgcagattaactcgggaatatctgatttggccttccaacgcagttttacggagagcaatcagtacaacatatatgccgcactgcataccgagccagacctcctgtttctggagttgtcgacaggaaaggtcggaatgctcaaaaatctcaaagaacctccagctggaccagctcaaccctggggcgggacccatcggatcatgcgagacagcggactcttcgggcagtatctgttgacaccggcacgggagagtctctttctcatcaacggcagacagaatactctgagatgcgaagtaagcgggatcaaaggtggcaccacagtggtatgggtgggagaagtatag

SEQ ID NO: 5277 - DNA, 2256 bp, Artificial Sequence
  Description of Artificial Sequence: Synthetic coding sequence
atggcctttcgtaccatctgcgtcctggtcggcgtgttcatttgctctatttgtgttaaaggctctagccagccccaggcccgggtctacttaactttcgacgaactgcgggagacgaaaacttctgagtattttagtctgtcccatcacccactggattaccggatcctgttgatggacgaagaccaggatagaatttatgttggctctaaagaccacatactgtcattgaatatcaataatattagccaggaggccctttcagtattttggccagcttcaaccatcaaagtggaggagtgtaagatggccggcaaggacccaactcacggctgtggcaatttcgtcagggtcatacagacctttaaccggactcacctctatgtgtgcggttctggtgctttcagccccgtctgtacatatctgaatcgcggtagaagatctgaagatcaggtctttatgatcgacagtaagtgtgagagcggcaaaggcagatgtagtttcaacccaaacgtgaataccgtaagcgtgatgattaacgaggaactattttctgggatgtatatcgatttcatgggcaccgatgccgccatctttcgttcacttacaaagagaaacgcagtgcgcactgaccagcacaactccaaatggctaagcgagccaatgtttgttgacgcccacgtcataccggatggtaccgatcccaatgacgcaaaggtgtattttttctttaaagaaaaactaaccgacaacaaccgcagcaccaagcagatccacagcatgattgcacgtatctgtcccaacgatacaggtggcctccggtcactggttaataaatggacgaccttcctgaaggcccggttggtgtgtagtgtcaccgacgaggatggaccagaaactcacttcgatgagctggaagatgtgttcctgctagaaaccgataacccacgaacaacattggtatacgggatctttaccacttcgtccagcgtgttcaaaggaagtgcggtatgcgtgtaccacctgtccgacatccagaccgtattcaatggaccatttgcacacaaggagggtcctaaccaccagctgatctcttaccagggacggatcccttacccccgacctgggacgtgccctggcggggcgtttactcccaatatgcgaacgacaaaagaatttcccgatgatgtggtgacgtttatccgtaatcatccactgatgtacaacagcatctatccaattcacaagagacctttgattgtaagaattgggacggattacaaatatacaaagatcgccgtggaccgcgtgaacgcggcagacggccgatatcacgtgctgttcttaggaaccgatcgtgggaccgtgcagaaggtcgtggttctccccacaaacaattccgtgagtggtgagcttatactggaagagctggaggtgtttaagaaccatgctccgatcacaaccatgaaaataagttccaaaaaacaacagctctatgtgtctagcaacgagggcgtctcacaggtttccttgcacaggtgtcatatctacggaaccgcctgtgcagattgttgcttagcccgcgacccctactgtgcttgggacgggcattcatgttcaaggttctaccctacaggcaagcggcgctcaaggcggcaggatgtgaggcatggtaatcctctaacacagtgtcgcggttttaatttgaaagcatatcggaatgcagccgagatcgtacagtacggcgtaaagaacaataccactttcctcgaatgcgcccccaagtccccgcaggctagcataaagtggctgttgcaaaaggacaaagatagaaggaaggaagttaagcttaacgagcggataatcgccacaagccaaggcctgcttatcagaagcgttcaagggtccgatcaaggactgtaccactgtatagctaccgagaacagttttaagcagaccatcgcgaagattaactttaaagtgcttgactctgagatggtcgctgtcgtcaccgacaaatggagcccttggacctgggctagcagtgtgagagctctgccttttcaccccaaggacatcatgggggcattctctcactccgaaatgcagatgatcaatcagtattgcaaggatacaagacagcagcaccagcagggcgacgagtcacagaaaatgaggggggattacggtaagcttaaagcgttgataaatagcagaaaatcacgaaataggcggaaccagttgcccgagtcgtag

SEQ ID NO: 5278 - DNA, 2316 bp, Artificial Sequence
  Description of Artificial Sequence: Synthetic coding sequence
atgggctggctcacgagaatcgtttgcttgttctggggtgtgttgctcacggcccgtgctaattaccagaacggaaaaaataatgtacccaggttgaagctctcctataaggagatgctcgagtctaataacgtgatcaccttcaacggattggcgaattctagttcttaccacactttcctcctcgatgaggaaaggtccagactatacgtgggagcaaaagatcacattttctcatttgatctcgtgaatatcaaggactttcaaaagatcgtgtggcccgtcagctatactaggagggacgagtgcaagtgggcaggcaaggatatcctaaaagaatgtgccaactttatcaaggtcttgaaggcctacaaccagacccacctgtacgcctgtggtaccggcgctttccacccgatttgcacctacatcgagatcggacaccaccctgaagacaatatttttaaactcgagaactcccactttgaaaatggcagggggaaaagcccgtatgaccccaagcttcttacagcctctcttctgatagatggagaactgtacagtggaacagccgctgacttcatgggccgcgactttgctatcttccgcacactcgggcaccatcatccaatccggactgaacagcacgattctagatggctgaacgatcccaagttcattagtgcgcatctcatttccgaatccgataatcctgaggacgataaagtctattttttcttccgagagaacgcaatcgacggggagcacagcggcaaagctacccacgctagaataggtcagatatgcaagaacgactttggtggacatcgatccttggttaacaaatggaccaccttcttgaaggcaaggctcatctgttctgtgcccggacctaacggtatcgacactcacttcgatgaactgcaggacgtgtttctaatgaacttcaaagaccccaaaaaccccgttgtttatggcgttttcactacatccagcaatatattcaaaggttccgccgtctgtatgtactcaatgtcagatgtgcgccgcgtttttttgggcccttacgcccaccgagatggacctaactatcagtgggtcccataccaaggccgcgtaccttaccctaggccagggacgtgtccctcgaaaacttttgggggctttgacagcacaaaggatctgcctgatgatgtgatcaccttcgcccggagccaccctgcaatgtacaatcctgtcttcccaatgaacaaccgtcccatcgtgattaaaacggacgtgaactaccaattcacccagattgttgtcgatcgcgtagacgcagaggatgggcagtacgacgtaatgtttatcgggaccgacgttggcactgtgctcaaggtggtatccatcccaaaggaaacttggtatgatttagaggaggtactgttggaagagatgactgtgtttcgcgaacctacagccatttcggccatggagctttcaaccaagcagcagcaactctacataggctcgacagctggcgttgcacagctgcctcttcaccggtgcgatatctacggaaaggcgtgtgccgagtgctgcctcgccagggatccgtactgtgcgtgggacggatctgcatgctcacggtatttccccacagccaagcgccgcaccagacggcaagacattcgaaacggcgatcccctgacccattgtagcgacctccaccacgacaatcatcatgggcattcgcctgaggaaaggattatctacggcgtcgagaattcgagtacttttctcgaatgttctcctaaaagccaacgcgcacttgtgtactggcagtttcagcggcgcaatgaagagcgcaaagaggagattcgcgtggacgaccacatcatccgcacagaccagggactcctcctgcggtccctccagcaaaaggacagcggcaattacctgtgccacgctgttgagcacggatttattcagactctcctcaaggtgacccttgaggtcatagacaccgaacatctcgaggagctattgcacaaggacgacgatggtgatggcagtaagacaaaagagatgagcaacagcatgacacctagccagaaggtgtggtacagggacttcatgcagctgatcaatcatcctaatctcaacaccatggatgaattttgcgaacaagtttggaaacgggacagaaagcagcgcagacagagaccaggacatacaccggggaattccaataagtggaagcacctgcaagagaataaaaagggtagaaaccgcaggacccatgagttcgagcgagctccaagatccgtgtag

SEQ ID NO: 5279 - DNA, 4605 bp, Artificial Sequence
  Description of Artificial Sequence: Synthetic coding sequence
atggctctaacacccgggtgggggtcttcagcgggtcccgttcggcccgagctgtggctgcttttatgggctgcagcttggcggctgggggcctccgcctgtcctgccttgtgtacctgcaccggaacgacagtcgactgtcatgggacaggacttcaggccattcccaagaacatcccgcggaatacggagagactagagctaaacggtaataacataaccagaattcacaaaaatgactttgctggtctaaagcagttgagggtgctgcagctgatggaaaatcaaatcggcgcagtcgagaggggggcttttgatgacatgaaggagctcgagcggctgcgcctgaaccgcaatcagctccacatgctccccgagctcctgttccaaaacaaccaagccttatcgcgattagatctcagtgagaacgcaatccaggctatccctcgaaaagccttccgtggggctaccgatcttaagaatcttcagctagacaaaaatcagatttcctgtatcgaggagggtgcctttcgagctctcagggggttggaagtgttaactctcaacaataataacatcacgaccatcccagtgtctagctttaaccatatgcccaaactgcgaaccttcaggctgcattccaatcacttattttgtgactgtcacctggcctggctgtctcagtggttacggcagagacctaccataggattgttcacccagtgttctggtccggcgagtctgcgcggcctgaatgtcgcagaggtccagaaatcagagttttcttgtagcggtcagggagaggccggacgagtgcctacatgtacactgagctctggatcctgtccggcaatgtgtacctgtagtaacggaattgttgactgtcgtggtaaagggcttaccgcaattccagcaaacctcccagagacaatgactgaaatcaggcttgagctgaatggtataaagagcatcccccccggagcgtttagcccttaccgtaagcttcgtcggatcgacctgagtaataaccagatcgccgagatcgcgcctgatgccttccagggacttcgcagtctgaacagtttggtcctgtatgggaacaaaatcaccgatctccccaggggtgtgttcggaggactgtataccttgcagctgttgctcctcaacgctaataagattaattgcatacgacctgacgcttttcaagatcttcaaaatctgtccctcctctctctgtatgacaacaaaatccagtccctcgctaaagggacctttacctcgttacgggctattcagactctgcacctcgcgcagaacccattcatttgtgactgtaacctgaagtggctggcagattttttgcgtacaaacccaatagagacaagcggcgcccgctgcgcatccccaaggcgcctggctaataagagaattggccaaattaaaagtaagaaatttcgttgcagtgccaaggagcagtatttcataccgggaacagaggactaccaactaaatagcgagtgtaatagcgatgtggtctgtccccataaatgccggtgcgaagccaacgtggtagaatgctctagtctgaagctgactaaaatcccggagcggattccacagtctaccgctgagctgaggctgaacaataatgagatcagcatcctagaagcgaccgggatgttcaagaagctgacgcacctgaagaaaataaatctctctaataataaagtgtcagagattgaggacggggcttttgagggcgccgcatctgtttcggagctccacctgacagcaaatcagctagagagcatacgcagcggcatgttcaggggcctcgatggtcttagaacgctgatgcttcgtaataacaggataagttgtatccacaatgatagtttcaccgggttgagaaatgtaaggctcctctccctctacgacaatcagatcaccactgtttcaccaggtgcgtttgataccctgcagtctttgtctacactgaacttgttggcaaaccccttcaattgtaactgccagttggcctggcttgggggatggctgcgtaagcgcaaaatcgtcacgggtaaccctagatgccaaaatcccgactttctgcgtcagatccccttgcaagatgttgcatttccagactttcgttgcgaagagggacaagaagaaggcggttgccttccccggccacagtgccctcaggaatgcgcatgcctggatactgtggtgcgttgcagcaataaacacctgagggccttgcccaaaggaatccctaagaatgtgaccgagctgtacctcgatggaaatcagttcactcttgtgcccggacagctgtcaacgttcaaataccttcaactggtagatctatccaacaacaaaatctcgtccttgtcgaatagttcattcacaaacatgtcccagttaactaccctaattctgtcttataacgccttacagtgcatccccccactggccttccaaggcctgcggagtctcaggctcctctcactgcacgggaatgacatttcaacactgcaagaaggaattttcgctgatgtgacaagcctttctcacttggcaatcggggccaaccctctgtattgtgactgccatctgcgctggctgagttcttgggtgaaaactggctacaaggagcctggtatagctaggtgtgccggtcctcaagatatggagggcaagcttctcctcacgacccccgccaagaagttcgagtgccagggacctcctacactcgccgtgcaggccaagtgcgatctatgtctttcatccccatgtcaaaatcagggcacatgtcacaacgacccactggaagtctatagatgcgcttgtccttcaggttataagggacgcgactgcgaggtaagtcttgacagttgctcttccgggccctgcgagaatggcgggacttgtcatgcacaagagggggaggatgcccccttcacctgttcttgccctacaggcttcgagggcccaacctgtggtgtcaataccgatgactgtgtagaccacgcctgtgccaatggtggtgtgtgtgttgatggagtgggtaattacacttgccagtgcccccttcagtacgaaggaaaggcttgtgaacagttggtggatctttgcagcccagatctcaatccctgtcagcacgaggcgcaatgtgtgggtactcccgacgggcctcggtgcgaatgtatgcctggttacgccggcgacaattgctcagagaatcaggatgactgtagagatcatcggtgccaaaatggtgctcagtgcatggacgaagtcaacagctactcatgtctctgcgctgagggttactccgggcaactgtgtgaaattcccccgcacctgcccgcacccaagagcccctgcgaggggacagaatgccagaatggcgctaattgcgttgaccaaggaaacagacccgtgtgccagtgtctgccgggattcggcggccctgagtgtgaaaaactgctttctgtcaactttgtagatcgagacacatatctacagttcaccgatctgcagaactggccacgcgccaacattaccctgcaggtgtccacggctgaagataatgggatactgctttacaacggtgataatgatcatattgcagttgaactgtatcaaggccatgtgcgcgtctcctacgaccccggctcatacccctccagcgccatttatagcgccgagactatcaatgatggtcagtttcatacagtggaactggttgcttttgaccagatggtgaatttatccatcgatggaggatcaccaatgacaatggacaatttcggaaaacactacacccttaatagcgaagcaccgctctatgtggggggaatgcctgtagacgtgaattcagccgcttttcgtctctggcagattctgaacgggacggggttccatggctgcataaggaacttgtatataaacaacgaactccaagacttcaccaagacacagatgaagcctggggtggtccctggttgtgaaccatgtcggaagctttattgcctgcatggaatctgtcagcccaacgctaccccaggacccatgtgccattgcgaggccggctgggtaggactgcattgcgaccagcccgctgacgggccttgtcacggtcataagtgcgtgcacggacagtgtgtgccgctcgacgccctgagctactcatgccagtgtcaggacggatattctggcgctctctgtaaccaggcaggcgccctggcagagccttgtcgggggctgcagtgcttacatggacattgtcaggcctcaggcactaagggggcgcactgtgtgtgtgacccaggtttctcaggagaactctgtgagcaggaatctgagtgccgcggtgaccctgtgagggacttccatcaagttcagagggggtacgctatttgtcagacgacacgccctctcagttgggttgaatgcaggggtagctgccccgggcagggctgctgccagggccttcggcttaagcggagaaagttcacattcgagtgctccgacggcacctcatttgctgaggaagtggagaaacccaccaaatgcggttgcgcattgtgcgcttag

SEQ ID NO: 5280 - DNA, 342 bp, Artificial Sequence
  Description of Artificial Sequence: Synthetic coding sequence
atggacagcaggcaggcagctgctctgttggtgctgttgttactgatcgacggcggatgcgcggagggcccaggtgggcagcaagaagaccagctctctgccgaggaagactccgaaccgcttccaccccaggacgctcagacctctgggtccctgctacactatctgctccaagcaatggagcgcccgggaaggtcacaggccttcctctttcagccgcagagatttggtcgaaacactcagggctcttggcgcaatgagtggctctcgcccagggcaggggagggactcaattctcagttctggagtttggcggccccccagcgcttcggtaagaaatag

SEQ ID NO: 5281 - DNA, 2568 bp, Artificial Sequence
  Description of Artificial Sequence: Synthetic coding sequence
atggctagacatctcctgctcccattggtaatgttagtcataagccctattcccggtgcattccaggactctgctctgtccccaacccaggaggaaccagaggatttggactgcggacggcccgagccatctgcaagaatcgtaggtggctccaatgcccagcctggtacatggccctggcaggtatctcttcatcacgggggaggtcatatctgtggtgggtcattaatcgctcctagttgggttttgtcagctgctcattgtttcatgaccaacggcaccctcgagccggcggcggagtggtccgtgttgctcggtgtacatagccaggacggacctctggacggagcacatacacgcgccgtggcagccatagtcgttcctgcaaattactctcaggtcgaactgggcgctgacttggccctgctacggctggcttctcccgcctccctgggccccgccgtgtggcccgtgtgcttacctcgggctagccaccgcttcgtgcacggtactgcgtgctgggcaaccgggtggggcgatgtccaggaggccgatcctctcccacttccctgggtgttgcaggaagtggaattaagactgctcggcgaggccacctgccagtgtctgtatagccaacctggcccattcaatcttacattacagatccttcctggaatgctgtgcgctggctacccggaaggccgacgggacacctgccaaggagatagtggggggcccctggtctgcgaagagggtggaagatggtttcaggccggaatcacaagctttggattcggttgtggcagacgcaataggccaggggtgtttacagctgtcgctacgtacgaggcatggattcgtgaacaggtgatgggctccgagcccggtcccgccttccctacacagccgcaaaaaacccagagtgacccgcaggagccacgcgaggaaaactgcactattgctctcccagagtgcggaaaagcaccacggcccggagcatggccctgggaagcccaggtgatggttccaggatctagaccctgtcacggcgcgctggtgtccgagagctgggtcctagctccagcctcatgcttccttgatcctaactcatctgactcgccaccccgggatttggacgcctggagagtgctgctgcccagtagacctcgggctgaaagagtggctagattagtgcagcacgagaacgcaagttgggataatgcttccgacctagccttactgcaactacggacccctgtaaatctctccgcggccagcagacctgtatgccttccccatcccgaacactacttcctccccgggtcacgttgccgcctggcccgctgggggcgcggcgagccggctctggggccaggtgctttgcttgaggccgaattattggggggctggtggtgccattgtttatacggacgtcagggtgctgcagtgcccctgcccggtgaccctcctcatgcactctgcccagcatatcaggaaaaggaagaagtaggaagctgttggaatgactcacgctggtcacttctgtgtcaggaggaagggacctggttcctcgccggcatccgcgactttccgagtggttgcctgcggccaagagccttttttcccttacagacccatggcccttggatttctcatgtaacaaggggtgcatacttagaggatcaactggcgtgggactgggggcccgatggcgaggagaccgagactcaaacctgtccgccacatacggagcacggtgcatgcggacttagactagaagcggctcctgttggggttctgtggccgtggcttgctgaggtgcatgtggcaggcgatcgcgtctgcaccggcatcctgcttgcccccggctgggtactcgcagctacgcactgcgtcttacggcctggaagcactaccgtgccttatatcgaagtatacctcggacgggccggagcctctagcctgcctcaggggcatcaagtgtcacgtctcgtgatttccatccggctgcctcagcatttggggttgaggcccccactggccctcctcgagttatcgtctcgagtggagcccagccccagtgctcttcctatctgtttacaccccgccggcatcccacccggcgcttcatgttgggtgctgggatggaaagaaccacaggacagagttccggtggcggctgctgtgtccattctgacccaaagaatatgcgactgcctgtatcaggggatcctcccaccgggtactctgtgcgttctttatgctgaaggccaggagaatcggtgtgaaatgacgagtgctccccctctgctttgtcagatgactgagggcagctggatcctggtgggcatggccgtacagggtagcagagaactgtttgctgctatcggccccgaagaggcgtggattagccagactgttggcgaagcaaactttctgccaccttccggctcaccccattggccaacaggaggttccaacctgtgcccgccagaactggccaaggcaagtggtagtccccatgctgtgtacttcttactgctcctgacccttttgatccaatcttag

SEQ ID NO: 5282 - DNA, 912 bp, Artificial Sequence
  Description of Artificial Sequence: Synthetic coding sequence
atgttacatcctgagacctcacccggacgaggacatctcctggctgtgctgctcgcgcttctgggaactacgtgggctgaggtctggccgccccagctacaggaacaggctccaatggccggtgcacttaaccgcaaggagagcttcctcctgttgagcctccacaacagactgcgatcctgggtgcagccacctgctgccgacatgcggaggctggactggtcagatagcctggcccagcttgctcaggcaagggctgccctatgtggcatcccaacaccttcccttgcatccggtctgtggcgcaccctacaagtcggctggaatatgcagctattacctgcaggactcgccagctttgtcgaggtggtgagtctatggttcgctgagggacagcgatatagccatgccgcaggtgagtgcgcacggaacgctacatgcacccattatacacagctggtttgggccacctcttctcagctgggatgtggaaggcatctgtgcagcgccggacaaacggccatagaggctttcgtgtgtgcctactctcctagaggaaactgggaggtcaacgggaaaaccattattccctacaaaaaaggtgcatggtgcagcttgtgtaccgcctctgtaagtggttgctttaaagcttgggatcacgcaggaggactgtgcgaggttccgcggaatccctgtagaatgtcctgtcagaaccacggtaggctgaatatcagcacgtgtcactgtcattgtccccctggctacaccggccggtattgccaagtcaggtgcagccttcagtgcgtccatgggagattcagagaggaagagtgctcgtgtgtgtgtgatatcggatacggcgagccctccgtgcctcctagatgtatctttccctctacccccgtgacctag

SEQ ID NO: 5283 - DNA, 1158 bp, Artificial Sequence
  Description of Artificial Sequence: Synthetic coding sequence
atgaagatgcttcctggagttggtgtgttcggaacaggatcctctgcccgggtgctggtacctctgctgagagccgagggcttcacggtagaggccctgtggggtaagacggaagaagaagccaaacaactggccgaagagatgaatatcgctttttacacatctcggacggacgacatcttactgcaccaggatgtggacctggtgtgtatatctatcccccctcccctcacgaggcagatctctgtaaaggcactggggattggcaaaaacgtggtttgtgagaaggcagccacctccgttgacgcttttcgcatggtgacagcttcaaggtactaccctcaattgatgtctctggtgggcaacgtgttgagatttctaccagctttcgtgaggatgaagcaattgatttctgaacactatgtaggtgccgtgatgatttgcgatgcacgtatttattccggaagtcttttgagcccctcctacggctggatttgcgacgagctaatgggaggcggcggactccatacgatgggcacctacatagtggatcttctgactcacctgactggcaggcgcgccgagaaggtgcacggcctgttaaagacatttgttcgccaaaacgcggctattcgtgggatccgccacgttacatcagacgacttttgttttttccagatgcttatgggcggcggggtgtgtagcaccgttaccctgaatttcaatatgcccggcgcattcgtgcatgaggttatggtcgttggaagcgctgggcggctggtggcccggggcgcggacctctacgggcagaaaaactccgctacccaggaggagctcctgctgcgtgacagcctcgcggtgggcgcagggttgcccgagcagggccctcaggacgtccccctcttatatctgaagggaatggtgtacatggtccaggccctgagacagtctttccaaggacagggagatcggagaacttgggacagaacccctgtgtcgatggcggcctcttttgaggacggactgtacatgcagtccgttgtggacgcaataaagcgttcgtctagaagcggggagtgggaggccgtggaagttctgactgaggagccagatacaaatcaaaatctgtgtgaagccctccagaggaacaacctgtag

SEQ ID NO: 5284 - DNA, 1470 bp, Artificial Sequence
  Description of Artificial Sequence: Synthetic coding sequence
atgccagtgactttcgccctgctgttgctactaggccaggccacagctgatccgtgctatgacccgcagggacgacctcagttttgcctcccgcctgtcacccagctagcggcggtcgctgcatcctgtcctcaagcctgcgctctgtctccgggaaatcacttgggcgctcgggaaacgtgcaacgggagcttgacactggcgctaggaggcccatttctgttaacgagtgtgtccttgaggttctgcacccctgggcctcctgccttaatactatccgcagcatgggcttccgggggcccctggaggctgctctggcaccgccccgcatggccgggggccctgggcggacccgagagggtcacttttcactctacccccggcccgaaggccactgttgctgcgtctcacttgcgtgtggagttcggcggacaggcgggacttgctgctgctggactgcgaggaaggtgtcaatgccacggacatgcagctagatgtgctgctagagcaaggcctcctcggtgccactgccggcatcatactacgggtcctggttgcgaaagttgccggccgagtcatagggactggccatggaggcccgccactcccaggcacccacacccatgcctgccctgcagttgtaaccagcacgcccgccggtgtcgttttaactcagagctgttccgcctgagcggggggagatcaggcggggtgtgtgaacgttgcagacatcatacggcgggccgacactgtcactattgccagccaggcttctggagagacccttctcagcctattttttcccgccgggcctgccgagcttgccagtgtcatcctatcggggctactggggggacttgtaaccagacttcaggccagtgtacatgtaaattgggcgttacaggcctcacctgcaaccggtgtggtcccgggtatcagcagtcaaggtctcctaggatgccttgtcagcggattcctgaagcaaccactaccctggcaacaacgccaggtgcctactccagcgatccccagtgccaaaattattgtaatatgtctgataccagagtgcacatgtccctgaggcggtattgccagcaggaccacgtgctcagggcacaggtactggcttcagaagcggcgggaccggcttggcagagactagccgtgcgcgtgctggccgtctataagcagcgggctcagccagtgaggcgtggcgatcaggacgcatgggtgcctcgcgcagacctgacatgtggatgtttgcggttgcagcctgggacagattacctgttgttaggcagcgccgtcggggatcccgacccaaccagactaatccttgatcgccacgggcttgctttgccctggcggccccgttgggcgcgccccctgaaacggctgcagcaagaagaacgcgccggcggatgccgaggcgtgcgagcacctacaccctccccacgacccgaacactag

SEQ ID NO: 5285 - DNA, 8430 bp, Artificial Sequence
  Description of Artificial Sequence: Synthetic coding sequence
atgacacttgaaggtctgtacctcgctcggggaccactggctagactcttgcttgcatggagtgctctattgtgcatggccgggggacaggggcgatgggatggtgcactggaggctgccgggcccggcagagtacggcgccgcggaagcccagggatcctccagggccctaacgtgtgcgggagcagattccacgcatattgttgtcctgggtggagaacattccctggacgttcacagtgcgtagtgcctatatgccgcagagcttgcggagaaggcttttgttcgcaacctaatttatgcacctgcgctgatggaaccctggcaccttcatgtggagtatccagaggctcaggttgttccgtctcctgcatgaacggcggtacatgtcgtggagcctcctgtctctgccagaaaggctatactggaaccgtttgcggccaaccaatatgcgacagaggttgccacaatggcggaagatgcattgggccaaatagatgtgcatgcgtgtacggatttatgggaccccagtgtgagagggattaccgcaccgggccttgctttgggcaagtcggaccagagggctgtcaacaccagctcaccggactggtttgcacaaaggctctctgttgtgccactgttggccgggcctggggactgccatgcgaactgtgcccagctcagccccacccatgtagacgcggcttcatcccgaatattcacaccggggcctgtcaagacgtggacgaatgtcaggccgttccggggctctgtcaaggaggtagctgtgtgaatatggtgggatccttccactgtcggtgtccagtcgggcacaggttatctgactcaagtgcagcgtgtgaagactaccgggcaggggcatgttttagcgtgcttttcggaggccgctgcgccggggatcttgctggccattacacgcgtcgccaatgctgttgtgaccggggtcgatgctgggctgcaggaccagtcccagagctttgcccccctaggggctccaacgagtttcagcaactgtgtgcccaacgcctcccactcctgcctgggcaccctggactcttcccaggtcttctgggattcggaagcaatggaatgggccctcccctagggcctgcgcgcctcaatcctcacggctccgacgcccgggggatcccctccctggggcccggcaatagcaacattggtaccgcgaccttgaatcagacaatcgacatttgtcggcattttactaacctgtgtcttaacggccgctgcctccctacgccctcttcctacagatgtgaatgcaatgttggctacactcaggacgtcagaggcgagtgtatcgacgtggacgaatgcacatcctccccatgccaccatggagattgcgtgaacatacctggaacttatcattgccggtgttatcctggatttcaagcgacgccgacccggcaggcttgcgttgacgtggatgagtgtatcgtgtccggcggactgtgtcacctcgggagatgcgtcaataccgagggctccttccagtgcgtttgcaacgccggcttcgaactctcacctgatggaaaaaactgcgtggatcacaatgaatgtgcaaccagcacgatgtgcgttaacggtgtttgcctaaatgaagacgggtcgttcagctgtctatgtaagcctgggttcctcctcgcccctggcggacattattgtatggacatcgacgaatgccagacacccgggatctgtgtcaatggccattgcacgaacactgagggatccttcagatgccagtgcttagggggcttagccgtgggaacagatgggagagtatgtgtggatacacacgtaaggtccacatgttacggtgcgatcgagaaagggagctgtgcccgtcccttccccggtactgtcactaaatccgagtgttgctgtgcaaatcccgatcacgggtttggggaaccatgtcaactttgtccagcgaaggattcagccgaattccaggctctgtgctcatctggcctgggcattacgaccgatggcagggacataaacgaatgcgccctagaccctgaggtatgtgcgaacggcgtgtgtgaaaaccttcgggggtcctatcggtgcgtgtgtaatctgggatatgaggcaggagcaagcggaaaagactgtacggacgttgatgagtgcgctctgaactcgttactctgcgacaacggctggtgccaaaattcgcctggttcttactcctgcagctgtcctcccggcttccacttctggcaggatacagagatatgtaaggatgtcgatgaatgtttgagcagtccctgtgtaagcggggtgtgccgcaacctggccggatcttatacttgtaaatgtgggcctggaagtagactagacccgagcgggactttctgcctggatagcaccaaaggtacctgctggctgaaaattcaggagtccaggtgcgaggtgaacctccagggcgcctctctgcgttccgaatgctgcgctacccttggagcagcctggggaagcccttgtgagcggtgtgaaatcgaccccgcatgtgctcgtggcttcgccaggatgacaggagttacctgtgacgacgtgaacgaatgcgagtcctttccaggcgtgtgtccaaacggacggtgtgtgaatactgccggatcattccgctgtgaatgccccgagggccttatgctggatgcttcaggacggttgtgcgtagatgttcgcctagaaccctgcttcttacggtgggacgaggatgagtgtggagtcacgcttcccgggaaatatcgcatggatgtttgctgttgctcaattggtgccgtgtggggggtcgagtgcgaagcgtgcccagaccccgaatctctggagtttgcaagtttgtgtccgcgcgggctgggattcgcttcccgagattttttgtccggcagaccgttttataaagatgtgaatgagtgcaaagtgttcccaggactgtgcacccacggcacgtgccggaatacggtgggatcttttcactgcgcctgtgccggagggtttgccctggatgcacaagagcggaactgtaccgacatagatgaatgtaggatctctcccgatctgtgtggacaaggtacttgtgtgaatactcccgggagttttgagtgcgagtgcttccctgggtatgaatcaggattcatgctgatgaaaaattgtatggacgtggacgaatgcgcacgcgatcctcttctatgccgtggaggcacctgtacaaacacggacggctcctacaaatgtcagtgtcctcccggccacgaacttacagcaaagggcactgcctgtgaggacatcgatgaatgttcacttagtgatggcctgtgcccacatgggcagtgcgttaatgtcattggagctttccagtgtagctgccacgcaggtttccaaagcaccccagacaggcaggggtgtgtcgacatcaatgagtgtcgggtgcagaatggaggatgcgacgttcactgtattaacaccgaagggagttacagatgctcatgcggacagggttattcactaatgccagacgggcgtgcctgcgctgacgtcgacgagtgtgaggagaacccaagagtctgtgatcagggacactgtacaaacatgccaggggggcacagatgcttatgttacgatggtttcatggccacccccgatatgcgtacatgcgtggacgtggacgagtgtgacctcaatccccacatatgcctgcacggcgactgtgagaacacaaagggatcttttgtttgtcattgccaacttggctatatggtccggaaaggagcaacaggctgttctgacgttgatgaatgtgaggttggcggtcataattgcgatagccatgcttcatgcctgaatattcctggctctttttcttgccggtgtttacctgggtgggtgggggacggtttcgagtgtcacgatttggatgagtgcgtcagccaagagcatcgatgctctccgaggggtgactgtctaaacgtacccgggtcctataggtgtacatgccggcagggctttgccggagacggcttcttctgcgaggatcgggatgagtgcgccgagaatgtggatctgtgcgataacgggcaatgtttgaacgccccaggaggctacagatgcgagtgcgaaatgggctttgacccgacagaagatcaccgagcatgccaggatgtagacgagtgtgcacagggtaatttatgtgctttcggttcttgtgagaacttgcctggtatgtttagatgtatttgcaacggaggctacgagttagataggggcggcggcaactgcacagacataaatgaatgtgcggaccctgtgaattgtatcaatggcgtttgtattaacacaccaggatcttatctgtgcagttgcccccaggatttcgagctgaaccccagcggcgtaggctgcgttgatacccgcgcgggcaattgctttctggaaactcatgaccggggtgacagcggcattagctgctctgctgaaataggggtgggcgtgacaagggcaagctgctgctgctcactcgggagggcttggggcaatccctgtgagctctgcccgatggccaatacaaccgaataccgcaccttgtgtccaggaggagaaggatttcagcctaaccgaattacggtgattttggaggatattgacgaatgtcaggagctgcctggcttgtgccagggcggtgactgtgtcaatacttttggtagctttcagtgcgagtgcccacccggatatcatttgtccgagcacacacgcatctgtgaagatatcgatgaatgctctactcacagtggaatctgtggtccaggaacatgctataatacacttgggaactatacttgtgtctgtcccgccgagtatctgcaggtcaatggagggaacaactgtatggatatgcggaagtccgtgtgttttcgccattacaacgggacatgccagaacgaactggccttcaacgttacacgcaaaatgtgctgctgcagctacaacattgggcaagcctggaatcgcccttgcgaggcctgcccgacccccatctcacccgactaccagatactgtgcggaaatcaagcccccggctttctcactgatatccatacaggaaagcctttggacatcgatgagtgtggcgaaatcccggctatttgcgccaacggtatttgtataaaccaaattggcagctttagatgtgagtgccccgctggcttcaactataacagcatattgcttgcctgcgaagatgtggacgagtgtggtagtagggagagcccatgccagcagaatgccgactgtatcaatatcccaggttcctacaggtgtaagtgcacccgggggtacaaactgtctcccgggggtgcctgtgtgggcaggaacgaatgtcgcgagatccctaacgtctgttctcatggggattgcatggataccgagggcagttatatgtgtctctgccatcgtggtttccaggcgtctgcagaccagacactctgtatggacatcgacgaatgcgacagacagccatgcggaaacggtacgtgtaaaaacatcattggatcatacaattgcctatgttttcccggatttgtagtgacccacaacggggattgcgtcgatttcgacgagtgcaccacactggtgggacaggtctgtaggttcggccattgcctcaatacagctggatcttttcactgcttatgccaggatgggttcgagctgacagctgacggtaagaattgtgtcgacacaaacgagtgcctgagtctggctggtacatgtctccccggaacctgccagaacttagagggttcctttagatgcatttgccccccaggcttccaggtacagtctgatcactgcatagacattgacgagtgttctgaggagcccaatctgtgcctgttcggtacctgtactaactcccccggatctttccagtgcttatgccccccgggatttgttttatcagataatggccatcggtgctttgacactcggcaatccttctgtttcaccagattcgaagctggcaagtgctcagtgccgaaagcatttaacaccaccaagacccgatgctgttgctctaagaggcctggagagggttggggcgatccctgcgagctctgccctcaggaaggtagtgccgcatttcaggagctttgcccattcggccacggcgccgtgccaggtccagacgacagtagagaagatgtcaatgaatgcgcggaaaatccgggagtctgcacaaatggagtgtgtgtcaataccgatggatcgtttagatgcgaatgcccattcggatattcactggacttcaccggaattaattgcgtcgatacggatgagtgctccgtcggtcatccctgtggccagggcacctgcacaaatgtgattggggggttcgagtgcgcatgcgcggatgggtttgagcctggcttaatgatgacttgcgaggatatcgatgaatgcagcctgaaccctctcctctgtgcattccggtgtcacaatactgaggggtcttacttgtgcacatgccctgctggatacaccctcagggaagatggggccatgtgtagagacgtggacgaatgtgcggacggccagcaggactgtcacgccagaggaatggaatgcaagaatttgatcggtaccttcgcttgtgtgtgcccccctgggatgaggcctctgcccgggtccggggaaggctgcactgacgacaatgagtgccatgcgcaacctgatctgtgcgttaacggtcggtgcgtgaatacagcaggttctttccgctgcgattgcgatgaaggatttcagccttcccctacacttactgagtgtcatgatatcaggcaaggcccatgttttgctgaagtgctacagacaatgtgcagatcgttatctagctcgtcagaggcagtgaccagggcggaatgttgctgcgggggtggcagagggtgggggccaagatgtgaactctgcccactgccaggtacatctgcctaccggaagctgtgccctcatggatccggatataccgctgagggccgggacgtggatgagtgtagaatgctcgcccatctatgtgcacatggagaatgcattaactcactggggagctttaggtgtcactgccaggcagggtacacacctgatgccaccgcgaccacctgtctggacatggatgaatgcagccaggttcctaagccctgtactttcctgtgcaagaacactaaggggtcattcctgtgttcctgcccgagggggtatttgctggaagaggacgggaggacatgcaaggacctggatgagtgtacttccagacaacacaactgccagtttctgtgtgtaaacactgtgggagcttttacgtgtcgatgccccccaggcttcacacagcaccaccaagcctgctttgacaacgacgagtgctccgctcaacctggtccttgtggagcccatggacactgtcataatacgccaggctccttccgctgcgagtgtcaccagggtttcacactggtgtcatctggacatggctgtgaggacgtgaacgagtgcgacggcccccataggtgtcagcacggttgtcaaaatcagctcgggggttaccggtgtagttgtccccaagggttcacacagcacagtcagtgggcccagtgcgtagatgagaacgagtgtgccctgtcacctccaacctgcggctctgcctcttgtaggaatactctgggcgggttccggtgcgtctgcccatcaggctttgacttcgaccaagccctaggcggctgtcaggaggttgacgaatgcgccggacgccggggcccctgtagttacagttgcgcaaatacccctggaggattcctgtgcgggtgtccccaagggtattttcgtgcgggacaaggtcactgtgtttctggattagggttctcccctggtccacaggacacacctgataaagaagagcttctcagtagcgaagcctgctacgaatgtaaaatcaacgggctgagccctcgggaccgcccacggcgttctgctcaccgtgaccatcaggtgaacctggccactctcgactcagaagcgcttctaacactagggctgaacctgtcgcatctcggcagagcagaacgcatccttgaactgagacctgcactcgaggggctcgaaggacggatacggtatgtgatcgtaagaggcaacgaacaaggcttctttagaatgcatcaccttagaggcgtgtcgtccttacagctgggacgcaggcgacctggtcccggaacttacaggttagaagtcgtgagccacatggccggcccctggggagtccagcccgaagggcagccagggccctggggacaagcacttagattgaaagtgcagttgcagctactctag

SEQ ID NO: 5286 - DNA, 303 bp, Artificial Sequence
  Description of Artificial Sequence: Synthetic coding sequence
atggagaccagacaggtttctcgctcccctcgagttcggctgctgctgctgctcctcctcctcctggtggtgccctggggggtgagaacagcgagcggggtcgccctcccccctgttggagtgctctccttaaggccacccggaagagcctgggcggatcctgcaacgccgagacctaggcgatccctcgcactcgccgacgacgctgcctttagagaaagggcccgtctgctcgccgcattagagagaaggcactggttgaacagttacatgcataagcttctggtcctagatgctccgtag

SEQ ID NO: 5287 - DNA, 1404 bp, Artificial Sequence
  Description of Artificial Sequence: Synthetic coding sequence
atgtggcgttgccctctgggtctgctgctacttctcccattggctggtcatttggccttgggcgcccagcaaggcagaggacggcgagaactggcccctggtctccacctgcggggcatcagggatgccggaggccgttactgccaggagcaggatctttgctgtcgaggcagagcagacgattgtgccctcccatatttaggggcaatttgctattgtgatctattttgcaaccgtactgtctccgactgttgccccgacttttgggatttctgcctgggcgtgccaccaccgttcccacctatccagggctgtatgcatggaggccgcatctaccctgtactgggcacctactgggataactgtaacaggtgcacctgccaggagaaccgtcagtggcaatgcgaccaggaaccgtgcttggttgaccccgacatgatcaaggccattaaccagggtaactacggatggcaggccggcaaccatagcgcgttttgggggatgactttggatgaaggcattcgataccgcctcggaactatccggcctagctcatcggtcatgaacatgcacgagatttatacggttctcaacccgggcgaagtgctcccgaccgcattcgaagcgtcggaaaagtggcctaacttgatccacgagcccctcgatcagggtaactgcgctgggtcctgggcatttagcacagcagcggtagctagcgaccgggtgtccatccatagtcttggacatatgacaccggtgctttctccccagaatttactgagttgcgacactcaccagcaacagggttgtcgcggcgggcggttggatggcgcttggtggtttctccggaggcggggagtggtctccgaccactgttatcccttctctgggagagaacgcgatgaggccggccccgcacctccctgtatgatgcactccagggcgatggggcgcgggaagcgccaggcaacagctcactgtcctaatagttacgtaaacaataatgatatttatcaggtgactcccgtgtaccgactggggtctaatgataaagaaatcatgaaagaactcatggagaacggccccgtacaagcgctcatggaggttcatgaggatttcttcctatacaaaggaggaatctatagccacacgcccgtgagcctcggaaggccagagcgatacaggcgtcacggcacccattcagttaagatcacaggttggggggaggaaactctgcccgacggcagaactcttaagtattggaccgctgcgaattcctgggggcctgcatggggggagcgcgggcactttcgtatagtgagaggggtgaatgagtgtgatatcgagagcttcgtccttggagtgtggggtagagtcggtatggaggatatggggcatcattag

SEQ ID NO: 5288 - DNA, 2205 bp, Artificial Sequence
  Description of Artificial Sequence: Synthetic coding sequence
atgttttacgtctgtagctcttgcgtgttcctgtgtgggtccaacttccctaatttcccttttcaggttgcctctgcgaaatcagcacccgagatccccacgattgatcaagcatatagcaagctgagcaactccatcacggtggagtgggctactgtccccggagccacatcttacctgctcaccgcggaggacggagatacagtaatagagacaacagttgcaaactcccccggcacagtcacaggcctgaaggctgcaacttggtatgagatcactattagatcaataagtgcagcgggaagatcacaggcctccccaccaaaacaggctaagaccgtgctggcagcaccaatcttggaggttagttccccatcctccgacagtatcctcgttcagtgggaggctgtctacatggcgatcgccttctccgtatccatcatgcgagcaaacggcttaggaagcatttggaaggaaaataccaccaatacttcgctcacctttacttccctcgaagccggcaccctttatacaattaaagcctacgcttggaatgctaacaggattcccggcgacgatagcacttgtaatcagcgtacatcccccagagcccccgctaacattcaggtgtcctttgactcaggtgccctcaaggcgtcattttcttgggcgagagctgagggggcattcaattataccgtgatggctctctccgacagttcggagcttacctgcagcacaactttcagctcctgcacgatctcctctctgcagtgtggcacggagtaccttatcagcgtgctcgcatccaacgatgctggaagttccaagtcttcctcagccatgaccctgaaaactgttgcctgcgctcctggcagggttacgattcaggaagaccctcccgggcatttgtctgtcgcgtggagctcggtcgacctgggagactattatgtggtgttcgtcaagtctgacgacggcttggaagtgcattgcaacacctcactgacccagtgtaatttcctgtccgaatgcggtttcacatacttcatctcagtgttcgtatacaataaggcagggcagtcccccctgggcgacatatttaactacactaccgcaccttgttgcccctccgatattaaccccgtcctcgtttcctccgatcgcgttgagattgtttggtccccagtgaggggtgctgagctttacgagacgaaagccgtagacgggtacaacatggtcgagtgcaacgatactacccccgcgtgtacgctttcagctctagagtgcgacaccaaatacaatatcaccgtatattcttttaacgaagtgaggggaagcaacatgtcttgtaccccacagtttattaccaccgcgccatgtagtccggagattaagaatgtgtccagagatgccttctccatgatcaacgtgcattggagaagcacgaatgatgatgctacatataccgtcaccgctcaaggtgaaaaaggcttgtatcaatgctcctcgaccggggaatcttgcacgatgcgcgggctcccttgcggatctgttttttctgttaccgccgtagcagaaactcaggcaggccgttcactgccctcctattccgtcccattggaaaccgtgccatgttgccccactggcttgaccgtcacgcaaataacacagtccgtgattaatgtgtcttggacaatcggacgcgttgcccagacacacgtggcagtgttggaatcccatacgggccagagcaaatgccatacacaccagaaccattgtctcctcggatgtattacatgtggcatcaattacaccgtgacccttaaagctatcagtgccaccggtctgaccgccgattgttcatatcagtcctacttcagtggcgcttgctgcccgctgggggtgaagctataccgcctggggcccaatgggattcgcatctactggcaggcaagccgcgggtccgctaactattcgacagatttatacggttctaaagggatctttacctgcactccaagcgcaggtctgagcttctgtgatgttactgagatcccttgcggtgacgtctacactgtcatggtgtctccggtggccaaaaccggactgaaattaacattttgccccaaaaaaatttattcagtgacctgtagtggttctactcttggcatggtgatttaccggggcaagagaaatgaggagtag

SEQ ID NO: 5289 - DNA, 1098 bp, Artificial Sequence
  Description of Artificial Sequence: Synthetic coding sequence
atgctggatggttcacctctagcacggtggttggcagccgcgtttggcttaacgctgctgctggcagcgcttcggccttctgcggcctacttcggactgactggaagcgagcccctcaccattttgccactgaccctggagcctgaggcagccgctcaggcacactacaaggcttgcgatcgcctcaaattggagcgtaagcagagaaggatgtgccgcagagaccccggtgtggcggagactctagtggaggccgtgtccatgtctgcattggagtgccagttccagttccgcttcgaacggtggaattgcactctcgagggcaggtatagggcctcactgttgaagcgcggattcaaagagactgccttcctctacgcgatcagcagcgcggggctgactcacgcgctggctaaggcctgttcagcaggccggatggagagatgtacctgtgacgaagcccctgatctagaaaaccgggaggcatggcagtggggcggttgtggagacaatctgaaatactcatcaaagtttgtgaaagagtttttgggaaggagaagcagcaaggatctccgggcccgggtcgatttccataacaacctggtgggcgtgaaagtcattaaggcgggtgtcgaaacaacatgcaagtgccacggagtgagtgggagctgtacggtccgcacctgttggcgtcagcttgcaccctttcatgaggtgggaaagcatctgaagcacaagtacgagaccgccctcaaggtgggatcaactaccaacgaagctgcaggggaggctggcgccatttcacctccacgcggcagagccagcggcgccggcggcagcgatccacttccaagaaccccggagctcgtccatttggatgattcaccaagcttttgcctcgccggcaggttctctcccggaaccgcagggagacgctgtcacagagagaagaattgcgaatccatttgttgtggacgaggacacaacactcagagtagagtagttacccgcccctgtcagtgccaggtgaggtggtgttgttacgtcgagtgcaggcaatgcacgcagagggaggaggtgtacacgtgcaaaggatag

SEQ ID NO: 5290 - DNA, 795 bp, Artificial Sequence
  Description of Artificial Sequence: Synthetic coding sequence
atgcgcctgaggcctttacctctggtggttgtgccaggtctgctgcaactgctgttctgcgatagtaaggaagtggttcatgccaccgaaggcctggattgggaggataaggacgcacctggaaccctggtaggaaacgtggttcatagcagaatcatctcccctctccgtttgtttgtaaaacagtcacccgtaccaaagccaggtcccatggcttatgcagatagtatggaaaacttctgggactggctggcgaatattactgagattcaagagcctctggcccgtactaagaggagaccaattgtgaagaccggcaaattcaagaaaatgttcggatggggggactttcatagcaacattaagactgtcaagctgaatctcctgatcacagggaaaattgtggaccatgggaacgggaccttcagtgtgtactttcgacataatagtactgggctgggcaacgtgtccgtctctctggttccccctagtaaggtcgtagaatttgaggtcagtccacagagcacgttagagacaaaggagtccaagtcttttaactgccgcatcgagtatgagaagacggaccgcgctaagaagacggctctgtgcaatttcgatccttccaaaatttgctatcaggaacagactcagtcccacgtgtcgtggctgtgctctaagccctttaaggtcatatgcatctatatcgcattttatagcgtcgattacaagctggttcagaaggtttgtcctgactataactaccatagcgagactccgtacctgagcagcggctag

SEQ ID NO: 5291 - DNA, 1125 bp, Artificial Sequence
  Description of Artificial Sequence: Synthetic coding sequence
atgaagcctctactggagacgttgtatctgctggggatgttggttcctggaggattgggctacgaccgctccctggctcaacacagacaggaaattgtcgacaagtccgtttccccatggtccttggagacatatagctacaatatctaccacccaatgggagaaatctatgaatggatgagagagatctctgagaagtataaagaagtagtgacacagcactttttgggggtcacttatgaaacacatccgatgtactacctgaagatctcccaacccagtggtaatcccaagaaaataatctggatggattgcggcatccatgcacgggagtggatcgcgccggccttttgtcagtggtttgtgaaggaaatactacaaaaccacaaggacaacagctcaatccgaaaactcctgcgaaacttagatttctacgtattgccggtccttaatattgacggttacatttacacgtggacaactgaccgactctggaggaagagcagatcccctcataataatggtacttgtttcggcacagatttgaaccggaattttaatgcaagttggtgctcaataggtgcctcccgtaactgtcaagatcaaaccttctgcggcacagggccagtctccgagcccgagaccaaggcagtagcctcctttatcgaatcaaagaaggacgacatcctgtgcttcctgactatgcatagttatggccaattaatactgacgccctacggttatacaaagaataagtccagcaatcaccctgagatgatccaggtgggtcagaaagcagctaatgccctgaaggccaagtatggtaccaactatagagttgggagtagcgccgatatattgtatgctagcagcggaagtagtcgggactgggccagggatatcggaattcctttcagctatactttcgagttaagagatagcgggacttacggtttcgtgcttcccgaggcacaaatccagcctacctgcgaagagaccatggaggctgtgctgagtgtactggacgatgtgtacgccaagcactggcactcagactccgcaggccgcgtcacctctgccaccatgcttctcggtctccttgtgtcctgcatgagtctgctttag

SEQ ID NO: 5292 - DNA, 1728 bp, Artificial Sequence
  Description of Artificial Sequence: Synthetic coding sequence
atggcttcttggctcagaagaaaactgagggggaagagacggcctgtgattgccttttgtttgctgatgatcctgtctgctatggcagtgacacgatttcctcctcagcgcccgtctgccgggcctgatcccgggcccatggaacctcagggagtgactggggctcctgctactcacattagacaggccctgtcgtccagtcggcgccaacgcgcgcgtaacatgggattttggagatcacgagcattgcccagaaacagcatccttgtgtgtgctgaggaacagggtcatcgggcgagggtcgatcgttcacgcgagtctccgggaggagacctgcgccatccgggtagagtgaggcgagacattacgctgagcggtcaccccagattgagcacacagcacgtcgttctgctccgtgaagatgaagtgggggatcctgggaccaaggatctgggccaccctcaacacggatcacccattcaagagactcagtcagaagtggtgactcttgtttccccactgccgggatccgacatggccgccctacccgcatggagagccacatcaggcctgacactatggcctcacactgctgagggccgcgatctcctgggtgcagagaaccgggcgctcactggaggtcaacaggcagaggaccccactctagccagtggggcccaccagtggcccggcagtgtggaaaaactgcaaggtagtgtgtggtgtgacgcagaaacactgcttagctcttcgcggaccggcggtcaggcccctccctggctgacggaccatgatgttcaaatgctgaggctcttggcacaaggagaggttgttgacaaagctcgtgttcctgcgcatggccaggttcttcaagtgggcttcagtaccgaggccgccctccaggacctctcctcccctcgcctgagtcagctgtgtagccaggggctgtgtggtttgattaaacgaccgggcgatctgcccgaagtcctgtcgttccatgtagaccgggttcttggtttgcggaggagccttcctgccgtcgccaggaggtttcactcacctcttttgccctaccgttatacagatggcggggctcgcccagtgatttggtgggcccctgacgtgcagcatctgtccgacccagatgaggaccaaaacagcctggctctgggatggctacagtaccaggctctactggctcacagctgtaattggccagggcaggcaccctgtccagggattcatcatacggagtgggccagactcgctctctttgattttctgctgcaggtccacgaccgactcgatagatattgctgtggatttgagccagagcccagcgacccatgtgtcgaagaacgtctgcgggaaaagtgtcagaaccccgctgaactccgtttggtgcatatcctggtgcgatcctccgatccatcccacttggtttacattgacaacgccgggaacttgcagcacccggaagacaagcttaatttccggctcctggaaggaattgatgggttccctgagtctgccgtaaaggtgctggcgtccggctgtctccagaacatgctgctgaaaagcctccagatggatcccgtcttctgggagtcacagggtggggctcaaggtttaaagcaagtgctgcagaccttagaacagcgcggccaggtgcttcttgggcacatccagaaacacaacctcacactgttccgggacgaggacccctag

SEQ ID NO: 5293 - DNA, 1680 bp, Artificial Sequence
  Description of Artificial Sequence: Synthetic coding sequence
atgtggacaaattttttcaagctgcggctcttctgctgcctgctggccgtcctaatggtggtagtgctcgtgattaatgtaactcaggtggaatatctggatcacgaaaccgtgtcagccacatttatcgatagcagcggccagtttgtcagttcgcaggtcacgggcatctcccggaacccttattgcggttacgaccagcaaactcttagcagccaggagagaatggaggaggactccctcctggctgcgctgcaccgccaggtgcccgacgtgggccctgtgcctttcgtgaagagtaccgacccttcctcctcctatttcgtcatactgaatagcgcggctttctttaaagtgggttcccagcttgaggtgctggttcacgtccaggatttccagcgaaagccaaagaagtatgggggagattacctacaggcaagaattcactcactgaagctgcaggcaggtgccgttggccgggtggtggactaccagaacggcttctacaaggtctttttcaccttattatggcccggaaaagttaaagtctcagtcagcttggtgcaccccagtgaggggataagggtacttcagcgactgcaagaggataagccagaccgagtgtacttcaaaagcctgtttaggagtggtaggataagcgagactaccgagtgtaatgtttgccttcccggaaatctccctctctgcaatttcacagacctgtataccggggagccttggttctgttttaagccaaaaaagctgccatgcagcagccgtattacccattttaaggggggctatttgaaggggttgctgactgctgcagaaagcgcattttttcagtccggcgtgaacataaaaatgcctgttaatagctccgggcccgactgggtaactgttatccccagacgaattaaggaaactaatagtcttgaattgagtcaggggtccggaacatttccatcaggctattactacaaggaccagtggaggcccagaaagttcaagatgcggcagttcaatgatcctgataatattaccgaatgtctacaacgcaaggtggtgcatctattcggggacagtactatcaggcagtggtttgaatatctcaccacgtttgtgcctgacctggtggaatttaaccttggatctccgaagaacgtggggccctttcttgctgtggaccagaagcacaatatattactgaaatatcgatgtcacggcccccccattcggtttaccaccgtgtttagcaacgagctacattatgtcgctaacgagcttaatggaatagtgggagggaagaatacggtcgtcgccatagccgtctggagccacttctcgactttccctctggaagtctatatcaggaggctcagaaatatccggagggccgttgttaggctgttggacaggtcgcctaagaccgtggtagtgatacggacagccaacgcacaagagctgggccccgaagtttcattgttcaattcagactggtataactttcaactcgataccatactgagaagaatgttcagtggggtgggcgtctatcttgtcgacgcatgggagatgaccttagcccactacctgccacataagttgcatccagacgaagtgatcgtgaagaaccagctcgacatgttcctcagctttgtttgtcccctggaaacttag

SEQ ID NO: 5294 - DNA, 3624 bp, Artificial Sequence
  Description of Artificial Sequence: Synthetic coding sequence
atgcggctgacgcacatttgttgctgttgtttgttataccagctggggttccttagtaacggtattgtgtcagagctgcaatttgccccagaccgcgaagaatgggaagtggtgtttcctgcgctctggcggcgggagccggtggaccctgcaggcggaagcggcggaagcgctgaccccggctgggtgaggggagtggggggtggcggcagtgccagagctcaagctgccgggagttctagggaagtgcggagcgtggcccccgtgccccttgaggaaccggttgagggtcgctctgaaagccggctgcggcctccccctccctcagaaggggaggaggatgaagaactggaatcccaggagctaccacgcggctcaagcggcgccgcagcgctatctccgggagctccagcctcctggcagcccccacccccaccccagccacctccctcaccacctccagcccagcacgctgaacccgacggggatgaagttctgctccggatacctgcctttagcagagacctgtacctcctactgaggcgggacggacgcttccttgctccaaggtttgcagtggaacagcgcccgaatcccggtccaggtcctactggggccgcctcagcacctcagccacctgcccccccggatgccggttgtttctataccggcgcggtgctgaggcacccaggctcactagcctcatttagcacttgcggaggcggactgatggggtttattcagctgaatgaggatttcatttttatagaacccttaaatgatacaatggccatcactggccacccacaccgcgtatataggcagaaacggtcaatggaagaaaaggtgacggagaaaagcgcacttcatagccattactgtggaattatttcggacaaaggccgaccaagaagccgtaagattgcagaaagcggcaggggaaagagatattcttacaagcttccccaagagtataatattgagactgtggtcgtggctgaccccgcaatggtctcctaccacggcgcggatgcagctcgcaggttcatcctcactatcctcaatatggtctttaatctgttccagcacaaatccttgagcgttcaggtgaacctgagagtaataaaactcatcttacttcacgaaaccccacctgaactatatatcggacatcatggcgagaaaatgcttgagtcattctgtaaatggcagcatgaggaatttggaaaaaaaaatgatatacacctggagatgagtacaaattggggcgaggacatgacctccgttgacgccgcgatattgatcacccgcaaagacttttgcgttcacaaagacgagccatgtgacacagttggtatcgcctacctgagtggcatgtgttctgaaaagcggaaatgcatcatcgctgaagacaatggcctcaacctggccttcacaattgctcacgaaatgggacacaatatggggatcaaccatgataacgaccatccctcatgcgccgacggtctgcatattatgagtggcgagtggatcaagggacagaacctgggagacgtgtcttggagccgctgttcaaaagaggacctggagcgattcctgcgaagcaaggcttctaattgtctgctccagaccaatcctcagagcgtgaacagcgttatggtcccttcgaagcttcccggcatgacctacactgcggacgagcagtgccagatcctcttcgggcccctcgcgtcgttctgccaggagatgcagcatgtcatttgcaccggactctggtgcaaagtagagggcgagaaagaatgtcggacaaagctggacccgccaatggatggcactgactgtgatctcggaaagtggtgcaaggcaggagagtgcacttcccgcacatctgctccagaacacttagcaggggaatggtccctgtggtctccatgctccagaacgtgtagcgccggaattagtagtagagaacggaagtgccctggattggattccgaggcaagagattgtaatgggcctcgcaagcagtataggatctgcgagaaccctccttgccccgctggcttgcctggctttcgggattggcagtgtcaagcttactcagtgcgcacctcttctcctaagcacatactccagtggcaggccgtgctggacgaggagaagccctgtgctctgttctgcagccccgttggtaaggagcaaccaattttgctctctgagaaagtgatggacgggacgtcctgcgggtaccagggcttggacatttgtgctaacgggcgctgtcagaaggttggctgcgatggcctcctcggctcactggccagggaagatcactgtggagtgtgtaacggcaatggcaaatcctgtaaaatcataaaaggggactttaaccacacacggggagctggctacgtcgaagtgttggttattccagccggtgccaggcggataaaggttgttgaagagaaacccgcccactcctatttagcactgcgcgacgctggcaagcaatctattaacagtgattggaaaattgagcacagtggggcctttaatttggctggcaccaccgtccattacgtaaggcggggcctttgggaaaaaatctcagccaaggggcctactacagctcctctccatctacttgtgttgctgttccaggaccagaattatggcttgcactacgagtacacaattccctccgatcctttgcctgagaatcagtcatccaaggcacctgaaccactgttcatgtggactcatacctcatgggaagactgtgacgctacctgcggtgggggcgaaagaaagactaccgtttcttgtactaaaattatgtcaaagaacattagcatagtggacaacgaaaaatgcaagtatctgactaagcccgagccacagatccgcaagtgtaatgagcagccatgtcaaaccagatggatgatgacagaatggacgccttgctccagaacctgtggtaaggggatgcagagccgacaagtggcttgcacgcagcaactgtcgaacggcaccctcattagagctcgggaacgcgactgcattgggcccaagcccgcctcagcacaacgctgtgagggacaggattgcatgactgtttgggaggcaggggtgtggagcgagtgtagcgttaagtgtggtaaggggatccggcatcgcacagtgcggtgcacaaatccacgcaagaaatgtgtcttgagcacacgcccccgggaggctgaagactgcgaggactattctaaatgctacgtctggcgaatgggcgattggtcaaagtgctctatcacatgtggcaaaggaatgcagagtcgggtgattcagtgcatgcacaagatcacaggccgacacggaaacgaatgtttctcctccgagaagcctgcagcctacagaccatgtcacctgcaaccttgtaatgagaagataaatgtcaataccattacatcacctaggttagccgcactcaccttcaaatgtctgggggaccaatggccagtgtactgtcgggtcataagggagaaaaatctttgccaggacatgcgctggtatcagcgctgctgcgaaacatgtcgcgacttttacgcccaaaagttgcagcagaaatcatag

SEQ ID NO: 5295 - DNA, 258 bp, Artificial Sequence
  Description of Artificial Sequence: Synthetic coding sequence
atgaaaattactggcggactcttattgttgtgcacggtggtgtatttctgtagctccagtgaagcggcgtcgctttccccaaaaaaggtagactgcagtatctacaagaagtacccagtagtcgccatcccttgtccaattacctaccttccagtatgtgggagcgactatattacgtacggaaacgaatgtcacctttgcacggagtcacttaaatcaaatggccgcgtgcagttcctccatgacggctcgtgctag

SEQ ID NO: 5296 - DNA, 2982 bp, Artificial Sequence
  Description of Artificial Sequence: Synthetic coding sequence
atgggaagtggccgggtgccaggcttgtgcctgctggtgttgctagtccacgcccgagccgctcagtattccaaggccgcccaagatgtcgatgaatgtgtggagggcaccgataactgtcatattgacgctatctgccagaatacacccaggtcatataaatgtatttgcaaatcaggctacaccggggatggcaagcactgtaaggatgtggacgagtgcgagcgcgaggacaacgctggatgtgtgcatgactgcgtcaatattccgggtaactataggtgcacatgctacgatgggttccatttggcccacgatggtcataactgcttagacgtggacgaatgcgctgaaggaaacggcggatgtcaacagtcttgcgtgaacatgatgggctcttatgagtgtcattgtcgcgaggggtttttcttaagcgacaatcagcatacctgtatccaaaggcctgaagagggtatgaattgtatgaacaaaaatcatggatgtgctcatatctgccgcgagacgcctaaaggcggcatagcatgcgaatgccgacccggttttgagctcactaagaaccagagggactgtaagttgacttgtaactacggtaatgggggatgccagcacacctgcgacgacacagaacagggccctcgatgtgggtgtcacattaaatttgtcctgcacacagatggcaagacatgcatcgaaacttgtgccgttaacaatggtggttgtgactccaagtgtcatgacgcagctaccggagtgcattgcacctgtccggtgggattcatgctgcaacccgatcggaagacgtgtaaggacattgatgaatgtaggctcaacaatggcggctgcgatcacatttgccgcaacacggtggggtctttcgaatgttcctgcaagaaaggatacaaactcttgattaatgagcggaattgccaagacatcgacgagtgctcctttgaccgaacttgcgatcacatctgcgtgaacacacccggctcgtttcaatgtctgtgccatcggggatacctgctttatggaattactcattgcggcgatgtggacgaatgctcaattaatcgtggcggttgccgctttggctgcatcaatacaccaggcagctaccagtgcacatgtccggccggacaaggtagactacattggaatggaaaagattgcaccgagccactcaaatgccagggcagcccaggggccagcaaggcaatgctgtcatgcaaccgctccggcaagaaagacacctgtgccctgacatgcccatcccgcgcaagatttctcccagaatcagagaacgggtttactgtgagttgcggcactccctcccctcgcgccgcgccagcaagggccggtcacaatggcaacagcactaattctaaccattgccacgaggcagccgtgttgagcattaaacagcgggcctccttcaagattaaagatgccaagtgtcgattacacttgcgcaacaagggcaagactgaagaagcgggtagaattaccggccctgggggagctccgtgctcagagtgccaggttactttcatccatcttaagtgcgactcctccagaaagggaaaggggcgccgcgcccgcacccccccagggaaagaagtgacccgtctgactttggaattggaagctgaagtccgagccgaagagactacagcatcctgcgggctcccatgtctccggcagaggatggagcgacgcctgaagggctctctgaaaatgctgcggaagtcaatcaatcaagatcgttttctccttcgcctggctggactcgactacgagttggcccataaaccaggattagttgccggggagcgagccgagccaatggagagttgcaggccgggacagcacagagccggcacaaaatgtgtctcttgtccgcagggcacttattatcacggtcagaccgagcagtgcgtgccatgcccggccggaacattccaggagcgtgaggggcaactcagctgtgatctatgccctgggagcgatgcacacggtccccttggagctacgaacgttaccacatgcgccggtcagtgcccaccaggacagcacagcgtggacggctttaagccgtgccagccgtgtcctcgaggaacctaccagcctgaggccggacgcaccttgtgctttccctgcggcggaggactgaccacgaagcacgagggggccatttcttttcaggactgcgacacaaaggtgcagtgcagcccagggcactattacaatacctcaattcacaggtgtatccggtgcgccatgggcagctatcaaccagattttagacagaacttctgttctcgatgtcctggtaacacatccaccgatttcgacggtagtacctcggttgcccaatgcaaaaaccgacagtgtggtggcgaactgggtgaatttacaggatacatcgaatcacccaattatccggggaattatcctgcaggcgtggagtgcatttggaacatcaatcccccacccaaacggaagatccttatcgtggtccctgaaatcttcctgccctctgaggatgagtgtggcgatgtgcttgtcatgcgaaagaatagttcccctagttccatcaccacctatgagacctgtcagacatacgagaggccaattgctttcaccgcgcgcagtaggaagctgtggatcaactttaagacatctgaagcaaactccgccagaggattccagatcccttacgtgacatacgacgaagattatgaacagctggtcgaggacatcgtgagggatgggagactgtacgcttctgaaaatcatcaggaaatacttaaagacaagaagctcatcaaggcctttttcgaagttctggctcatcctcaaaactactttaaatatacagaaaagcacaaggagatgctgccaaagagcttcatcaagctgcttaggtcaaaagtgtctagcttcttaagaccctacaagtag

SEQ ID NO: 5297 - DNA, 4773 bp, Artificial Sequence
  Description of Artificial Sequence: Synthetic coding sequence
atgcctgggggcgcttgcgtgctggtgattgccttgatgttccttgcgtggggggaggctcaggaatgctctcctggcggccatcagtttctccgctctccctacaggagcgtaaggttcgactcttggcacctgcagcagtccgccgtacaggatttaatttgcgaccattccctgagcccaggatggtatcgcttcctaatcctggaccggcccgcagaaatgcctaccaaatgcgttgagatgaatcactgcggcacacaggcgccgatctggctgtccttgcgcgattccgagacactcccttccccaggtgagataaagcagcttactgcctgtgccacatggcagttcttgttctctaccaccaaggattgctgtctattccaaatccctgtgagcgtgcgtaattgtgggaacttctcagtgtacctgcttcaaccaacacagggctgcatggggtattgtgccgaggcaatctcagacgctagactccacccctgtggcagcgatgaaacagagacgggcggagactgcgtgagacagctggctgcatctctgcccccccctccagcaggaagaccggaagttcttgtggaattaattgaatcccggctattctgtcggtgttcctttgatgtgccagccacaaagaactctgtggggttccacatcgcctggagtagactgtcttctcaggaggtcaaggaggagctgacacaggagacaaccgtccaggccttctcactcctggaattggacggtataaatctccgcctgggggatagaattttctgcagcgctagcgtgttcttcctcgaaaacccgcacgttcagtccgtcgccattgagtctcaggaattcttcgcaggttttaaactccaaccagaactgtcgacaatctcagaggacgggaaagagtactacctgagaattgagtcaacagtgcctattatttgcagcgagttctctgagttagaccaagagtgtaagatttctctaaaactaaagacaataggccagggccgcgaacacttggggctgaacttggctctgtcgtcctgccacgtcgacctgttacagacctcctcttgcgctaacgggacttgttcccatacattcgtttactataccgccgtgaccgacttttcaagagatggggatagggttagcaacattgttgtgcagcctatagtgaacgaagatttcctgtggaataattatatcccagattcgatccagatcaaggtcaaggacgtgcctactgcgtactgctacaccttcaccgacccccacattattacattcgacggacgtgtctacgataactttaaaacaggcaccttcgtcctgtacaagtctatgtcccgcgattttgaagtccatgtacgtcagtgggactgccgatccctgcactatccagtatcctgcaactgcggttttgttgcccaagaagggggcgacatcgtgacattcgatatgtgtaatggacagcttcgggaaagtcaaccttacttatttataaaatcacaagacgttactaggaacataaagatttccgagagctatctgggtcgtaaggtcactatatggttcagttccggcgcatttatccgagccgacctgggggaatggggtatgtctctcaccataagggctcctagcgtggactataggaatacactcggactgtgtggaactttcgacgaaaaccccgagaatgatttccatgataagaacgggatgcaaatcgaccaaaactttaacaactatgtggcctttatcaacgagtggagaatcctccccggcaagagcatgagcgacacgttacctgtctccatgacatcaccaggcaagcctagctattgtagttgcagcctggacacagccgcgtacccctcatccgaagacctggattccgtctccagatcagaaattgcattgggatgcaaggatctcaatcacgtaagcctcagctccttaattcccgaactcgacgtcacttctgagtacatcaattctgacacgttagtgagagaaatcaataagcacacctccccagaggagtacaatcttaacctcttcttacaagagaaaaaacacattaacctgacaaaattgggcctgaatgtgcagaagcaccccggaaatgagaaggaggactccttgcagtaccttgctaataaaaagtatacccaggggcgcgggtcacactctcaggagatgcggtacaatcgccagaataggtggaagaggcagaatttccatgaattccccccactgttcgcttttccttcgttgagtcaaacggatctggaggaattgacctatttcttccccgaagatcacgccgaagatgtacagcaggaatttttcccttcctggccaacaccaagcggacttactgaatactccactctgaccctctgtcaggagactttggctaacagttctattggtagactgtgtttggcttttctcggtaagagactggactctgtcatagagatgtgtgtcaaagatgttctactcaaagatgacctatcatgggctgaggcgggtgtggctctactcgaaaacgagtgtgagaaaaggatcgtggaggaaggaaagtacaacaccgaggagtacggtactagcatcgaagacattttgtctgttctcaaatgtcccaatttatgttcaggcaacggtcagtgtatggagtggggatgcgcatgtagcccttcgttctcctcgtatgattgttcagactcctatgataaggctcccgaaatcaccgaactggggaacgctggcttttgcgacgttcagaaatacaattgtatgatggtgcgcgtcttcggcaaggggtttaaggagctgccaagtattaaatgcgaggtgacgaaactccagtacaacagttccgagtggatgccaggcgagcctatctacactcagacagtgtttcacaattcaagagcggtcgactgtcaactgcctacagatgtgcagcagttcgataccatggacctagtgggcggaaagcctacagggaaatggcaactcaaagtgagtaacgacggctacaaattctcaaatccaaaaattaccgtcatctacgatggggcatgccaggtctgtggcctctacaaaaatgactcctgtaccattaaagaaaacgtgtgcattatcgatggcttgtgttatgtcgagggcgacaagaacccaacgtccccctgtctgatctgtcgccccaagatttccagatttacttggtcttttctcgagaacaatcagccgcctgttatccaagccctgcaagataaactgcagactttctatggcgagaacttcgaataccagttcgtggccttcgaccctgagggctccgatatacacttcacattagatagcggacctgagggcgcatctgtgagttcagctggactattcatgtggaagacggatctgctgactacgcaacagatcaccgttaggctcaacgatgattgcgacgcggagactcgagtgacgatcgaagtgactgttaagtcatgtgactgtcttaatggaggaagttgtgtgagcgacagaaacttttctccaggttcaggggtgtacctgtgtgtgtgtctacccggctttcacggctccttgtgtgaggtcgacatctccgggtgtcagtccaacccctgcggactaggctcgtacatcagcgggtttcattcatactcctgtgactgtcccccagagctgaaggtggagactcagttcgttaatcagttcacaactcagacagtcgttctgacaaggtctgacaaaagcgtcaacaaggaggaggacgacaaaaatgcccagggacgcaagagacatgttaaacctactagtggcaatgcatttacaatttgcaaatacccatgcggtaaaagtagggaatgtgtggcccctaacatctgtaaatgcaaacctggatatataggcagcaactgccagacggccttgtgcgatcccgattgcaagaaccatgggaagtgtatcaagcccaacatttgtcagtgcctcccgggccacggcggcgcgacctgcgacgaggaacactgtaacccaccttgccaacacgggggtacttgccttgctggcaatctatgcacctgcccgtacgggttcgtgggaccgaggtgtgagactatggtgtgtaatcggcactgtgagaacggaggtcagtgtttgacaccagatatatgtcaatgcaaaccagggtggtatggacctacatgttcaactgcactttgcgacccagtgtgtctgaacgggggctcctgtaataagccaaatacgtgtctgtgtccaaacggcttttttggagaacactgtcagaacgccttttgccatcctccctgtaagaacgggggccattgtatgcgcaacaacgtctgcgtgtgtcgcgagggctacactggtcggcggtttcagaaaagcatttgcgatcccacctgcatgaacggtggaaagtgtgtgggaccctcaacctgctcttgtccgtcaggctggtcgggcaaaaggtgcaatacacccatttgtctgcagaagtgcaagaatggcggggaatgtatcgctccaagcatctgtcactgtccaagttcatgggaaggtgtcagatgtcagattccaatatgcaacccaaagtgtctgtacggaggccggtgcatcttccctaacgtgtgctcgtgtagaaccgagtattctggcgtaaaatgcgaaaaaaagattcagattcggagacactag

SEQ ID NO: 5298 - DNA, 624 bp, Artificial Sequence
  Description of Artificial Sequence: Synthetic coding sequence
atgtccacaaaacccgatatgatacagaagtgcctctggctggaaatcctgatgggtatttttatagcaggcacactctcgctggactgcaacctgctcaatgttcatttaagacgggtaacttggcagaacttacgtcatttgagctctatgagcaattcctttcctgtggaatgcctgagggaaaatatcgccttcgagctgccccaggaattcctgcagtacactcagcctatgaagcgagacatcaaaaaggctttttacgaaatgagcctgcaggcatttaacatcttctcacaacacacctttaagtactggaaagagagacatctgaagcagatccagattggcctagaccagcaggccgagtacttaaatcaatgccttgaagaggataagaacgagaatgaggacatgaaagaaatgaaggagaacgaaatgaaaccctcagaagcccgggtaccccagctatcatctctggagctgcggagatacttccaccggattgacaactttttaaaagaaaaaaagtattccgattgcgcatgggaaatcgtgcgcgtcgaaataaggaggtgtctttactacttttataaattcacagcactgtttagacgtaagtag

SEQ ID NO: 5299 - DNA, 939 bp, Artificial Sequence
  Description of Artificial Sequence: Synthetic coding sequence
atggagtctgccctacccgcggccggctttttgtactgggtgggcgccggcacagtcgcatatctcgccctccgaatctcctactccctttttaccgcactccgggtttggggagtgggcaatgaagctggagttggccctggactcggtgagtgggccgtcgtgaccggcagtaccgacggcattggtaagtcttacgctgaagagctggccaaacatggtatgaaggtggtcctgatttctcggagcaaagacaagctagaccaggtgagctcggagatcaaagaaaaatttaaagttgagacgcgaactatagcagtggactttgcctcagaagatatctacgacaaaataaagaccggactcgctggacttgagatcggtattctagtgaacaatgtggggatgagctacgagtaccctgagtacttcctcgacgtcccagacctagataatgtaatcaagaaaatgatcaacatcaatatactctcagtgtgtaaaatgacccagctcgtcctgccagggatggtggagcgctctaagggcgccatcctgaacatatcaagcgggtctggcatgttgccagtcccgctgcttactatttatagcgcaacaaagactttcgtggactttttctcccagtgcctccacgaggaataccggagtaaaggcgtgttcgtgcagagtgttctaccctatttcgttgcaactaaactggccaagatacgtaagcccaccctggacaagccgagtcctgagacctttgtcaaatcagccatcaagaccgttgggcttcaaagtcggactaatggataccttattcacgccctaatggggtctattatctcaaacctaccatcctggatctacctgaaaattgttatgaatatgaacaagtcaactagggcccactatctcaagaagacaaaaaagaactag

SEQ ID NO: 5300 - DNA, 2214 bp, Artificial Sequence
  Description of Artificial Sequence: Synthetic coding sequence
atggaactgggatgctggactcaactgggcttaacgtttctacagctgttgcttatcagttccctgccacgagagtataccgtgataaacgaggcctgtcccggtgcagaatggaacattatgtgtagagagtgctgcgaatacgatcagattgagtgtgtgtgcccgggcaaaagggaggtggtgggctataccattccttgttgccgtaatgaggagaacgagtgtgatagctgcctcatccacccaggctgcacaattttcgaaaattgcaagagttgtcgcaacgggtcttggggtgggaccctcgacgacttttacgttaagggtttctactgtgctgaatgtcgcgccggctggtatggcggggattgcatgcgctgcgggcaggtgttgagggcacccaagggtcagatcctgttggagagctacccactcaatgctcattgcgaatggactatacacgccaagcctggtttcgttatccagctgaggttcgtaatgttgtctctggaatttgattatatgtgccagtacgattatgtggaggtcagagacggggataacagggacggccaaatcattaagagggtttgtggtaatgaaagacccgcgccaattcaaagtattggcagcagcctccatgtgctgttccactccgatggatctaagaacttcgacgggttccatgcaatctatgaggaaatcaccgcctgcagctcttcaccttgtttccacgacggcacttgcgtactagataaggcaggcagctacaaatgcgcttgcctggctggttataccggacagcgatgtgagaatctccttgaagcaggaaagagtaaaattaaggctagtgaggattccctgagcgtcttggaggagcgaaattgctccgatccaggggggcctgtaaatggctaccagaagattacgggagggcccggtcttatcaacgggcgtcatgcaaagatcggaactgtagtgagcttcttctgcaataatagctatgtactctcgggaaacgaaaagagaacttgccagcagaacggggagtggtctggcaagcagcctatttgtatcaaggcttgccgtgaacctaaaatctcggatctcgtgcggaggcgggtgctccccatgcaggtccagtcaagggagacgccactgcaccagctctacagcgctgcttttagtaaacaaaaactacagagcgcaccaactaaaaagccagcccttcctttcggcgatctgcccatgggctaccaacatctccacacgcagctacagtacgagtgcatatctccattctatcgaagactggggtccagtcgccgaacatgtcttcggactggtaagtggagcgggagagcacccagctgtatacctatctgcggtaaaattgaaaatattaccgcgccaaagactcaaggtctgcgatggccctggcaagccgctatctaccggaggacctctggcgtccacgatggctcactgcataaaggcgcatggtttttagtgtgcagtggcgcactggtcaacgagaggaccgtggttgtggccgcccattgcgtgaccgacctcggcaaagttacaatgataaaaacagctgacttaaaagttgtgcttggtaagttctatagagatgacgacagggatgaaaaaaccatccagtccctccagatatccgccattattctccatcccaattatgaccccatcctgttggacgccgatatcgctatattgaagctgctggataaagctcgcatcagcacccgcgtccaaccgatatgtttagccgctagtagagatctcagtacatctttccaagagagccacatcaccgttgccggttggaatgtcctcgctgacgtaagaagccccggcttcaagaacgacaccttgcgatcaggtgtagtgagcgtcgtagactctcttctgtgcgaggaacaacacgaggatcacgggatcccagtgtctgtcactgacaacatgttttgtgctagttgggagcctactgctccgtctgacatttgcacagccgagactggcggtattgccgctgtgagctttcccggacgcgctagcccagaaccaagatggcatctgatggggctagttagttggagttacgacaagacttgctctcaccgcctcagcacggcatttactaaggtgctccctttcaaagactggatagaaagaaacatgaaatag

SEQ ID NO: 5301 - DNA, 1503 bp, Artificial Sequence
  Description of Artificial Sequence: Synthetic coding sequence
atgggcactgccaggtggctggctctcggttccctgtttgccctggcaggtctgcttgagggccggctggtcggggaagaagaagccgggttcggggagtgcgataagttcttctatgctggaacgcccccagccggactagcagccgactcacacgtgaagatttgtcaacgagctgagggagcggagagatttgcgaccctctactctacgcgagacagaatccccgtctactcagctttccgcgcgccgcgccccgctcctggaggagctgagcagcgttggctggtagagccacagatagatgaccctaatagtaacctcgaagaggcgattaacgaagccgaagcgatcacaagtgtaaattcgctgggctccaaacaggcactaaacacagattacctggattcagattaccagcgaggtcagttataccccttctctttaagcagcgacgtccaagttgccaccttcaccctgactaactctgcgcccatgacacagtcatttcaggaaaggtggtatgtaaacctacattctctcatggaccgggcactgactccacagtgtggatccggggaggatctctacattctgacagggactgtgccatcggactaccgcgtaaaagacaaggtggctgttccggaattcgtctggctggcagcttgttgcgctgttcctggtgggggatgggccatgggcttcgtcaagcacactagggacagcgacataatcgaagacgtgatggtaaaggatctccagaagctgctcccatttaatcctcaactgtttcaaaataactgcggggagaccgagcaggacactgagaagatgaagaagatactggaagtcgtgaatcagatccaagacgaggagagaatggttcagagtcagaagtctagcagtccactctcaagtacccgatccaagagaagtactttactgccccccgaggcgtccgaggggtcttcctcattcctgggcaaacttatgggtttcattgctactccctttatcaagttgtttcaattaatttattatcttgtggtcgctattttgaaaaatatcgtgtattttctgtggtgcgtcaccaaacaggtcattaatggtatagagagctgcttgtacagattgggctctgccactataagctattttatggcaatcggggaagaactagtcagtataccttggaaggtgttgaaagtggtcgcaaaagtcatcagggccctgctgagaatactatgttgcttgctgaaggctatttgccgtgttttgtcaatccctgtgagagtgcttgtggatgtggctacattcccagtttacaccatgggagcaattcctatcgtttgtaaggatatagccttgggcctcggcggcaccgtttccctgctgtttgataccgcgttcggcaccttgggaggcctgtttcaggtggtgttctcagtgtgcaagcgcattggatacaaggtgaccttcgacaattccggggagctctag

SEQ ID NO: 5302 - DNA, 300 bp, Artificial Sequence
  Description of Artificial Sequence: Synthetic coding sequence
atgaagagcgccaaattgggttttttgttacgattttttattttctgcagcctgaataccctcttactgggtggagtcaacaaaattgcagagaagatttgtggggacctgaaagatccttgcaagttagacatgaacttcggttcttgttatgaggtgcactttcggtacttttacaatcgcacttccaaacggtgtgaaacattcgtgttttcaggatgtaacggaaatctgaacaacttcaaactgaagatcgaaagggaagtggcatgtgtggctaagtataaacctccgcgctag

SEQ ID NO: 5303 - DNA, 390 bp, Artificial Sequence
  Description of Artificial Sequence: Synthetic coding sequence
atgcccatggccagcccacagactctggtcctgtatttactggtgctggccgtgaccgaagcatggggccaggaggcagtgatacctggctgtcacctccacccctttaacgtgacagtccggtctgacagacagggcacctgccagggtagccacgtggctcaagcctgtgtgggccactgcgagtcgtctgcctttccatctaggtactctgttctagtggcaagcggctataggcacaatattaccagtgtcagtcagtgttgtacaatctcgggccttaagaaagtcaaggtgcagctgcaatgtgtggggagtaggagggaggaactcgaaatcttcacggcccgagcgtgtcaatgtgacatgtgccgtttatctaggtactag

SEQ ID NO: 5304 - DNA, 1965 bp, Artificial Sequence
  Description of Artificial Sequence: Synthetic coding sequence
atggcaaagttcggggtgcatagaattctattgctggcaattagcctcactaagtgtttagaatctactaaacttctagctgatctgaagaaatgcggcgatctcgagtgtgaggcactgataaacagggtcagcgctatgagagattatcgtggccccgactgccgatacctcaatttcacaaagggggaggagatctccgtgtacgtaaagctggccggcgagcgcgaggacttgtgggccggaagcaaggggaaggaattcggctatttcccgagggatgccgtccaaatcgaagaggtgtttatatcagaagagatccagatgagcactaaggagtcggacttcttatgcctcctcggcgtgtcttacacgtttgataatgaggattcagagctgaacggagactacggggaaaacatctatccgtacgaggaggacaaggatgagaaatctagtatctatgaaagtgattttcaaatcgagcccggattctatgcaacatatgaatccaccctctttgaagatcaggtgccggctctggaggcgcccgaggatatcgggagtacctcggagtctaaggactgggaagaggtagtggtcgaaagtatggaacaagaccgcatacccgaagtacacgtgcctcctagctctgcagtcagcggtgtgaaagaatggtttggactgggaggggagcaagccgaggagaaagctttcgaaagcgtcattgaacctgtccaagagagcagcttccggtcccgaaaaatcgccgtggaggacgagaacgacctcgaggagctaaataatggcgagccccagactgaacatcagcaggagtcggagtctgagatcgactctgtacccaagacccagtccgagctcgcatccgaatcagagcacatcccaaagccccaaagcactggttggttcgggggtggctttacctcctatttaggctttggcgatgaggatacaggactagagctgattgccgaggagtcgaatccaccactgcaggactttcccaactcaatttctagtgataaggaagccactgtaccatgcacagaaatactcaccgaaaagaaggatacaataacaaatgattcgctgtctctgaaacctagttggttcgatttcgggttcgccatcctggggtttgcttatgccaaggaggataagataatgctagacgaccggaagaatgaagaagacgggggtgctgatgagcatgagcacccactaacctccgagttagaccccgagaaagagcaggagatcgagaccataaaaattatcgagacggaggaccagatagacaaaaaacctgtcagtgagaagacagatgagtcagacacaatcccctatcttaaaaagttcctgtacaacttcgataacccttggaacttccagaatatccctaaggagacagaacttccgtttcccaaacagatcttggatcagaataacgtgattgaaaatgaagagacaggagagttttcgatcgacaattatcccactgacaacacgaaagtgatgatttttaaaagttcgtactcactgtccgacatggtgtcaaacattgagctgccgacaaggatccacgaggaagtgtattttgagccctcaagcagcaaagatagtgatgagaatagcaaaccctcagtggacacggaaggacccgccctggttgagatagaccggtctgtcgaaaatacactcctgaattcccaaatggtgtccacagataactccttgtcttctcagaattatattagtcaaaaggaagatgccagtgaattccaaatcttaaaatacttgtttcagatagacgtctacgacttcatgaattctgccttcagccctatagttatcctgaccgaacgagtttcgctgccttttaaaccttttgcaatcatcctgccaatcctgcttaacatccgggtggctacaaagtacgtttag

SEQ ID NO: 5305 - DNA, 1152 bp, Artificial Sequence
  Description of Artificial Sequence: Synthetic coding sequence
atggccggcattccagggctgctgttcttgcttttttttctgctttgcgctgtagggcaggtgagcccatattcagcgccctggaagcccacatggccggcctaccgcttgccagtggtcctgccccagagcactcttaacctcgccaagcccgatttcggggctgaggctaagttagaagtgagcagcagctgcggaccgcagtgtcacaaggggaccccacttccaacgtacgaggaggcgaagcagtacctgtcatacgagaccctgtatgccaacgggtcacgaactgagacacaagtaggcatttacattctgtcctcaagcggtgatggcgcacagcatcgagatagcgggtcctcaggcaaaagtcggagaaagagacaaatttacggctatgatagccggtttagcatcttcggcaaagacttcctactgaactacccattttctacatctgtcaagttatcgacgggttgtaccggcactctcgttgccgagaaacatgtattaaccgctgcccactgcatacatgacggcaaaacttacgtgaagggaacccaaaagctgcgcgtcggattcctcaagccgaagtttaaggatggcggcaggggggcgaacgattccacctcagctatgccagagcagatgaagttccagtggatcagagtgaagaggacccacgtccccaagggatggatcaaaggtaacgctaacgatatagggatggattacgattatgcactcctcgagctaaaaaaacctcacaaacggaaatttatgaagattggcgtctctccaccagcaaagcagctgcctggcggtagaatccacttcagtggctacgataatgacaggcccggaaacctcgtgtaccgcttttgtgatgttaaagacgagacctacgatctgttatatcagcaatgcgacgcccagccgggcgccagcggctctggggtgtatgtccggatgtggaagagacagcagcagaagtgggagaggaagattatcggcatattttcgggtcaccaatgggtggacatgaacggtagcccccaggatttcaacgtggcagtgcgcatcacaccactaaaatacgcccagatctgctattggatcaagggcaattatcttgattgtcgggaggggtag

SEQ ID NO: 5306 - DNA, 1662 bp, Artificial Sequence
  Description of Artificial Sequence: Synthetic coding sequence
atgaagtggtgttggggtccggttcttcttattgcaggcgccacagtactgatggagggcttgcaggcagcccagagagcctgtggacagaggggacccggaccccctaaaccccaagaaggcaatacagttcctggcgaatggccttggcaggcctcagtacggcgccagggggctcacatctgcagtggtagtctggtcgcagacacctgggtattaacagctgcccactgttttgagaaggcagctgccacggagctaaactcctggtctgttgtgcttggatctctccaaagagagggactgagcccgggggctgaagaagtgggggtggctgccctgcagcttccaagagcctacaatcattactcccaaggatctgatcttgctctgcttcagttagcccacccaaccacccacacaccgctctgcttaccacagcctgctcacaggtttccgttcggggcctcttgctgggcaaccggctgggaccaggatacctccgacgcaccaggaaccttgcggaatctcaggttgaggctgatcagcagaccaacctgcaactgtatctataatcagctgcatcaacggcaccttagtaatcccgctaggcctgggatgctttgcggtggtccacaacccggagtccaaggaccctgtcaaggcgatagtggcggaccggtgctgtgcctcgaaccagatgggcactgggtgcaggccggcattatcagcttcgccagtagttgtgcccaggaggatgcgccagttttgctcacaaatacagctgcgcattcgtcttggttgcaagccagagtccagggcgccgcattcctggcacagtcccctgagactcccgaaatgtccgatgaggatagctgtgtagcgtgtggcagcctgagaactgctgggccgcaggcaggagccccaagcccctggccctgggaggcgaggctgatgcaccagggacagctcgcctgtgggggggccttggtctcagaggaggccgtactgactgcagcacactgtttcattggtcgtcaggcaccagaagaatggtccgtcgggctgggaacccggccggaagagtggggcttgaagcagttaatcttgcatggggcctacacccacccagagggtgggtatgatatggcgcttctgctattggctcagcctgttacactaggcgcatctttaaggcccctttgccttccgtatcctgatcatcacctgcctgatggcgagagaggttgggttctgggaagagcacggccaggcgcaggtatctccagcctgcaaacagtccctgtgacactgctgggtcccagagcctgctcaaggctgcacgctgcccccggaggggacggctctcccatcctgcccgggatggtgtgcaccagtgcagtgggcgagctgccgtcttgtgaaggcctgagcggcgccccattggtgcacgaagttcggggaacttggttcctagcaggcttgcattcttttggcgatgcttgccagggcccggcacgtccagcagtgtttacagccctgcctgcctacgaagactgggtctcctctctcgattggcaggtgtacttcgccgaggaacccgaacccgaagccgagcccggatcgtgcttagcaaatatcagccagcccacctcatgttag

SEQ ID NO: 5307 - DNA, 936 bp, Artificial Sequence
  Description of Artificial Sequence: Synthetic coding sequence
atgggaattatccaaagcatcctcgcaaccagcagagattgctattcctttaagaagaaacccattccgaagaaacctactatgctggcacttgcaaagattctactgatttctacgctgttttattctctgctctccggtagccatggcaaagaaaatcaggatattaacaccacacagaatatcgctgaagtattcaagacaatggaaaacaagccaattagtctggagtctgaagctaacctgaactcggacaaggagaacattaccacaagtaacttgaaggcctcacacagcccgcctctaaacctaccaaacaatagccatggaatcacggattttagctccaattcttcggccgaacactcgctgggcagcctgaaacccacgtctaccatttcaaccagcccgcctttgattcactcctttgtgagtaaggtgccctggaatgcaccaattgccgacgaggacctgctgccgattagcgctcatcctaacgcgactcctgcactgtcctctgagaatttcacttggagtctggtcaatgacactgtgaaaacacctgataattcctctataaccgtttcaatactgtcaagtgagcctactagcccttccgtaactcccctgatcgttgagcccagcggctggctcaccacaaattctgatagcttcaccgggttcaccccttaccaggaaaaaaccaccttgcaaccaactctcaaattcacaaacaattctaagctgtttcccaacactagcgaccctcagaaagtcttacgactagataatgctcctgagccatatgacgtgagcttcggtaattcatcttactacaacccaaccttaaatgattcagctatgcctgaaagtgaggagaatgccagagacggtatccccatggatgacatacctccacttcgcacttctgtgtag

SEQ ID NO: 5308 - DNA, 3120 bp, Artificial Sequence
  Description of Artificial Sequence: Synthetic coding sequence
atgcagtccagactgctacttctgggggcccctggcgggcacggagggccggccagcagaagaatgaggctgctgctgcggcaggtcgtgcaacggcgccctggtggggataggcagaggccagaagtgcgactcctacacgcagggagtggcgctgacaccggggacactgtgaacataggggacgtctcatacaagctgaagatccccaaaaatcccgagctggttcctcagaactacatatcagactctttggcccagtccgttgtgcagcatctgaggtggatcatgcagaaagatctgcttggacaggatgtttttctgatcggtccaccggggcccctccgcagaagcatcgcgatgcagtatctagagttgaccaagcgggaagttgagtacattgcgctgagcagagatactacggagaccgatctcaaacagaggagggaaatacgagctggaacagcgttctacattgaccagtgtgccgttcgggcagctactgaaggaaggactcttattctcgagggtctggaaaaggctgaacggaacgtgctcccggtgttgaataatctgctggagaatcgtgaaatgcagctggaagatgggagattcctaatgtccgcggaacggtatgacaagttactgagggaccacaccaagaaagagttggattcatggaagatagtgagggtgtcagagaacttcagggtcattgcgctaggcttgccagtccctagatatagcggcaatccactcgatcctcctttgcgttctcggtttcaggcacgcgatatctattaccttcccttcaaagaccagctcaagttactctactctattggggccaatgttagcgcagaaaaagtgagccagcttctctcttttgccaccactctctgctcacaggagtccagcacccttggcttgccagacttccccctcgattccttggcagccgctgtccaaattctcgattcttttcctatgatgcctatcaagcatgccattcagtggctgtacccctatagcattttattgggacacgaggggaagatggccgtggagggcgtgcttaagagatttgaactgcaggactctggcagctctctgctgcctaaagaaatagtcaaggtggaaaagatgatggagaatcacgtttctcaggcttccgttaccattaggatcgccgataaggaagtgactataaaagtgcccgctggcaccaggctcctctcacaaccttgcgccagcgatcggttcatccagaccctgtcccacaaacagctgcaagcagagatgatgcagagtcatatggtgaaggatatctgcctgatcggaggtaagggctgtgggaaaaccgtgattgcgaagaactttgccgatacccttggctacaacattgagcctattatgctataccaggacatgaccgcgagggatctccttcagcaacgctacacactgcccaatggagatacagcctggcgctcatccccgctggtcaacgccgcactcgagggtaaactggtccttctggatggaatccatagagtgaatgccggcacactcgctgtactgcagcgtctgatccacgatcgggagttgagtctctacgacggcagtaggctgctgagagaagaccgatacatgcgtcttaaagaggaactgcagttgagcgacgagcagctgcagaagagatcaatttttcccattcatcccagcttccgtatcattgccctggccgaacctccagtgatcggaagcaccgcccaccagtggctgggccccgagttcctgactatgtttttctttcactacatgaagccactggttaaatctgaagagatccaagtgatcaaggagaaggtcccgaatgtgcctcaggaggccttggataaactgctatcatttacccataaattgcgggagacccaggatcccacagcccagtccctggcagccagcctgtcaaccaggcagctgcttcgcatctccagacgcttgagccagtatcccaacgagaatctccattccgccgtcactaaagcttgcttgtctcgctttctcccaagcctggcccgctcagcactggagaagaatctggcagacgcgactattgagattaacaccgacgataacctggagcctgagttaaaggactacaagtgtgaagtgactagcggtaccctccgcattggagccgtctcggcaccaatttacaacgctcacgaaaagatgaaggtccccgatgttttgttttatgacaatattcaacatgtaatagttatggaagacatgctcaaggacttcctcctgggggagcacctgcttctcgtcggtaaccagggagtaggaaaaaataaaatcgtcgacaggtttctgcaccttcttaaccggcctagggagtatattcagctccatagagatactaccgtccagaccctgactctccaaccttccgtgaaagatggattgatcgtgtacgaggatagtcctttagtcaaggcagtgaagctgggacacatcctcgtcgtggacgaagctgacaaggcccctaccaacgtgacctgtatactgaagacgctggttgagaatggcgagatgatactggccgatggccgcagaatagtcgcgaacagcgcaaatgttaatggtagagaaaacgtggttgttatacatcctgattttcgaatgattgtgctggcgaaccgccctggcttcccctttctgggaaatgacttcttcggcacccttggtgacatattttcctgccatgccgtggataacccaaaaccccattccgaactcgaaatgttgcgccaatatggtcctaatgtgccagagcccattctccaaaagctagtggccgcattcggcgaactccgctcattggccgatcagggcatcattaactacccttacagcacaagggaggtagtcaacatcgttaagcacctgcaaaagttcccaacagaaggacttagcagcgtggtccggaatgtatttgattttgactcctacaataacgacatgagggaaattctcattaacacccttcataaatatggcattcccatcggcgctaagcctaccagcgttcagctggctaaagagtag

SEQ ID NO: 5309 - DNA, 801 bp, Artificial Sequence
  Description of Artificial Sequence: Synthetic coding sequence
atgcgtctgctttttctggcagtcctgcgaccccatactggtaatgccgtgacagcacagagagtgcgggcccatctcgaggcagccgggcatgtttgcgtgttaaaggatgcatttgatttcgaaagccgatccgaaatagcgaacttaattttggcagaaaattgcgaggccgccctggccctccacctgtacagaggtgggcggttattacaagggcatagaatcccctttggcgtgatatttggaggtaccgacgtcaatgaggatgcaaaccaagctgaaaagaacacggttatgggtagagtgctcgaagaagcgcgcttcgccgtggcctttaccgaatcaatgaaagagatggcccaggcgcagtgggtagatcccgtttttacacgggaggtcaaggccaaagtgaagcgagctgccggcgtgaggttaatcggcgagatgccccaagaagacctccacgctgtcgttaaaaactgtttcgcagtcgttaactctagcgttagcgaaggtatgtctgcggcaattttagaggcaatggacctcgaggtaccagttctcgcacggaacattcctggcaacgcagccgttgtgaagcatgaggtgactggccttctcttctccaacccacaggagttcgttcatcttgcaaagcgcctggttagtgatcccgccttggagaaggagattgtagtgaatggaagggagtacgttagaatgtatcacagctggcaagtcgagagagatacataccagcagttgatacgcaaactcgagggctcaaccgaggactag

SEQ ID NO: 5310 - DNA, 2478 bp, Artificial Sequence
  Description of Artificial Sequence: Synthetic coding sequence
atgtttagcggtttcaacgtctttagggtgggcataagctttgtcatcatgtgtatcttttacatgccaacagtcaattctttgccagagctgtcaccgcagaaatacttcagcaccctccagcccggcaaagcatcactcgcatacttctgccaggcagactcaccacgcactagcgtcttcctcgaggagcttaacgaagcagtgcggcctctgcaggactatggtatatctgttgctaaagtcaattgtgtcaaagaggagatatcccgatactgcggaaaagagaaagatctgatgaaagcttacctgttcaaaggtaatattctgttgcgggagttcccaacagacaccctgtttgacgttaatgctattgtcgcacacgtgttgtttgctctgctttttagcgaagtcaagtacatcacaaatctggaagacctgcagaacatagagaacgccctgaaggggaaggccaatatcatcttctcgtacgtgcgggctatcggcattcctgagcatcgcgcggtgatggaggctgctttcgtgtacggaaccacgtatcaatttgtactgaccaccgaaatcgcactcctggagagtatcggaagtgaggacgtggagtacgcgcacctgtacttttttcattgtaaactcgttctggacctgacccaacagtgtcgccgtacattaatggaacagcccttgaccactctcaacatccacctcttcataaaaacaatgaaagctccccttctcactgaagtcgccgaagacccccagcaggtaagcactgtgcacctccagttaggactgccgctcgttttcatcgtgagccagcaagctacgtacgaggctgaccgccgaacagccgaatgggttgcctggaggctgctcggtaaagctggggtgctgttactgttgcgcgattcccttgaggtgaatatcccacaggatgcaaacgttgtctttaaacgggcagaggaaggcgttccagtagaatttttagtcctccacgacgtggatttaatcatctcccatgttgaaaacaatatgcacatcgaggaaatccaggaggatgaggataacgatatggaaggacctgacatagacgtccaggatgatgaagtggcagagacggtctttagggacagaaagcgaaagcttcctctcgagcttacagtggagctcacagaggaaacttttaacgccaccgtgatggcctctgatagcattgtgcttttctacgccggttggcaggctgtaagtatggcgtttctgcagtcatacatcgacgtggctgtgaaactgaaaggcacatcaaccatgttactgactcgtatcaactgtgcagactggtctgacgtgtgcacaaaacagaatgtgacggaattccctataattaagatgtacaagaagggggaaaatcctgtctcatacgcaggtatgcttggcacagaggacctgcttaagtttatccagttaaatcggatttcatacccagtgaacataacatctatccaggaggctgaggagtacctcagtggagagctgtacaaggatcttatcttgtattcttcagtgtcggtgctcggactcttctctcctaccatgaagactgcaaaagaggatttttccgaggccgggaactacctgaaaggttatgtcatcaccggcatttacagtgaagaggacgtgctgttactgtctacaaagtacgctgctagcctgccagccttgctactcgcgagacacaccgagggcaaaatcgagtcgattcccttagcttccacgcacgcccaggatatcgtgcagataatcacagatgctctgttggagatgtttcccgagatcaccgtggaaaatctgcccagttacttccgtttgcagaagccgcttctgattctgttttcggatggtacggtgaatcctcagtataagaaggctatcctcactctcgtaaagcagaagtacctagatagcttcaccccgtgctggttgaacttgaaaaacacacccgtggggcgcggaatcctgcgcgcctacttcgatcccctaccccccctgcctctgctcgtcctggttaacctgcactctggagggcaggtttttgcctttccctccgaccaggccatcatcgaggaaaatctcgtactgtggctaaaaaagcttgaggccggcctggagaaccacatcacaatcctcccagcccaggaatggaagccgcctcttccggcgtacgatttcctttctatgatcgatgccgctaccagccaacgcggcacccgtaaagtaccaaaatgtatgaaagagactgacgtgcaggagaatgacaaagagcaacatgaggacaaatctgccgtacggaaggagcctatcgagacactcagaataaagcattggaaccgtagcaactggttcaaggaggctgagaagtcattcaggcgtgacaaggagctagggtgttccaaggtgaactag

SEQ ID NO: 5311 - DNA, 672 bp, Artificial Sequence
  Description of Artificial Sequence: Synthetic coding sequence
atgacctggagacatcatgtgaggttactgttcactgtctccttggccctgcagattataaatctggggaacagttatcagagagagaagcataacggtggcagagaggaggtcaccaaagttgcgacgcaaaagcaccgccaatctccgctcaactggactagttcacattttggagaggtgacaggatcagccgagggatggggccccgaggagccacttccgtatagttgggcatttggggagggcgcctcggccagaccacggtgttgcagaaatggcggcacctgcgtcctgggctctttttgcgtatgtcccgctcattttacaggaagatattgtgagcacgaccagcgcaggtctgaatgcggcgcgctcgaacatggcgcctggaccctaagagcctgtcacctgtgccgctgcatatttggcgctctccattgtctgcccctacagacccctgaccgttgtgacccaaaggacttcctggccagccatgctcatggcccatcagctggtggcgctccttccctcctgttactcttgccctgcgcactgcttcaccggttgctaaggccggacgccccagcccacccacgctcgctggtgcccagtgtcctgcagcgggagcggcgcccttgcggaagacccggattgggacatcgactctag

SEQ ID NO: 5312 - DNA, 1320 bp, Artificial Sequence
  Description of Artificial Sequence: Synthetic coding sequence
atgccagctattgcggtcctggccgctgcggccgcagcctggtgttttctccaagttgaatctcggcatctcgatgctctcgctggaggggccggcccaaatcacggaaattttctcgacaacgaccagtggctgtccaccgtttctcaatatgatcgcgacaagtactggaatcgctttcgagatgatgactatttccgaaattggaaccccaacaagcccttcgaccaggctttggatccatctaaagacccctgcttgaaagttaagtgctccccccacaaggtgtgtgtaacgcaagattaccaaaccgccttatgtgtgagcaggaagcacctgctgccgcggcaaaagaagggaaacgtcgcccagaagcattgggttggaccttccaatctggtcaagtgcaaaccttgtccggtggcccagagtgccatggtgtgtggctccgacgggcactcctacactagcaaatgcaagctcgagttccacgcctgctccaccgggaagagcctcgccaccctgtgcgatggcccctgcccgtgcctgccagaacccgaacctcccaaacataaggcagagcgctcggcatgtactgacaaagagctgcgaaaccttgcctcgcgcttgaaagattggttcggagccctgcatgaggacgcaaaccgtgtcatcaagccaacatcttctaacaccgctcagggccggtttgataccagcattctgcccatttgcaaagatagtctgggatggatgttcaataagctagacatgaattatgacttacttcttgatcctagtgagattaacgccatctatcttgataaatacgagccctgtataaagccgctgtttaactcttgcgattctttcaaagacggaaagctgtcgaacaatgagtggtgttattgcttccagaagcctggcgggctcccatgccagaacgaaatgaacagaatccagaagctctccaaagggaaatcactgctcggagcttttataccaaggtgcaacgaggaaggatattacaaggcaacacagtgccatggatccacgggacagtgttggtgtgttgacaaatacggcaatgaactcgcaggaagccggaagcagggagcagtaagctgtgaagaagaacaggagacatccggagacttcggtagcgggggttcagtcgttttgttggacgaccttgaatatgagcgcgaattaggcccgaaggataaggaaggcaaactccgcgtgcatacacgagcagtgaccgaggatgacgaggacgaggatgacgataaagaggatgaggtaggttacatctggtag

SEQ ID NO: 5313 - DNA, 7872 bp, Artificial Sequence
  Description of Artificial Sequence: Synthetic coding sequence
atgaaagtcaaaggaagaggcatcacgtgtctgctcgtgagcttcgctgtgatttgccttgtggcaacacccggcggaaaagcgtgcccgcgccgatgcgcctgctacatgccaacagaagtccactgtacgtttagatacttgacctctatccctgatagcatcccgccgaacgtggagcgaattaaccttgggtataattcattagtgcgcctgatggaaactgatttctctgggttaaccaagctcgagcttctgatgttacattccaacggaatccacacaattcctgacaaaacattttccgacttgcaggctttgcaggtgctaaagatgagctacaataaggtcaggaagctgcagaaggataccttctatggcttacgctctctaacacgtctccacatggatcacaataatatagaatttatcaaccccgaagtgttctatggcctgaactttcttagactggtccacctggagggaaaccaactaacaaagctgcaccctgacacatttgtctccctgagctatctgcagatttttaagatatctttcattaagtttctgtatctgtccgataatttcctgacttcactgccacaggagatggtgtcctatatgcctgacctggacagtttgtatcttcatggtaatccgtggacctgtgactgtcacctgaaatggctctccgactggatacaagaaaagcctgatgttatcaagtgcaaaaaggaccgatcgccctcttctgcacaacagtgtccactctgtatgaatccccgcaccagcaagggcaagccattggcaatggtgagtgcagccgccttccaatgtgccaaaccaaccatagattccagtctaaagagcaagtccctgaccatactcgaagacagctcaagtgccttcatcagcccacagggatttatggctcctttcggaagcctcaccttgaacatgacagaccagtcgggtaacgaggccaacatggtctgttccattcaaaagccaagcaggaccagccccatcgcctttactgaggagaacgattacatcgtgctaaatacctccttttctactttcctagtctgtaacattgactatgggcatattcaacccgtctggcaaatcctggcgctttactctgatagccccctgatcttggagagatcccatctgctgtccgaaacccctcaattgtattacaagtacaaacaggtagctccgaaacccgaggacatcttcactaacatcgaagccgacttgagagccgaccccagctggcttatgcaggatcagataagtctccaactgaatcgtaccgctacaacattctccaccctgcagattcaatacagttccgacgcccaaatcacactcccacgggcagagatgcggcccgttaagcataaatggaccatgatctcgagagataacaatacgaaattagaacatactgtgctggtgggggggaccgtgggactcaactgtccaggacagggcgaccctacaccccatgtagactggctgctggcagacgggagcaaagttcgagctccatatgtttctgaggacgggcggattttgatagataaaagcggcaagctggagctccaaatggcagatagtttcgatactggcgtgtaccattgtatctcatctaattatgacgacgccgacatactgacttaccggattaccgtcgtagaacctctggtagaagcttaccaggagaatggcatccaccacacggtgttcattggagagacccttgatctgccttgtcactccacaggtattcccgacgcttctattagctgggtcattcccggcaataacgtgctgtaccagtcatccagagataagaaagtcctcaataacgggacacttcgtatactgcaggtcacgccgaaagatcagggttattatagatgcgttgctgccaaccctagtggggtggacttcctgatcttccaggtatccgtgaaaatgaaaggccagagaccactggagcatgatggcgagacagaaggttctgggctggatgagagcaaccccattgctcacttgaaggaaccaccaggggcgcaactaaggacatccgccctgatggaggctgaggtggggaagcatacgtcctccacttctaagaggcacaactacagagaactaacacttcagagacggggcgactcaacacaccggcggttccgcgaaaatcgaagacactttcccccctccgctagacggatcgatccgcaacattgggcagctctcctcgaaaaggccaagaaaaacgctatgcctgataagcgcgagaacactaccgtttcacctcctcctgttgtgacacagctccctaacattccgggggaggaagatgatagttctggaatgcttgccctccatgaagagtttatggtacctgctactaaggctctaaatttgcctgcccgcaccgttaccgcagactcgagaaccatcagtgattccccaatgacaaacattaattacggaactgagttctctcctgtcgttaactcccagatcctgccgccagaggaaccaacagactttaagcttagcacggccataaagactacagccatgagtaagaatattaaccccacaatgtcaagtcaaatccagggtaccactaaccaacactcctccaccgtattccctctgcttctgggcgctaccgagttccaggactccgatcagatgggccgaggtagggaacatttccagtcacgccccccaataaccgttcgaactatgattaaggatgtgaatgtcaagatgctgtcgtctaccaccaataaactgttgcttgaatcagtaaacacaaccaattcccatcaaacaagtgtccgcgaggtaagtgagccccggcacaaccatttctacagccacacaacgcagattctgtccacgtccacattcccgtctgatccccataccgccgcccacagccagttcccaataccaaggaacagcacagtgaatattcctctgttcaggcgctttgggaggcagaggaaaatcggtggccgcggacgaattatcagcccctatagaactcccgtcctgcggcgccacagatattcgatattccgaagtactactagggggtccagcgagaagagcaccactgctttcagcgctactgttctgaatgtcacgtgcctgtcctgcctcccacgcgagcgcctaaccactgccactgcagctctaagtttccctagtgcagcccctattacatttcccaaagctgatatcgcgagggtgccaagcgaggagagcaccaccctggtacagaacccactgctcctgctcgaaaacaagcctagtgtggaaaagactacacccacgatcaaatacttcaggaccgagatttcccaggtcactccaaccggcgccgtgatgacatacgcacccacaagcatcccaatggaaaaaactcacaaagtgaacgcaagctatccaagagtctcgagcaccaatgaagctaaaagggattctgtgatcacaagcagcttatctggcgcaataacgaaaccaccaatgacgatcatagctatcacacgtttcagtaggcgaaagattccttggcaacaaaacttcgttaataaccataacccaaagggccgcttgagaaaccagcataaggtttcactgcagaaaagtacagcagtcatgttacctaagaccagtccggctctaccaagagacaaggtatcaccctttcatttcacaactctgagcaccagtgtcatgcaaattccttccaacactctcaccaccgctcaccacactactaccaagacccataatccaggaagtcttcctactaagaaagaacttcccttccctcctttaaaccccatgctgcccagtattatctcaaaagacagtagcactaaaagtatcatttccacacagactgctattcctgccactactccgacctttccagcatctgtgattacctatgaaacacagactgagaggtctcgcgctcagacaattcagagagagcaggaaccgcaaaagaagaatcgtactgacccgaacatctccccggaccagtcctccggatttacaacgcccacagcgatgactccccccgtgctgactaccgctgaaacaagtgtaaagccatctgtgtccgcgtttacgcattccccccccgaaaataccaccggcatcagcagcacaatatcatttcacagccgaactctcaatcttaccgacgtgatcgaagaattggcccaggcatcaactcagaccttgaagtctactatcgcatcggaaacaacactgagcagcaaaagccatcagtctacgacaacacgcaaagcaataattagacattcaactatcccaccattcctgagttcttccgcaactttgatgccggtccccatcagccctccttttacccagcgggccgtgaccgataatgtagccacaccaatcagtggactgatgaccaacacagtggtgaagctgcacgagtcttcacggcataacgctaaaccccaacagctggtggcagaagtggccactagccccaaggtacacccaaacgctaagtttacaataggcacaacccatttcatctattcaaatctgcttcactcaaccccgatgccggcccttacaacggtgaagagtcagaattccaagctcacacccagtccttgggccgagaaccagttttggcataagccctacagcgagattgctgagaagggaaagaagccggaagtgtccatgctcgccactaccggactgagcgaagccactaccctggtctcggattgggatgggcagaaaaacactaaaaagtcagacttcgacaagaagcccgttcaggaggcgaccacttcaaagctcctgccctttgattcactttcaaggtacattttcgagaagccaaggatagtcggcggcaaggccgcgtcattcacaatacctgccaatagcgacgccttcctaccctgcgaggctgtaggaaatccactgcccaccattcattggacgcgagtgccttcgggactcgacttgtctaaacgcaagcagaacagcagagttcaagtcctgccaaatggtactctgtctatccagagggtggagatccaggatcgtggccagtacctctgctccgcttcaaacctgttcggcaccgatcatctgcatgttacactgagcgtggtcagctatcctccccgtatcttggaaagacggactaaggagatcacggtgcatagcgggtccacagtcgagctgaagtgccgggccgagggccgcccatcccctaccgtgacatggatcttggcgaatcagactgtggtctctgagtcttcccagggttcacggcaggccgtggtgacagtggacgggactttggtgttacataacctcagcatctatgacagagggttctacaagtgtgtggcctctaaccccggtggacaagattcactgttggtgaagatccaggtcattgcagctcctccagtgattttggaacagaggaggcaagtgatcgtcggtacgtggggcgaatcactgaagctaccttgtacggctaaggggacccctcagccatccgtgtattgggttttatcggacggcactgaagttaaaccactgcagtttaccaacagtaagctttttctgttttccaacggtactctatacattcggaacctggccagcagtgaccgcggcacatatgaatgcattgctaccagctctacaggatcagaacggcgggtagtaatgttgactatggaggagagagtcacctccccgcggatcgaggctgcgtcccagaagcgaaccgaagtcaactttggagacaaactgctcctgaactgctctgccacgggagaacctaagccccaaatcatgtggagattgcctagtaaggctgtggtcgatcagcaacatcgagtcggatcgtggatccacgtgtaccctaacgggtctctgtttattggatctgttactgagaaggattccggcgtttacctttgtgtcgcaaggaataagatgggtgatgacttgatcctcatgcatgtctcactcaggcttaaaccagctaaaattgatcacaagcagtatttcaggaagcaggtgctccacgggaaggattttcaggtagactgtaaggcttcagggagtcctgtgccagaaatctcttggtcgctgccggacggtactatgataaacaacgcaatgcaggctgacgactcagggcaccgaacgagaagatacacactgttcaataatgggaccctgtattttaacaaagtgggtgttgctgaggagggggactatacatgttacgcacagaatactctgggtaaagatgagatgaaggtgcacctgaccgtgatcacagccgctccccgcatccgccaatctaataagaccaacaagcggattaaagcaggagataccgcagtgctggattgcgaggtgacgggcgacccaaaaccaaagatcttttggctgttgccatcgaacgacatgatttctttttcaattgaccgatatacgtttcatgccaacgggagtttgaccataaataaggtcaaactgctggatagcggcgaatacgtgtgtgtcgccagaaatccatccggcgacgatactaaaatgtataagctagatgtggtatctaaacctccgctgataaacggcttatatacaaacagaaccgtcattaaagccaccgcagtccgacatagcaagaagcacttcgactgccgggccgagggaacaccttcccccgaagttatgtggattatgccagacaatatcttcctcacagccccctactacgggtcgcggattacagttcacaaaaatgggactcttgaaattagaaatgtaagattgtctgacagcgctgacttcatctgcgtcgcgcgtaacgaaggcggagaaagcgttctagtggtccagttagaggtcctggaaatgttacggcgcccaaccttccgcaatcctttcaatgagaagatcgtggcccagctcggaaaaagcactgcattaaactgttctgtggacgggaatcctccacctgaaatcatttggatacttccaaatggtacaaggttctcaaatggcccccagtcctaccagtacctaattgcaagcaacggttccttcatcatcagcaagaccactcgagaagacgccggcaaataccgatgcgccgcaaggaataaagtaggctatattgagaagctggtgatcctggaaatcggccagaaacccgtgatcctgacttacgctccgggaacagttaagggtatcagtggcgagagcttgtcactccactgcgtttccgatggcatccctaagcccaacatcaaatggaccatgccctccggctatgtggtagaccgtccgcagatcaatggcaagtacattctgcacgataatgggaccttggtcataaaggaggcgactgcctacgatcgcgggaactatatttgcaaagcacagaattcagtgggacacacccttataactgtaccagtgatgatcgtcgcttatccacccagaatcactaacagaccaccaagaagcatcgtaacaaggacaggggctgcgtttcagctgcattgtgtggctttgggcgtcccaaaacccgagatcacgtgggaaatgcctgaccactctttactgtccacggcctccaaggaacgcacacatgggtcggagcagcttcacctgcaaggtaccctggtgatccagaatccccagacaagtgattctggaatttataaatgtaccgccaagaaccctttaggctcagattacgctgcgacttacatccaagtcatctag

SEQ ID NO: 5314 - DNA, 1995 bp, Artificial Sequence
  Description of Artificial Sequence: Synthetic coding sequence
atgaagacgggcctctttttcctgtgcctactgggcactgctgcggccatcccgacaaatgctcgactgctatccgatcacagcaaacccaccgctgagaccgtcgctcccgataacaccgctattccaagtctgcgagcagaggcggaagaaaatgaaaaggagaccgctgtgagtactgaggacgacagtcatcacaaagccgagaaaagtagtgtgctgaaaagtaaggaggaaagccatgaacagtctgccgagcagggcaaaagctcaagtcaggaattggggctgaaagaccaagaggattcagatgggcatctcagtgtgaatttagagtacgcacctacagaggggaccctggatatcaaagaagatatgagcgagccccaggaaaagaagctgtcagagaacactgacttcctggcccctggtgttagctccttcaccgactccaaccagcaggagtccataaccaaacgggaggagaaccaggagcagcccagaaactactctcatcaccagctgaacagatcttcaaaacatagccagggcctccgcgatcagggtaaccaggagcaggaccctaacatatctaatggtgaagaggaagaagagaaggagcctggcgaagtgggaactcataacgacaatcaggaaaggaagacagaactgccacgagaacacgccaactctaaacaggaagaagacaatacacaaagtgatgatatccttgaagaaagtgaccagcctacccaggtgtctaaaatgcaagaggatgaatttgaccagggtaatcaagagcaggaggacaattctaatgcagagatggaggaggaaaatgcaagcaatgtgaataagcacatccaggaaaccgagtggcagagtcaggagggaaaaactggactagaggcgatcagcaatcacaaggagaccgaagagaagaccgtgtccgaagctctcctcatggaaccaacagatgatggcaacactacacccagaaatcacggtgtggacgatgatggagatgacgacggcgatgacggaggcaccgatgggccccggcattctgcatccgacgattacttcataccatcccaagcctttttagaggctgagagagcccagagtatcgcataccacttgaagattgaagagcaacgagagaaagtacatgagaacgagaatatcggtaccaccgaacccggagagcaccaagaggctaagaaagctgaaaatagctctaacgaggaggagacctcctctgagggcaacatgcgggtccatgcagtagacagttgcatgtcttttcagtgtaagagggggcatatctgtaaagcagatcagcaaggtaagccgcattgcgtgtgccaggacccagtgacctgcccgcctaccaaacccttagaccaagtgtgcggaaccgataaccagacctacgcctcctcttgtcacttgttcgcgactaagtgtcggctggaggggactaagaagggacatcaattacagctggactacttcggggcctgtaaatcgattccgacgtgtacagacttcgaagttattcagtttccactccggatgagggactggctgaagaatatactgatgcaattgtatgaagccaattctgaacatgctggttaccttaatgagaaacagagaaataaagtgaaaaaaatatatctcgatgagaagcgcctgcttgctggcgatcacccaatcgatcttttgctgagggacttcaagaagaattaccatatgtacgtgtatcctgtccattggcagttttctgaattggaccagcacccaatggaccgagtgctcacacactccgagttggcccctctgcgtgcaagcctcgtgccgatggaacactgtattacaagattcttcgaagagtgtgaccccaacaaagataagcatattaccctgaaagaatggggccactgtttcggaataaaagaagaagacatcgatgagaatctccttttttag

SEQ ID NO: 5315 - DNA, 1254 bp, Artificial Sequence
  Description of Artificial Sequence: Synthetic coding sequence
atgctggctttgctcgtcctggttacggttgcccttgccagtgcgcaccatgggggtgaacacttcgagggcgagaaagtgttccgggtgaatgtggaagacgaaaaccatataaacatcatccgcgagctggctagcacaacccaaattgatttttggaagcctgacagcgtaacccaaatcaagccacactcaactgttgatttccgtgtgaaggccgaggataccgtcactgtcgagaacgtgctcaaacagaacgagctccagtataaagtccttatctccaatctcagaaacgtggtcgaggcccagtttgacagtcgggtgagggctactggccatagctacgagaagtacaataagtgggagaccattgaggcttggacccagcaggtggccaccgagaaccctgctcttatcagtcggagcgtcatagggacaacgttcgagggacgggccatttacctcttgaaagtggggaaagcagggcagaacaaacctgccattttcatggactgtgggttccacgcacgggaatggatcagccctgccttctgtcagtggtttgttagggaagccgtccgcacctatgggcgggagattcaggtcacagagcttctggacaagctggacttttacgtcctgccagttctcaatatagacggatatatctatacatggactaagtcaagattttggcgaaagacccggagtacccacacaggatcctcatgtatcggcactgacccaaacagaaattttgacgcaggctggtgtgagatcggagcctcacggaacccgtgtgacgagacatactgtggcccggcagcggagtcagaaaaggaaaccaaggctctggccgactttatccggaacaaattgagtagcatcaaggcttacttgacgatccatagttattcccagatgatgatctacccttactcttatgcttacaagctgggggaaaataacgctgagctcaacgctcttgctaaggcgacggtgaaagagctggctagccttcatgggaccaagtacacctacggaccaggcgctacgacaatctacccggcagctggaggttccgatgattgggcttatgatcaaggcataagatatagcttcacatttgagcttcgcgacactggcagatatggcttccttctccctgaatctcagatcagagctacatgtgaggagaccttcctcgccatcaagtacgttgctagttatgttcttgagcacctctactag

SEQ ID NO: 5316 - DNA, 588 bp, Artificial Sequence
  Description of Artificial Sequence: Synthetic coding sequence
atggctgtgagccaaggggacgggaccctgtgctttgtactattgctgtgttgctggcaagaaacagagttgcggcccaggaccgtgataccgggttccccaactgaaatccctttctccagcaagcaggaggacatgagcgaactcctggatgagatactagttcaggagatactcgacctaaacaaaacgaccccatctgaaatgcccagcacggcatcaaccctttcaacacctctacatgcaggcatcgatgaaaactaccaggcaggggggagcgagaattaccacgagttattggagaatctacaattttcccctggcatagaggtgaagatcagtaacgacgaggcaaacgcaaacgctaaccttcatggtgatccgagcgaaaattacagaggccctcaggtgtcgcccggtagcgagaaatctgtctctagtaaagaaaaaaacagcaagaacactcaatatgaaaacctgtccattctggaccagattctgcagaatattggaaggtcatccggcaatatctttcacaaggagcagcagaggacgtcagcgcagagaaggtctcagggatcccagtag

SEQ ID NO: 5317 - DNA, 2334 bp, Artificial Sequence
  Description of Artificial Sequence: Synthetic coding sequence
atgaacgcaaacaaggacgaacgactgaaggcccgaagccaagactttcacttatttccggccctgatgatgctttctatgaccatgctctttttaccagtgaccggtactctaaagcaaaacataccgaggctgaaactaacctacaaagacttgctgttgtccaactcctgcatcccattcctgggcagttcagaggggctggattttcaaacactgctgttagacgaggagcgaggccggttattactgggcgccaaggatcacattttccttctgtcattggtcgacctgaacaagaactttaaaaaaatctattggcccgctgccaaggaacgagtggaattgtgtaagcttgcgggcaaagacgccaacactgagtgtgcaaactttatcagagtgcttcagccttataataagacccacatttacgtatgtggaaccggcgcatttcacccaatctgtgggtatatcgacctgggggtctacaaagaggatattatcttcaagttagacacgcacaacctggaatccggacgtttgaaatgtccattcgacccacaacagcctttcgcttcggtcatgactgatgagtatttatattctggaaccgcttctgacttccttggtaaggacacagccttcacaagatccctgggcccaactcacgaccatcattatattaggacggatatcagcgagcactattggctgaatggagccaagttcattggaactttctttataccagacacctacaatcccgatgatgataagatttatttcttctttcgggagagttctcaggagggcagcactagtgataagactattttgtcccgggtgggccgtgtgtgcaaaaatgatgttggggggcagcggagtctgatcaacaagtggaccacattcttgaaggcacggctgatctgttccattcctggcagcgatggcgccgacacctacttcgacgagcttcaggacatctatctccttcctacccgagacgaacgcaatcctgtcgtgtacggcgtgtttaccaccaccagcagtatctttaaagggagcgccgtgtgcgtttactcaatggccgatatccgggctgttttcaatgggccctacgcacataaggaaagtgcagatcaccgatgggtacagtacgatggtcgaatcccttacccaagacctggtacatgccctagcaagacctacgaccccctcataaagtctacccgcgactttccagacgacgtgatctcctttatcaaacgtcactctgttatgtataaatcagtctaccctgtggctggaggacccacctttaagagaatcaatgttgactataggctcacacagatcgtggtggatcacgtcatagcagaggatgggcagtacgatgtgatgtttctgggaacggatattggaaccgtgcttaaggtcgtgagcatctctaaagagaaatggaatatggaagaagtcgttttagaagagctccagattttcaaacacagctcaattattctgaatatggagttgtcattaaagcaacagcagctctacattggctctagagatggcctggtgcagttgagcctccacagatgtgatacctatgggaaggcgtgcgcggattgctgcttggcgcgcgatccttactgtgcttgggacggcaatgcctgcagccgttatgcacccacaagcaagaggagagctagacgccaggacgtgaagtacggggaccccattactcagtgttgggacattgaggattcaatcagtcacgaaaccgccgacgaaaaagtcatctttggcattgagttcaactctacctttctggagtgtatacctaaatctcagcaagctactatcaagtggtacatccagcggagcggggatgaacacagagaggaactgaagccagacgagagaattataaaaacagaatatggcctgctcatccggtctctccagaagaaggactctggtatgtattattgcaaggcacaggaacataccttcattcacaccatcgttaagcttacactgaatgtcattgaaaacgagcagatggagaacacacagcgggccgaacacgaagaaggaaaggtcaaagacctgctcgcagagagtcgtctacgctataaggattatattcagatcctcagtagcccaaacttttctctggatcagtattgcgagcagatgtggcatcgcgaaaagcggcgccagcgaaacaagggcggaccaaagtggaagcatatgcaagagatgaaaaagaagaggaaccggagacatcacagggatctagacgagttacctcgggcagtggcgacgtag

SEQ ID NO: 5318 - DNA, 1332 bp, Artificial Sequence
  Description of Artificial Sequence: Synthetic coding sequence
atgcaaccttcagaaatggtgatgaatccaaaacaggtctttctctcagtgctcatttttggcgtcgctgggctgcttctttttatgtatctccaggtttggattgaggaacagcataccggacgagttgaaaaaaggagggaacaaaaagtgacgagcggctggggacctgttaagtatctgcggcctgtgcccaggattatgtcaactgaaaaaattcaggaacatatcactaaccagaacccaaagtttcacatgccagaagacgttcgtgagaagaaagaaaatttgttactgaacagcgaaaggagtacccggctgctgacgaagacctcacacagtcaaggtggagaccaagctctgagtaaatcgacgggtagcccgaccgagaaactgatcgagaaacgccagggcgccaagacagtattcaacaagttcagtaatatgaactggcctgtggacatccacccactcaacaagagcctagttaaggacaataagtggaaaaaaaccgaggagacgcaggagaagaggaggagcttcttgcaggagttctgcaagaagtacggtggggtttcccaccaccaatcacacctattccacacagtatcaaggatttacgtagaagacaagcacaagatactctactgtgaggtacccaaggccggatgttcaaattggaaaaggatcttgatggttctcaatggattggccagcagcgcatataatatcagccataacgccgtgcactacgggaagcacctgaaaaagctggattcatttgatctgaaaggcatatacactagacttaatacctacacaaaagcagtattcgttagggaccctatggagcgccttgtcagcgcatttagggataagtttgagcacccaaattcctattaccaccccgtgtttgggaaggcgatcatcaagaagtacaggccaaacgcgtgcgaggaggccctgataaatggctcaggtgtcaagtttaaagaatttatccactacctcctagattctcaccggccggtaggaatggatattcattgggaaaaggtatcaaagctgtgctacccgtgcctgattaattatgacttcgtgggaaagttcgagacgttggaggaggatgcaaattactttttacagatgataggcgctccaaaggagcttaagtttcctaactttaaagacagacacagttcagacgagcgaaccaacgctcaagtggtacggcaatatctcaaagacctaacccgcacggagcgccagctgatctacgatttctactatctggactacctgatgtttaattacacaacccccttcttatag

SEQ ID NO: 5319 - DNA, 3228 bp, Artificial Sequence
  Description of Artificial Sequence: Synthetic coding sequence
atgagaggcgggaaatgtaacatgctgtcgtccctgggatgtctgctgctgtgtggctctatcaccctcgcgcttgggaacgcacaaaaattacctaagggcaagagacctaacctcaaagttcatattaatacaacatccgattccatcctgctgaaatttctgagacccagccctaacgtgaagctggaaggtctgctgctgggatacgggagtaatgtatcaccaaaccagtactttcctttgcccgccgaggggaaatttactgaggccatcgtggatgccgagcccaagtatctgattgttgtgcgcccagcccctccaccctctcagaaaaagtcatgctccggaaagacccggagccggaagcccctccaactggtcgttggaacactcacaccttctagtgtgtttttgtcctgggggttcctgatcaacccgcaccacgactggacactgcccagtcactgccccaacgacagattttacacaattcgttaccgagaaaaggacaaggagaaaaagtggatttttcagatttgcccagcaacagaaactatcgttgagaacctcaagccgaatacggtatatgagtttggagtgaaagacaacgtggagggaggcatttggtcaaagatattcaatcacaagaccgtcgtcggcagcaagaaagtgaacggcaaaatccagagcacttatgatcaggaccacactgtcccagcctacgttccaaggaagctgatccctataaccattatcaaacaagtgattcagaacgtgacacataaggatagcgcgaaatccccagaaaaggcacccctcgggggcgtgattctcgttcatctgatcatacctggcctaaatgagactactgttaaacttcccgcgtctcttatgttcgaaataagtgacgcattgaaaacgcagctggcaaagaacgagaccctggcactcccagcagaaagcaaaacacctgaagtggagaaaataagcgctcggccaacaactgtgaccccggagactgtacctcgatctactaagccaacaacatccagcgctctagatgtgagcgagacaactctggcatcatctgagaaaccttggatagtgccaacagcaaaaatctcagaggacagcaaagtgctccagccccagactgctacttatgacgtgttttcgagcccaacgacatcagacgagcccgagatctctgattcgtacaccgcaactagtgataggatccttgactctatccctcccaagacctcacgaacacttgaacagccgcgcgcaacacttgctccctcagagaccccattcgtccctcaaaagttggaaatatttaccagcccagaaatgcaaccgaccactcccgccccccaacagactacatcaatccccagcaccccaaaaagacgaccgcggcctaagccacctaggactaagcccgaacggacaacctcagccgggaccattacacctaagatttcaaaaagtccagagcccacctggaccacaccagcaccagggaagacgcagttcatttccttaaagcctaagatacctctgagtccggaggtgacacacaccaaacctgcccccaaacaaactccacgcgctccccccaaaccaaaaaccagcccgagaccgagaattccccaaacccagccagtccccaaggtgccccagcgggtgactgctaagcctaagacttctccttcccccgaggtgtcttacaccacacccgcccccaaagacgtgctcctgccccataagccctatcccgaggtcagtcagagcgaacccgcacctctcgagacccgtgggataccctttatcccaatgatctcaccttctccaagtcaggaggaactccaaacaacgctagaggagacggatcagtcaacgcaggagcccttcacaactaaaattcctaggactaccgagctcgctaagacaacccaggcccctcaccgtttctatacaacggttcgtccgaggacgtctgacaagccacacatccgcccaggtgtcaagcaggctccgcggccctccggtgctgatcggaacgtttctgtggactcgacccacccaaccaagaagcctggcacacgcaggcccccgctcccccctagacccacacacccccggaggaagccgctgccccctaataatgtgacaggaaaaccagggtcagcaggcatcatatctagcggccctattaccactccacccctgcggagcactccaaggccaaccggtacccccctagagcggatcgagacggatataaagcagcccacagtgccagcttcgggggaggaattggaaaatataaccgactttagttcctcccctaccagagagaccgaccctctcgggaaacccaggtttaagggtcctcacgtgaggtacatacagaagcccgataattctccttgttccatcactgactctgtgaagaggttcccaaaggaggaggccacagagggaaatgccacgagtcctccccagaacccaccaacaaatctgaccgtggtcactgttgagggctgtccatctttcgtgatactcgattgggaaaagccactgaacgacacagtgacggagtacgaggtcattagccgggaaaacggtagcttttctgggaaaaataagagcatccagatgaccaaccagacttttagcacggtagaaaatctgaaacccaataccagctatgaatttcaggtgaagccaaaaaatcccctcggggagggccccgtctccaatactgttgcattcagtactgagagcgccgacccaagagtgagcgagcctgtgtctgccgggagagatgcgatctggaccgaacggccgtttaacagtgattcttattcagaatgcaaaggcaagcaatacgtcaagaggacctggtataagaaatttgtgggagtacagctctgcaatagtctgcgctataaaatctacctgtctgatagtcttaccggaaagttttataacatcggcgatcagcgcggccacggcgaagaccactgtcagttcgtggatagcttcttggatggacgcaccgggcagcaattgacaagcgaccaactgcccattaaggaagggtatttcagggccgtgaggcaagagccagtgcagttcggcgaaatcggtgggcacacccagatcaactatgtgcagtggtatgagtgcggtacaaccatccctggtaagtggtag

SEQ ID NO: 5320 - DNA, 483 bp, Artificial Sequence
  Description of Artificial Sequence: Synthetic coding sequence
atgttaccctttctcttcttctcaactctcttcagctccattttcacggaagctcagaagcagtattgggtatgcaacagcagtgacgcatcaattagctacacatattgtgacaagatgcaataccctatcagcatcaatgtgaacccctgtattgaactaaaacggtccaagggcctactgcacatattctatatcccgaggagggacctgaaacagttgtatttcaacctgtacattactgttaataccatgaacctcccaaagaggaaagaggtgatatgccgggggtccgatgatgattacagtttctgcagggcccttaagggggaaacagttaatactacaatctcatttagctttaaaggaataaaattctctaaagggaaatacaagtgtgtggtggaagctatctctggttcacccgaggaaatgctcttctgtctcgagttcgtcatcctccaccagcctaacagtaactag

SEQ ID NO: 5321 - DNA, 780 bp, Artificial Sequence
  Description of Artificial Sequence: Synthetic coding sequence
atggccgccttaatgaggagcaaggactccagctgttgcttgctgctcctggccgcagttctgatggtggagagttctcagattggcagctcgcgcgccaagctcaactcgatcaaatcaagtctaggcggtgaaaccccaggtcaggctgcgaatagaagcgctggaatgtatcaaggtcttgcattcggcgggtctaaaaagggtaagaatcttggtcaggcatacccctgcagtagcgataaggaatgtgaggtgggcagatactgccatagccctcaccagggtagctcagcctgcatggtgtgtaggcgcaagaagaagcgctgccacagggacggcatgtgctgtcccagcacgagatgcaacaatggtatctgcatacctgtgaccgagagcattctgaccccacatattcccgcgctagacgggacgaggcacagggaccgaaaccatggacattactccaaccatgatctggggtggcagaacctgggaaggccacacaccaagatgtctcacattaaggggcacgagggtgatccctgcttgcggagctcagactgtatagaaggattctgttgcgctaggcatttctggaccaagatctgcaaaccagtgctgcatcaaggcgaggtgtgcacaaagcagcggaaaaagggatcacacggattagaaatttttcagagatgcgactgcgccaaagggttatcatgtaaggtgtggaaggatgctacctattcctccaaggctagactccacgtttgtcagaagatctag

SEQ ID NO: 5322 - DNA, 3030 bp, Artificial Sequence
  Description of Artificial Sequence: Synthetic coding sequence
atgggacagttgtgttggctccctttactggcccctttgcttcttctccggcctccaggggtccagagcgccggcccgatccgagcttttgtggtccctcattcacacatggatgtgggatgggtgtatacagtgcaagagagtatgagagcgtacgccgccaacgtatacacaagtgtagttgaagagttggctcggggacagcagcggaggtttatcgccgtcgaacaggaattctttcgtttatggtgggatggagtggcaagcgatcaacagaaataccaggtgcgacagttactcgaagaaggcaggctcgaattcgttattggcggccaagtgatgcacgatgaagccgttactcacctcgacgaccagattctgcaactgacagagggccatggcttcctatacgagacctttggtattagaccccagttcagttggcacgttgatcccttcggggcttcagctaccacaccgacgttatttgcacttgcgggattcaacgcacacctcggttcacggatagattatgacctaaaggctgccatgcaggaggcgcgagggctgcagttcgtgtggcgtggatcaccgtccctcagtgaacgccaggagattttcactcacataatggaccagtacagctactgtacacccagtcacattccattttcaaatcgctctggattctattggaacggggtggcagtgttccctaagcctcctcaggacggcgtctacccaaacatgtccgaacctgtaacaccagctaacataaacctttacgctgaagccttagtggccaacgtgaaacagagggccgcctggtttcgaaccccccatgttttatggccttggggttgcgataaacagttctttaacgcgagcgtgcagtttgccaacatggaccccttgttggaccacattaattcgcacgctgccgagctgggcgtgtcagtgcagtatgcaacactaggtgattactttcgagccctgcacgccctcaacgttacatggagagttagggatcaccacgatttcttgccctattccacagagccctttcaagcctggacaggcttttataccagcaggtccagcctcaagggattagcccgccgcgctagtgctttgctgtacgctggggagtctatgtttactcgatacttatggccagctcctaggggccacctcgaccctacatgggccctgcagcaacttcagcaacttcgttgggcagtttctgaagtccagcaccacgatgcaatcacaggcacagaatccccaaaagttagggatatgtacgcaactcatctcgcctctggtatgctgggaatgcggaagttgatggcatcgatcgtgctggatgagctgcaaccacaagctcccatggcagcctcatccgatgccggcccggcgggccatttcgcttcagtgtataatccactcgcttggacggtgaccactattgtgacattgacggtgggtttcccaggcgtgcgtgtgactgatgaagcgggacatcccgtacccagccaaatacagaattctaccgagacccccagtgcatacgatttgctgattttaaccacaatccctggcttgtcctacagacactataacataaggcccaccgccggtgctcaagagggcactcaggagccggcagctactgtcgcaagtacacttcagtttgggcggagactgcggcgtaggacaagccacgctggcaggtatttggtcccagtggcgaacgactgctacatcgtgctactcgatcaggataccaacctgatgcactccatctgggagcggcagtctaatagaacagttcgggtgacccaggagttcctggaatatcatgtaaatggtgacgtcaagcaagggcccatcagtgacaactacctattcacacccgggaaggccgccgttcctgcttgggaggctgtggagatggaaattgtggccggacagttggtcactgagatcagacaatacttctatagaaatatgaccgctcagaattacacctacgcaattcggtcccgcctgacacacgtgccccagggccatgatggtgagctactctgccaccgtatagagcaagagtaccaggctgggcctctcgaattaaacagggaagccgtgctgaggaccagcacaaacctgaacagccagcaggtcatctattcggataacaacggctatcagatgcaacgccgaccttatgtgtcttacgtgaacaattctattgcccgaaactactaccccatggtacagtcagctttcatggaggacggaaaatctagacttgtcctcctttctgaaagggcacatggcatcagctctcaggggaacggtcaagttgaagttatgttgcatcgtcggttatggaacaatttcgattgggatcttggctataatctgacactgaatgatacttctgtggttcaccccgtcctgtggctcctgctgggtagctggagcctgacaaccgccttacgccagcgatccgccctcgccttacagcatagacccgtagtcctttttggggacctcgccggcaccgccccgaagctgccaggcccacagcagcaggaggcggtgacactccctccaaacttgcacctacagatactgtcaattcccggatggaggtacagctccaaccacacggagcactcccagaacctgcgcaagggccaccggggagaggcccaggcagacttgcgacgggtcttgcttaggctgtaccatttatatgaagttggtgaagatcctgtgttaagccagccggtcacagtgaacctggaagcagtgttgcaggccctggggagcgtggtcgctgtcgaagagcggagtctgactggtacttgggacctgtcgatgctgcaccgctggtcttggagaactggtcctgggagacatcgcggtgataccacaagcccaagtaggccccccgggggacctataatcaccgtgcatccaaaagagattaggactttcttcatacattttcaacagcagtag

SEQ ID NO: 5323 - DNA, 1443 bp, Artificial Sequence
  Description of Artificial Sequence: Synthetic coding sequence
atgctttttagaaatcgcttccttctcttactcgccttagcggccttgctggcctttgtatcccttagcttgcagtttttccatttaatcccggttagcactccaaagaacggcatgtccagtaagtcaaggaagaggattatgccggatcctgttacggaaccccctgtaaccgatcccgtttatgaggcgctgctgtactgtaacatacctagcgtagccgagcgaagcatggagggacacgcccctcaccacttcaagttggtgagtgtacatgtgtttattcgtcatggggaccgataccctctctacgtaatcccaaagacaaagcgtccagagattgattgcacactagtcgcaaacaggaagccttatcatcctaagctcgaggcctttatctctcatatgtctaagggcagtggggcttcattcgagagccctttaaactctctgccactctaccctaatcatccactgtgcgaaatgggtgagctgacacagaccggagttgtacaacatttgcaaaatggtcagctgctgagggacatctatctcaagaaacacaaattgctgcctaacgactggtctgcagatcagttatacctagagaccactggcaagtccagaacactgcagtcggggctggccctgctctacggctttcttcctgattttgattggaaaaagatttacttccgtcaccagcccagtgcattgttttgtagcggatcatgttattgccccgtccgcaatcagtacctggaaaaggaacagcgacgtcagtacctcctgcggttaaagaattctcaactcgaaaagacatacggggaaatggcaaagatcgttgatgtacctacaaaacagctgagggccgccaatcccatcgactctatgctgtgccacttttgccataacgtgtcattcccttgcactcgaaacggatgtgtggacatggaacattttaaagtgattaaaacccaccagatagaggacgaaagggagcgaagggaaaagaagctgtacttcggctacagtttgttaggcgcgcaccctatcctcaatcagacaatcggtaggatgcagcgggccacagagggtcgcaaagaagagctgtttgcactgtattctgcacatgacgtaactctcagcccagtgctctccgccctggggctgagcgaagcgcggtttccacggttcgctgccaggctgatctttgagctgtggcaagatagagaaaaaccaagtgagcactcagtgcgaatcctgtataacggcgtagacgtgaccttccacacaagcttctgtcaagatcatcacaagcgctctccaaagcccatgtgtcccttagagaatctggtgaggtttgtaaagcgagatatgtttgtggcactcggcgggagcggaacgaactactacgatgcctgccatcgggaggggttttag

SEQ ID NO: 5324 - DNA, 1341 bp, Artificial Sequence
  Description of Artificial Sequence: Synthetic coding sequence
atgttacatccagaaacctcccctgggcgcggccatcttcttgctgttctgctcgccctgttgggcactgcctgggcagaagtgtggcctccccagctgcaggagcaggcaccaatggcgggcgccctgaatcgtaaggagtctttcctattgctcagcctacacaatcgactcagaagttgggttcagccaccggcggccgatatgcgtaggttggactggagtgacagtctggcccagctagctcaagcccgcgcggccttatgtgggacaccaaccccctcactggcctcgggcctatggcgtacattgcaggttggctggaatatgcagctgctccctgccggcctggtgagcttcgtcgaggtcgtgagcttgtggtttgcggaggggcagcgctatagccacgccgctggcgaatgtgcacggaacgccacatgcacgcactacacacaactcgtatgggccacaagctcacagctgggatgtggccggcatctttgctctgcaggacaagctgccatcgaagctttcgtatgcgcatacagtcctcgaggcaattgggaagtcaacggtaagaccatagtaccatataaaaaaggggcctggtgttccctctgcactgcttccgtgagcggatgttttaaagcttgggatcacgccgggggcctttgcgaggtgcccagaaacccctgccgcatgtcttgccaaaaccatggtcggttgaacatatccacatgtcactgtcactgcccccctggctacactggacgatactgtcaagtgaggtgtagcctacagtgcgttcacggaagatttagggaggaggaatgtagctgcgtttgtgacataggctatggcggagcgcagtgcgccacaaaagttcactttcctttccatacctgcgatttacgcatcgatggcgactgtttcatggtatcctctgaggccgacacctactatcgagccagaatgaaatgccaacgcaaaggcggtgttctcgcgcaaataaagagccaaaaggtccaagacatattggccttctacctgggtcgcttggagacaacaaacgaggtaattgactcagactttgagaccaggaacttttggattggattaacctacaagacagctaaagactccttccgctgggcaacgggcgaacaccaggcgtttacctcattcgctttcgggcaacccgataaccatggctttggcaactgtgtagagctgcaggctagcgccgcttttaattggaatgatcaacggtgtaagacaagaaatcgctacatttgccagttcgctcaggagcatatctctcgctggggcccagggagttag

SEQ ID NO: 5325 - DNA, 2313 bp, Artificial Sequence
  Description of Artificial Sequence: Synthetic coding sequence
atggtggaaagtgccggacgagccggccagaagcgcccagggttcctcgaaggtggtttgctcttactgctgttgctcgttactgccgcactagtcgccctaggggtgctctacgccgaccgacgtggtaaacagttacccagactagctagccggctatgttttctccaggaggagagaacctttgttaagaggaagccgcgaggcatccctgaagctcaggaggtgagtgaagtctgtaccacgccgggttgcgtgatagcggcagccaggatcctgcagaatatggatcccacaacagaaccttgcgatgacttctatcaatttgcctgtggtggctggctgcgccgccatgtcatacccgaaaccaattcgcggtactccatattcgacgtgctgcgggatgaattggaggtgattcttaaagctgtgctggaaaactccaccgccaaggaccgcccggccgtggaaaaggcacgaaccctctataggtcatgcatgaaccagtcagttatcgagaagcgcggcagtcagccgttattagatatcttggaggtcgttggcggctggccagtcgctatggataggtggaacgagaccgtaggcctcgagtgggagctagaacgtcagttggctttgatgaactcccagttcaatcgtcgcgtactgatagacctgttcatatggaatgacgaccaaaatagtagtcgccacatcatctacattgatcagcccaccctgggcatgcccagccgcgaatactactttaatggcggttccaaccgtaaggtgagggaggcatacctccagtttatggtatcggtcgccactttattaagagaagatgctaatctgccgagagatagttgtctcgtccaagaggatatggtccaggtattggaattggaaacccaactggcaaaggccacagttccacaggaggagaggcatgatgttattgccctgtaccaccgcatgggtttggaagagttacagagtcaattcgggctgaaagggttcaactggacactatttatccaaaccgtgctgtcctccgtcaagattaagctcctgcctgacgaggaggtagtggtttatggcattccgtacttgcagaatctcgaaaatatcatagacacctatagcgcccggacgatacagaactacctggtgtggcggctggtcctggaccgcattggaagtttaagtcaacggttcaaggacacaagagtgaattaccggaaggccctctttggtactatggtggaagaagtgaggtggcgtgagtgcgttggctacgttaattcaaacatggaaaacgccgtgggcagcctctatgtcagggaggcattccccggcgattcaaaaagcatggttcgggaactgatagacaaagtacggactgtctttgtggaaacactggatgagctcggctggatggacgaggagtccaagaagaaagcgcaggagaaagccatgagcatacgggaacagattggtcatcctgactacatcttagaagaaatgaaccgcaggcttgacgaggagtactccaacttgaacttctccgaagacttatacttcgagaactcgctacaaaacttaaaggtgggggcgcagaggagcctccgcaaactgcgggagaaggtggatcccaacctgtggataattggagccgcggtcgttaatgcattctacagcccgaaccgaaaccagattgtgtttccggcaggtattctccagccaccattcttttcaaaagagcagccccaggccttgaacttcggggggattggaatggtgattggccacgaaattacccacgggttcgatgacaacggacgcaacttcgataagaatggcaacatgatggactggtggtcaaacttttccacacaacatttccgcgagcagagcgagtgcatgatttatcagtacggcaattattcatgggacttggctgatgaacaaaacgtgaacggcttcaacacactaggggagaacattgccgataatggcggcgtgcgccaagcatacaaggcatacctcaagtggatggctgaaggcggaaaggaccaacagttacccggtctagacttgacacatgagcaactgttcttcataaattatgcccaggtctggtgcggctcttatagaccagaattcgccatccagtcaataaaaacggacgtgcacagccccttgaagtatcgcgtcctcggcagtctccaaaatctggccgctttcgctgacaccttccactgtgcccggggcactcccatgcacccgaaagaacgctgtcgtgtgtggtag

SEQ ID NO: 5326 - DNA, 1317 bp, Artificial Sequence
  Description of Artificial Sequence: Synthetic coding sequence
atgtcaaagcgagataaggctggcaaagatacagcacgcggcaaaggcaaggatatcagtaagtatggctctgtccagaagtcattcgcagaccggggacttcccaaacctccgaaggaaaaattactgcaggtggagaagcttcgcaaggaatctggaaagggatctttcctccagcctactgcaaaacctcgggcattagcgcagcagcaagccgttataagggggtttacatactataaagccgggaagcaagaagttacagaggcagtggccgacaacactcttcagggaacatcctggctggagcagctgcctcccaaagtggagggccgctcaaactcagccgagccgaacagcgccgagcaagacgaagctgagcctagatcctcggagcgggtggatcttgcaagcggcactcctacgagcattcctgctactaccacaacagcgacaacaacgccaacccccacaacgtctctgctacctaccgagccaccctctggcccagaggtgagctcccagggaagggaagcatcatgcgaaggaacgcttagagctgttgacccccccgtccgtcaccatagctatggcaggcacgagggggcctggatgaaggatccggcagctcgggacgatcgcatctatgtcactaattattactacggcaactcactggtggagtttcggaacctcgaaaactttaagcagggcagatggtctaacatgtataagttgccctacaattggatcgggactgggcacgttgtgtaccagggagccttttattacaatcgcgcattcactaaaaatataatcaaatacgatctccgccagaggttcgtagctagctgggctctgctgcccgacgttgtctacgaagatactacaccatggaaatggcgaggtcactccgacattgattttgccgtggatgaaagtggcttgtgggtgatctaccctgccgtcgatgacagagacgaggcgcagcccgaagtgatcgtgctgagccggctggaccccggggacttgtccgtccaccgagaaaccacttggaaaacccgtctgagacgtaattcgtacggcaactgtttcctggtatgtggcatactgtacgcggttgatacttacaaccagcaggagggtcaagtagcctacgcttttgacacccatactggtacagatgcgcggcctcagctccctttccttaacgaacatgcttacaccactcagattgattacaaccccaaagaacgagtgctatacgcctgggataacggacaccagctgacctatactctgcattttgtggtgtag

SEQ ID NO: 5327 - DNA, 3570 bp, Artificial Sequence
  Description of Artificial Sequence: Synthetic coding sequence
atgccgggattgctcaattggataaccggagccgctttacccctcacagctagtgatgtcacctcctgtgtgtctgggtatgccttaggattaacagcctccctgacatatgggaatctagaggcccagccgttccaggggctttttgtgtatccgcttgatgagtgtacaaccgtgataggcttcgaagccgtaatcgctgatagagtggttactgttcagattaaagataaggcaaagctggaatccggacattttgacgcttcgcatgtgaggtcccccacagttactggtaacattctgcaggacggtgtttcaattgccccacactcatgtacccctggtaaagtgacccttgacgaagatctagagcgtattctgtttgtcgctaatctagggaccatagcgcctatggaaaatgtcaccatctttatctctaccagtagtgaactgcctactctaccttccggtgccgtccgtgtgttgttacccgccgtatgcgcccccaccgttcctcagttttgcacgaaaagtaccggaactagcaatcagcaggctcagggtaaggaccgacactgcttcggcgcatgggcccctggatcgtggaacaagctttgcctagccacactactcaataccgaggtgagtaatccaatggagtacgagttcaactttcagctcgaaattaggggaccctgcctgctggctggtgtcgaatctccaacacacgagatccgcgcagacgctgcaccttccgctcgaagcgcaaaaagtatcattatcacgctcgctaataagcacacattcgacagacctgtagaaatcttgatccacccatctgagcctcatatgccacacgtgctaattgagaagggcgacatgacattgggtgaattcgatcaacatcttaaggggcgaactgattttattaagggaatgaagaagaagagtagggcggagcgcaaaaccgagattattaggaagcgactacacaaagacatacctcaccactccgtgataatgttgaacttctgccccgatttgcagtccgtgcagccatgtctccgcaaagcccacggggagttcatctttcttattgaccggtcctcatccatgtccggcatcagcatgcaccgcgtgaaggacgcaatgctagttgcactcaagagcctgatgccagcctgcctctttaatataatcggttttggaagcacatttaagtcactgttcccctccagccagacgtactccgaggactccttggcgatggcctgtgacgacatccagcggatgaaagccgatatgggtggcacaaacatcctcagccctctgaaatgggtgatcagacagcccgtgcaccggggacatcctcgcctcttgttcgtgattaccgacggcgcggtcaacaatacgggtaaggtgttggaacttgtgcggaaccatgcattctcaactcggtgttactcatttggaattgggccgaatgtgtgccaccgccttgtgaaggggctcgccagtgtgagtgagggctcagcggaacttctcatggagggcgagaggctgcagccaaaaatggtcaagtcgctcaagaaagcaatggctccagttctgtcagacgttacagtggaatggattttccctgagacaacagaggtgctggtatccccagtttctgccagttcattgttcccaggggaaagactcgtcgggtacggaatagtgtgtgacgccagtcttcacatcagcaatcctcgctccgataaaaggagacgctacagcatgttgcatagtcaggagagtgggagctccgtcttctatcattcacaagacgatgggccagggttagagggtggggactgtgcgaagaactctggggctccattcatcctaggtcaggcgaaaaatgcccggcttgcatcaggggacagtactactaagcacgatctgaatctgtcacagaggcgccgagcttactccaccaaccagataactaatcataagccactgccccgtgctaccatggcgtccgacccgatgccagccgctaagcggtaccccttgcgcaaagccaggttgcaggatctgaccaatcaaactagcctggacgtgcagaggtggcaaatcgacctacagcccctgctcaacagcgggcaggacctgaaccaagggccaaagctgcgcggaccgggtgcccgacgtccatccctgttgccccaaggatgccagcctttccttccctggggtcaggagacccaggcttggtcccctgtgagagagcgtacatcagattctagatccccaggggaccttgaacctagccatcatccttcagccttcgagacggagacaagctctgattgggatccgccagccgaaagtcaggaaagggcttcacccagtcgccccgctactccagctccagttctgggaaaggcactagtaaaaggactccatgattcacaaagactgcagtgggaggtgtctttcgagttaggaacaccagggccagaacgtgggggagcacaggacgctgatctgtggagcgaaacattccaccatttggccgcaagggccattatcagggacttcgaacaactcgccgagagggagggcgaaatcgagcagggatctaacaggcgataccaggtctccgctttgcatacctcaaaagcctgtaacatcatctctaaatatacggccttcgttcccgttgacgtgtcaaagagcaggtacctgcccacagttgtggagtatcccaatagtgcggctcttcgaatgctgggtagccgtgccttggctcagcagtggaggggcacctcgtccggttttgggcgaccgcagaccatgctcggggaggactctgcccctggcaacggcccccagaggagtctggctacaaacaccttgtcttccatgaaggcttcagagaatttattcggatcatggttaaaccttaacaaaagtcgcctacttacaagggccgccaagggattcctgtccaaacccctgattaaggccgtagagagtacaagtggtaatcagtctttcgattatataccccttgtctcattgcaactggccagcggggcttttctgcttaatgaggctttctgcgaagccacacatatccctatggaaaaactgaaatggactagtcccttcacctgtcatagggtatctctcaccacgaggccttcggagtcaaaaacccctagtcctcagctctgcaccagtagccccccgcggcatccgtcttgtgacagcttcagcctcgaacctctcgcgaaagggaagttaggactggagccaagggcggtcgtggagcacacgggcaagctgtgggctaccgtggtgggacttgcgtggctcgagcactctagcgcttcctatttcacagagtgggagcttgtcgccgccaaagcgaattcctggctggagcaacaagaggttccagagggacgcacccaggggaccttaaaagctgccgcaagacagttattcgtgctgttacgccattgggatgagaacctggaatttaatatgctctgttacaatcctaattacgtttag

SEQ ID NO: 5328 - DNA, 1344 bp, Artificial Sequence
  Description of Artificial Sequence: Synthetic coding sequence
atgccccacgttctgattgagaaaggggatatgacccttggcgagtttgaccaacatctgaagggcagaacggactttattaaaggtatgaagaagaaaagtcgagccgaaagaaagactgagatcatacggaaaagactgcacaaagatatcccgcaccactctgtcatcatgctgaatttttgtcctgatctgcagagtgtgcagccttgccttcgcaaggcccatggggaattcatctttttgatagatcgctcaagctcaatgtccggcatctccatgcacagagtgaaggacgcaatgctggtggcgcttaaatcgctaatgcccgcctgcttatttaatattatcggattcggctcgacctttaagtccctgttcccatcatctcagacttatagtgaagattctctagccatggcctgtgacgatattcaacggatgaaagccgacatgggcggaacaaacattctgagccccctgaagtgggtgattcgacagccagttcaccgcggtcacccccgactgctgttcgttatcaccgatggtgctgttaacaacaccggcaaggtgctcgaactcgtgcgaaatcacgcctttagcacccgttgctactctttcggcataggaccaaacgtttgccacagactggtgaagggtctagctagtgtgtcggaggggagtgccgagctcctgatggagggtgagaggctacagcctaaaatggtaaagagtctgaaaaaggcaatggcaccagtcctctcagacgttacggtggagtggatatttcccgaaactacggaagtgctggtttctcctgtgagtgcctcgtccctatttcccggagagcggctggtgggctatggtatcgtatgtgatgcgtccctgcatatttcaaatccacgtagcgataagaggagacgatatagcatgctgcacagccaggagagcggcagttctgtgttctatcactcccaggatgacggaccgggtctggaaggcggagattgcgctaagaacagcggcgctccgttcatactgggccaagcaaaaaacgctagacttgcaagtggggactctacaaccaagcacgatctgaacttatctcaaaggcggagagcgtacagtactaatcaaatcaccaaccataagcctctccctagagcgactatggcaagtgatccaatgcctgccgctaagaggtatccgctcagaaaagcccgacttcaggatctaacaaatcagacctcattggatgttcaaagatggcagatcgacctgcaggccttcatctgcctcacatctgaggacacctttcaaatcagaacacctaccggccagtag

SEQ ID NO: 5329 - DNA, 726 bp, Artificial Sequence
  Description of Artificial Sequence: Synthetic coding sequence
atgtggaccgtgagaacagaagggggccacttccctctgcactctcccacttttagctggagaaatgttgccttccttctgctcttaagcctcgccctcgaatggacctctgccatgctgaccaagaagataaagcataaacccggtctgtgtccaaaggaacggcttacttgtactactgaactcccagattcgtgtaacactgacttcgattgtaaagaatatcagaagtgttgctttttcgcatgtcaaaagaaatgcatggatccattccaggagccgtgtatgcttcccgtcaggcatgggaactgcaatcacgaagcccagcgatggcatttcgattttaaaaactatcgttgtaccccttttaaatatcgggggtgtgagggtaacgcaaacaattttctcaatgaggatgcttgccggaccgcttgcatgttgattgtcaaagatggccagtgccccctgttcccgtttactgaaaggaaggagtgccccccatcatgccattctgacatcgattgccctcagacagacaagtgttgtgagtcccgctgtggctttgtgtgcgcacgcgcatggactgtgaagaaaggcttttgccctcgtaaacctctgctgtgcaccaagattgacaagcccaaatgcctgcaggacgaggaatgccctctcgtggaaaaatgctgttcgcattgtggcctaaaatgcatggaccctagacgatag

SEQ ID NO: 5330 - DNA, 1074 bp, Artificial Sequence
  Description of Artificial Sequence: Synthetic coding sequence
atgcgccctcctcctgccttggctcttgccgggctctgcctgctcgcactgcccgctgccgcagctagttacttcgggctcaccgggcgcgaagttctgactccctttccaggcctcgggacagcagcagcaccagctcagggaggcgctcacctcaagcaatgtgatttactaaaactctctcggaggcaaaaacagttgtgcagaagagagcccggtcttgccgagactctgagggatgccgctcatctgggattacttgaatgccagttccagtttcgccacgagaggtggaactgcagtctggagggaagaatgggcctgctgaaaaggggattcaaggaaactgcattcttgtacgcagttagctccgccgccctgacacatactctggctcgagcatgtagcgccgggaggatggaaagatgcacttgtgacgactctcctggattggaatcgaggcaggcatggcaatggggcgtctgtggcgacaacctgaaatacagcaccaagtttctaagtaactttctcggatccaaaaggggcaataaggaccttcgcgcaagagcggatgcccacaacactcatgtaggaataaaagcagtcaagtcagggctgcggacaacctgtaagtgccatggggtcagcggctcctgtgccgtgcgtacatgctggaagcagctgtccccttttagagagactgggcaggtactaaaattgcggtatgatagcgctgtgaaagtttcatccgccaccaatgaagcacttggccggttagagctctgggcccccgcccggcaagggtccttaaccaagggattggctcctaggtccggcgacctggtttatatggaagacagcccatccttttgccgccccagtaaatacagtccagggacggcgggacgagtctgctctagggaagccagttgctcctccctgtgctgcggtcgagggtacgatacacagtctcgattggtagcatttagctgtcactgtcaggttcagtggtgctgctacgtagaatgccagcagtgcgtccaagaagaactcgtgtacacatgtaagcattag

SEQ ID NO: 5331 - DNA, 810 bp, Artificial Sequence
  Description of Artificial Sequence: Synthetic coding sequence
atggtcaggtgtctgggcccagccttattgcttcttttacttctgggttccgctagcagtgttggaggcaaccgatgcgtcgacgctgcagaggcttgtaccgccgatgcccgttgtcagagactgcgctcagagtatgtcgcacagtgcctcggcagagccgcccaaggtgggtgtcccagagccaggtgcaggcgagcactgaggcgcttcttcgcacggggcccgcccgctcttactcacgcgctccttttctgcccttgcgcaggacccgcatgtgctgaaagacgcaggcagactttcgtcccatcttgcgccttttccgggcccggccccgcccctcctagctgtctggaacctctcaacttttgtgaacggtccagggtgtgtagaccaaggcttcttgcctttcaagtgagctgtactccagcacctagcgcgcctgacggatgcctccttgatcagggcgcacggtgcttacgggcatatgcaggcctggtggggacagctgtgactcccaattatgtggataatgtgtcggctcgcgtggctccgtggtgtgattgtggggcttctgggaatcgcagggaggattgcgaagcatttagagggctgtttactcgaaacagatgtctagatggagctatccaggcgtttgcatcaggttggcctcccgtgttattagatcaactgaatccgcaaggcgatcccgaacattccctgctgcaggtctctagtaccggcagagcactcgaacggagatcattgttgtcgatactccctgttctggccttgccagctctattatag

SEQ ID NO: 5332 - DNA, 1728 bp, Artificial Sequence
  Description of Artificial Sequence: Synthetic coding sequence
atgtccggtaactgggtgcacccaggccagatactgatatgggcaatttgggtcctcgcagctccgacaaaaggcccaagtgccgagggtccccagaggaatacgagactaggctggattcagggaaaacaggtgaccgttcttggctccccggtacccgttaacgtcttccttggtgtgcctttcgcagccccccctctgggctctttgcggttcaccaatcctcagccagcctcaccttgggacaacctacgtgaagccacatcttaccccaacctgtgcctccagaattccgaatggctgctcctggatcaacatatgctcaaggtgcattaccctaaatttggcgtgtctgaggactgtctgtatctcaacatatacgcacctgcacacgccgacacaggcagcaagctgccagtgcttgtgtggtttcccggtggagcgttcaagaccggatcggcctccatcttcgatgggtctgccttagccgcatatgaggacgtcctcgtagtggtggtgcaatacaggctggggattttcgggttcttcacgacatgggaccagcacgctccaggaaattgggctttcaaagaccaggtagccgcactctcctgggttcagaagaacatcgaatttttcggaggagacccctcctccgtcaccatctttggtgaaagcgccggcgcgatttcagtgtcgagcctgatcctgagccctatggcaaaggggctgtttcataaggccattatggaatcaggcgtcgctattatcccatatctggaggctcacgactacgagaaatctgaggatcttcaggtggtggcccacttttgtggcaacaacgcctcagattcagaagccctgttgaggtgtctgcgtaccaaaccttccaaggaacttttaacactcagccagaagacaaaatcttttacgcgggtggtggatggagccttcttcccaaacgaacctttggacctgctcagccagaaagccttcaaggctataccatccatcattggggtcaataatcatgagtgcggctttctactcccaatgaaggaggcccctgagatacttagcgggtctaacaaaagcttggcactgcaccttatccagaatattctgcacattccaccacagtatctgcacctggtggccaatgagtacttccatgataagcattctctgacagagattcgcgactcgctgctcgacctcctgggggacgtcttctttgtcgttccggccttgataacggcccgctaccaccgcgatgccggcgctcccgtttacttctacgaatttagacaccgaccccagtgctttgaagatactaagccagcgtttgtcaaggctgaccacgccgatgaggtcagatttgtatttgggggcgcttttctgaagggagacatcgtgatgtttgagggggctacagaggaagagaagctgctgtcacggaagatgatgaagtactgggcaacctttgccagaaccggaaacccgaacggcaacgacctgtccctgtggcccgcctacaatctgactgaacaatacctccagctggacctgaatatgagtctcggtcaacggctgaaagaaccccgtgtggacttctggactagcacaatcccccttatactaagtgcttcggacatgctccattctcccctgtctagtctcacttttttgtcattgctgcagccatttttctttttttgcgccccttag

SEQ ID NO: 5333 - DNA, 1026 bp, Artificial Sequence
  Description of Artificial Sequence: Synthetic coding sequence
atgggaaccctcccttggttgcttgctttctttattctcggacttcaggcctgggatactcctaccatcgtttcgcgtaaggaatggggagccaggccactcgcttgtcgggccctgcttacactacccgtcgcttacataatcaccgatcaattgccaggcatgcagtgtcagcagcagagcgtatgttctcaaatgctgcgcggcctccagtctcattccgtgtacaccatcggttggtgtgacgtggcatacaacttccttgtgggcgatgatggcagggtttatgaaggagttggatggaacatacagggactgcatacacaagggtacaataatatctctctgggaatagcattcttcggcaataaaattggttcgtccccctcccccgccgccttgtcggcggcagagggtctgatctcctacgcaatacagaagggccatctctcccctcggtacattcaaccgctgcttctgaaagaagagacctgcctcgacccccagcaccccgtcatgcccagaaaagtgtgcccaaacatcattaaacgatctgcatgggaggccagagagacacattgcccaaagatgaacttacctgccaagtatgtaattattattcacacggcaggaacttcttgtactgtctcaactgattgtcagaccgtagtgcgtaatatacagagctttcatatggatacccgcaacttctgcgacataggctaccattttctggtgggtcaagatggaggcgtttacgagggggtggggtggcacattcaaggctcccacacttacgggttcaacgatattgcactgggcattgcatttattggctattttgtagaaaagcctcccaacgcagccgcactggaggccgctcaggacttaatacaatgtgcggtggtcgaaggctacctcacacctaactatctcctaatgggacattctgacgtggtcaatattctctcgcccggacaggctctatataatatcataagcacctggcctcactttaaacattag

SEQ ID NO: 5334 - DNA, 897 bp, Artificial Sequence
  Description of Artificial Sequence: Synthetic coding sequence
atggggatcgtgtgtgctcagtgtagtttcatactcctgctgtccatcattagggcgagaccaccccccttccttttctgtcccctgtcttcacaacgaactgaaagcccgtataagcctgtgcacctaggacttggcccgaccgacaaggttgctgctatcgccatggctcgcatcatcgaccttgtaccatgggatgatggctccactcacgtatatgcttccccagctatactgctcccaatggagagacagcggaatcagttagcaggggtgaaacaacaactgtaccatccggcgttgcccacccttaggcacatggacagggataccgtcaaggcctgcctaccagatgagcactgccagagcaccacatattgtcgtaaggatgagttcgacaatgcacatttcaccctcctcggcgtcccaaacaaaccccttcagtgcctcgatatcacagccactggacagaagctgagaaaccgataccatgagggcaagcttgccccaatcgcgcctggcatcaaccgggtggattggccctgttttacgagagctattgaggattggtcccattttgtgagttccgctggcgagttcaagttaccatgtctgaggaagcgcgctgaggggctgagtggttatgctgtcagatatctaaaacccgatgtgacgcagacttggaggcaggaagcgctatgtggggcgtgggccggccgcccctgctcacccgactctccaagaccttacccctgttgccccccccaatattgtctttcacaaaatccttcgctggaccggtacggccagaagcctttgccgtttgacagtctgaacactttccgcagcttcggaagctcttatagtagagtaaactacctgactccgtggcattag

SEQ ID NO: 5335 - DNA, 5799 bp, Artificial Sequence
  Description of Artificial Sequence: Synthetic coding sequence
atggctcctggcgcattacggggcggctgtgagcagagggccccgggcgggggtgcccgcactgccgccctaggtccttggccctggccatcacccggtccagccccaagcccaggcgctgctccacccaggtcaagaaaaatgtcgggtgcgcttctatggcctctgctgccgctgctccttctgcttttgtcagctagagatggagtccgggctgcccaaccccaggccccagggtacctcatcgccgctccaagtgtgttcagggcaggcgtggaggaagtaattagcgttactatcttcaatagccccagagaagtcacggttcaggcacagcttgtggctcagggtgaacctgtagtacagtcccagggggctattcttgataagggcacaataaagctgaaggtgcctaccggactcagaggtcaagccctgctgaaagtgtggggaagagggtggcaagccgaggaggggccactgttccataatcagacatctgtgacggttgacgggaggggagccagcgtttttattcagacggataaacccgtctacaggccacagcatcgcgtgctgatctccatctttacagtgtcccctaacctccggcctgtgaacgagaagctcgaggcctacatcctagaccctcgtgggtccagaatgattgagtggagacatctcaaacccttttgttgcggcatcacgaatatgtcctttccactgagtgatcagccggttctgggcgagtggtttatctttgtggagatgcagggccatgcatataacaagtcatttgaggtacagaagtatgtcctgcccaagttcgagctgctaatagatcctccacgctatatccaggatctggacgcatgcgaaacaggaactgtccgcgccagatacacatttggaaaacccgtagcaggggcacttatgatcaacatgactgtcaatggcgtaggctattacagccatgaagtgggtcggcccgtactccggaccaccaagatcctgggaagccgcgattttgacatctgtgtgagagacatgattccagcagacgtacctgagcatttccgggggcgggtctccatttgggcgatggtgacttccgttgacgggtctcagcaggtggccttcgatgattcaacccccgtgcagcggcagctcgttgatatacgttactctaaggatacccgaaaacagtttaagccaggactggcctatgtaggtaaggtcgagctatcttaccccgacgggtcccccgccgaaggcgtgaccgtgcaaatcaaagcagagttgaccccgaaagataatatctacacatctgaggtcgtgtcacagcgcgggctggtgggtttcgaaatcccctccatcccaacatccgctcagcatgtctggctcgagaccaaggtaatggcactcaacggaaagccagtgggcgctcaatacctcccgtcatatctgtcactgggtagctggtacagtccttcccagtgctacctccagctccagcctccatcacatcctttgcaagtgggcgaggaggcatacttctctgtgaaaagcacttgcccttgtaatttcaccttgtactacgaggtggccgcccgcggcaatattgtactctcagggcagcaacctgcccacacaacccagcagcgttccaagcgtgcagctcctgccctcgaaaaacccataaggctgacacacctgtctgaaaccgaaccaccacccgccccagaagccgaggttgatgtctgtgttacttccttacacctggccgtgactccatccatggtccctcttggcagactgctggttttttatgtgcgagaaaacggagagggcgttgctgatagtctgcagttcgctgtcgagactttcttcgagaaccaagtatctgtgacctattctgccaacgagacacaacctggcgaagtggtggatctgcgtatccgcgcggcccgtggcagttgcgtgtgtgtggctgcggtcgacaaatccgtatacctcctgagaagtgggttcaggttgacgcctgcccaagtgtttcaagagctcgaggactacgatgtatctgacagctttggagtcagcagagaggacgggcctttctggtgggcgggactcactgcacaacgcagaaggagatcatcagtgttcccatggccctggggcatcactaaagactctggcttcgcattcacggaaactgggctcgtcgttatgacagaccgggtgagccttaatcaccgtcaagacggaggcctgtacacggatgaggcagtgcctgctttccagccccacactggaagtctggttgctgtcgcaccctctaggcacccgccgaggaccgagaaacggaagcgaacatttttcccagagacctggatctggcattgcctgaacataagcgacccttcaggagaggggaccctgtctgtgaaggtcccggactcaatcacttcctgggtgggtgaggcagttgcattatctacttcacagggtctaggcatcgctgagcccagtctcttgaagaccttcaaaccctttttcgtcgatttcatgctcccagctttaataattcgcggagaacaggtgaaaatccctctgtcagtgtacaactatatgggtacctgtgccgaggtgtacatgaagttgtcagtgccgaagggaatacagttcgtcggtcaccccggcaaacggcacgttactaagaagatgtgtgtggcacccggcgaggcggaacctatttgggtcgtactctccttttctgacctggggcttaacaacattaccgccaaagccttagcatacggcgatacaaattgttgtagggatggtcggagcagcaagcatcccgaggaaaaccatgctgataggcgggtgccaatcggagttgaccatgttcgacgatccgtgatggttgaggcagagggggtccctcgcgcctatacatacagcgccttcttttgtcctagcgagagagtccatatttcaacccccaataaatacgagttccagtacgtccagaggccgctgaggttgactagatttgacgtggccgtgagggcccacaacgacgctcgggtggccttaagtagtggcccacaggatacagcagggatgatcgagatagtgctgggggggcatcagaatacacgttcatggatttcaacgtccaaaatgggggaacccgtagcctccgcccacacagccaaaatactcagctgggatgagtttcggaccttttggatttcctggagaggaggcctgattcaggtgggccacgggcccgaaccgagcaacgaatctgtgattgtagcatggaccctgcctagaccccccgaggtgcaatttattggcttctctacagggtgggggagtatgggagagtttaggatttggcggaagatggaagtggacgaatcctatagcgaagcgtttacattgggcgtgccccacggggcaatacctgggagcgaaagagctactgcctccatcattggtgacgtgatgggcccaacactcaatcatttgaacaatttgctgcgactgcctttcgggtgcggagaacagaacatgattcattttgcccctaacgtgttcgtcctgaagtacctgcagaagactcagcagttatctccagaagtggagcgagagactacagactacttggtgcagggctaccagagacagttgacgtacaagcggcaggacggatcatatagcgccttcggtgagcgggatgccagcggcagcatgtggctgactgcttttgtgctcaagtctttcgcccaagcgcgctcgttcatctttgtggacccaagggaattggcggcagctaaatcctggataattcagcagcagcaggctgatggtagctttctggccgtaggccgcgtgctgaacaaggacatccagggcggaatccacgggacagtgccccttaccgcatacgtggtggttgcactgcttgagacaggaacagcttccgaagaagaacgcggctccacggacaaagctaggcactttcttgaaagtgccgcgcctctggcaatggatccttactcctgcgccctgactacctacgctctgaccttacttcggagcccagctgcacctgaggcattgcgcaagctgcgcagtctggcgataatgagggatggtgtcactcactggtctttgtctaactcatgggacgtggacaaggggaccttcctgtctttttccgaccgggtgagccagagtgtggtgtccgcagaagtggaaatgactgcatatgcacttctcacatacaccctgcttggcgatgtcgccgcggccctacccgtggtaaaatggctcagccaacagagaaatgcccttggcgggttttcaagcacacaggatacctgtgtcgctctgcaagccctcgccgaatacgcgatcctcagttatgctggtgggatcaatctcacagtgagcttggcgagcacgaatcttgattaccaagagacatttgaactccaccggacaaaccagaaggtcctccagaccgccgctattccatccctgcctactgggctgtttgtgagcgcaaaaggcgacgggtgttgcttgatgcaaattgacgtgacttataatgtgcctgacccagtcgcgaagcctgcctttcaactgcttgtgtcactccaggagccagaggcccagggaaggccacctccgatgccagcctccgccgcagaaggatctagaggtgactggcccccggccgacgacgacgaccccgccgccgaccagcaccaccaggagtacaaggttatgctggaagtctgcaccaggtggcttcatgcgggatcctccaacatggccgtcctcgaagtgccattgctgtccggcttcagggccgatatcgaatctctggaacaattgctgctggataagcacatgggcatgaaaagatacgaagttgctggaaggcgcgtgctgttttactttgacgaaatcccctctcgttgtctgacttgcgttagatttcgggctttgagggagtgcgtagtgggccggacatctgcactccctgtgtccgtatacgactactacgagcctgctttcgaggccaccagattttacaatgtatctacgcactccccattagccagggagctctgtgcaggacctgcctgtaacgaagtagagcgagcaccagctcgcggtccaggctggttcccaggtgagagtggaccagccgtggcccctgaggaaggtgccgctattgctagatgtggctgcgatcatgactgcggtgcacaggggaacccggtgtgtggatctgacggggtggtctatgccagtgcctgtcggttacgagaggctgcctgccgccaagcggcaccgctagaacctgcaccaccgtcttgttgtgccctggaacagcgactccctgccagtagttcatctacatacggcgatgacctcgcctcggtggccccaggaccccttcagcaggatgttaagcttaacggtgctggcctagaggtggaggattccgatcctgagcctgagggcgaggccgaggacagagttacggcagggcctagaccccccgtatccagcgggaacctggaatcatcaacgcagagcgcttcgccttttcacagatggggccagacacccgccccacaacggcactccggcagagtagtgggggctcaccgccctggactgctgagccccgtgttcgtctactcacccgcctttcagagcggtggtgaggagggcctttggatgtccaatacgtgtactttgcgctag

SEQ ID NO: 5336 - DNA, 1209 bp, Artificial Sequence
  Description of Artificial Sequence: Synthetic coding sequence
atggtatgtgcaagggccgcattgggccccggtgcactgtgggcagccgcctggggggtcctgctgttgactgcaccagccggagcccaacgtggccgtaaaaaagtggtccacgtgctggaaggggagagcgggtctgtggtcgttcagaccgcccccggacaggtcgtctcacatcgcgggggcacaattgtgctgccttgtcgataccattacgaggccgcagctcacgggcacgatggcgtgcgtcttaagtggaccaaagtggtggaccctctggcctttacagacgttttcgttgcgctgggaccccagcaccgagcgtttggtagttaccgcggccgcgctgaactacagggagatggacctggggatgcctcactggtgctgcggaacgtcaccttacaggactatggacgatatgagtgtgaggtcacaaacgagctggaggatgatgcagggatggtgaaacttgacctggaaggcgtggtttttccctaccaccctcgaggtggcagatacaaactgacttttgctgaagcccaaagagcctgtgccgaacaagacggaatccttgcgtctgctgagcagttgcacgcagcgtggcgagatggcctggattggtgtaacgcaggctggctgcgagatggaagtgttcagtaccctgtcaatcggcccagagagccttgcggtggtttggggggaacaggctctgccggaggcggcggcgacgctaacggcggcctgcgaaattatgggtatcggcacaacgctgaggagaggtatgatgcattttgctttacatcaaaccttccggggagagtcttcttcctgaaacccctgaggcctgtgccgtttagtggagcagcaagggcttgtgcggcccgcggagccgctgtcgctaaagtgggtcagctcttcgcagcttggaaacttcagttgctggatcggtgcaccgcgggatggttggccgacggctccgcccgctatcccatcgtgaatccccgggcccgctgcggcggaagacgccctggagttaggtccttgggatttcctgacgctacgagaagactttttggagtgtactgttaccgagccccaggagcgcctgacccagctcccgggggctggggatgggggtgggccggcggtggaggctgggccggcggcgccagagaccccgcagcgtggacaccgctgcacgtgtag

SEQ ID NO: 5337 - DNA, 1740 bp, Artificial Sequence
  Description of Artificial Sequence: Synthetic coding sequence
atgtctgcattgagacctctcctgcttctcctcctccctctttgtcctggccctgggccaggtccaggctcagaggcaaaagtcactaggagttgcgccgagacacgacaggttctgggcgcacgagggtacagcctgaatctgataccgccggccctgattagtggagaacatctccgcgtttgtccgcaagagtacacttgctgttcttctgagactgaacagagactgataagggagaccgaggccacctttcgggggctcgtggaggatagtgggtcttttttagttcatactctcgctgctaggcaccggaagttcgacgaattttttctagaaatgctctccgtcgcccaacacagtctgacccagctgttctctcattcctacgggcgactgtacgcacagcacgcgcttattttcaatggtcttttttcacgattacgcgatttctatggcgagagtggtgaaggattggatgacacgttggcggatttctgggcacagctgttggaacgcgtgtttccgcttttacacccccagtactcctttccacccgattacttactgtgtctctctcggctcgcctccagcaccgacggttccttgcagccctttggagacagtccccgccgcctgagactgcagatcacaagaaccctggttgctgctagggccttcgttcagggactcgaaaccggccgtaacgtggtttcggaagccctcaaagtgccagtgagtgagggttgttcacaggccctgatgcgccttattggttgccctctgtgtcggggagttccgagccttatgccatgccagggcttctgtttgaacgttgtccgcggctgtttgagcagccgtggattggagcctgactgggggaactacttggacggccttctgattctcgcagacaaactccaggggccattcagtttcgaattgactgctgagagtatcggggttaaaatctctgaggggctgatgtacctgcaagagaatagcgctaaagtttccgcccaggtgtttcaggagtgtgggccacccgatcccgtgcctgccaggaatcgcagggccccacccccgagggaggaggcggggagactgtggtcaatggtgaccgaagaggaacggccaaccacagccgccggaactaacctccatcgcctggtgtgggagctgcgggagcgactggcccggatgagaggcttttgggctaggctcagtctaaccgtgtgtggcgactctcggatggccgccgatgcgtcactggaagccgccccttgctggactggcgccggacggggcaggtacttaccacctgtggtaggtggctcacctgcagaacaggtgaacaacccagagctgaaagtggacgcctcaggtccagacgtgcctacccgccggcgcaggctccagcttcgcgctgctactgccaggatgaaaacagccgcattgggtcacgacctggacggtcaggacgctgacgaagacgcgtccggatccgggggtggacagcagtacgcagacgattggatggccggggcagtggcgcccccagcccgaccccctaggcccccttacccaccacgacgcgatggtagcggaggcaagggcggaggtggatctgcacggtataaccaggggcgttctcgaagcggcggagcctccataggatttcacacacagacaatcttgattctcagtctatccgcgctggctctacttggaccacgttag

SEQ ID NO: 5338 - DNA, 498 bp, Artificial Sequence
  Description of Artificial Sequence: Synthetic coding sequence
atggctttgctcgcgctgctactcgtcgtggcgctgccaagggtgtggaccgatgccaacctgacagcaagacagagagacccagaagattcccagcgcacagatgaaggtgataatcgcgtgtggtgtcatgtctgcgaaagggagaatacattcgaatgtcagaatcccagaagatgtaagtggaccgagccctactgtgtcatcgccgcagtgaaaatcttcccccggttttttatggtggccaaacagtgctcggccggatgcgctgctatggagagaccaaaacctgaggagaagaggtttttgctggaggaacccatgccctttttttatctcaaatgttgcaaaattcgttattgtaaccttgagggccctccaattaactctagcgtcttcaaggagtatgctggtagtatgggagaaagttgcggaggcctgtggttggctatcttgctcctgcttgccagcattgctgctggtctgagcctttcatag

SEQ ID NO: 5339 - DNA, 933 bp, Artificial Sequence
  Description of Artificial Sequence: Synthetic coding sequence
atgaacgggctgagtttgtcggaactgtgctgcctcttctgctgcccaccatgcccaggtcgtatcgccgccaagcttgcgtttctgccacctgaggcaacttatagcttggttcctgagccagagcccggtcccggcggagccggcgccgcacctctgggcacactccgagcaagttcaggggcccctgggcggtggaagctccacctaactgagagggccgacttccaatactcacagagggagcttgataccattgaggtgttccccaccaaaagcgcacgcggaaacagggtcagctgcatgtatgtcaggtgtgtgcccggggcgcgctacactgtgttgttttcccatggcaacgctgtagatttaggtcaaatgagctctttctacataggcttgggctccaggttgcattgcaatatctttagctacgactatagcggttacggagctagtagcggaagaccctccgagaggaacttgtacgccgatatagatgccgcctggcaagctctcaggacccgctatggcatatccccggattccattattctctatggccagagtattggcacagtccctacggtcgacctggccagtcggtacgaatgtgcggcggtagtgctccatagccccttgaccagcggcatgagagtggcctttccagacaccaaaaaaacatactgctttgacgcgtttcctaacattgagaaggtatccaaaatcacatcacccgtccttattatacacggcacagaagatgaggtgattgattttagccatggtctggcactgtacgagaggtgccctaaagcagtggaacctttgtgggttgaaggtgcagggcacaatgacatagaactttacagccagtatttagagaggctcagacggtttatctctcaggagcttcccagtcagcgggcctag

SEQ ID NO: 5340 - DNA, 1905 bp, Artificial Sequence
  Description of Artificial Sequence: Synthetic coding sequence
atggcgcagggtgtcctgtggattctgctgggcctgctgttgtggtcagatccgggcaccgcctccctccctcttctgatggattccgtgatccaggctctcgccgagctggaacagaaggtgccggccgccaaaactcgacatacagcctccgcttggctaatgagtgctcccaactccggaccacataataggctgtaccatttcttacttggagcatggagtctgaacgctaccgaactggatccctgtcctctgtcgcccgaattgttaggactgacaaaggaagtggcgcgtcacgacgtgcgagagggaaaggagtacggtgtggtgcttgccccagatggttccacagttgccgtggaaccgctgcttgctgggctggaggcggggctgcagggccgtcgtgtgattaatctgcctctggacagtatggctgccccctgggagactggagataccttcccagacgtggtggccatcgcaccagatgtgcgtgcgactagttcaccgggcttgcgcgatggatctcctgatgtaacgactgccgacataggggccaatactccagatgcaacgaaaggatgccctgacgtccaagccagcttgcccgacgccaaagctaagtctccccctacaatggttgactccctgctggccgtaacattagcagggaacctggggttaactttcctgcggggcagccagacccagagccacccagacttgggcaccgaaggttgctgggaccagctgtcggctccaagaacgtttaccttactcgatcccaaggccagcctcctgacaatggcatttttgaacggcgccctggacggtgtaatcttgggagactatttgagccgcacgccagagccaagaccctcactgtcacatctgctcagccagtactacggagccggtgtcgcccgggaccctggctttcgatcaaattttcgtaggcagaatggggcagccttgacctctgcgtctatcttagcccagcaggtctggggcactctggtgctcctgcagcggttagaaccagtgcacctccaactccagtgtatgtctcaggaacagcttgctcaggtggctgccaatgctactaaggaattcacggaggccttcctcggttgccccgcgattcatcccagatgtcggtggggggcggcaccgtatagagggcgacccaagttgctgcagcttcccctcggctttctctatgtccatcacacctatgtgcctgctcctccgtgcacagactttacgcggtgcgccgcaaacatgcgctcgatgcaacggtaccaccaggacacccaaggctggggagatattggctactcctttgtagtcggatctgatggatatgtgtacgaaggccgcggctggcattgggtaggagctcatactctggggcataactcccgagggttcggggtggcaattgtcggaaattataccgccgctctgccaaccgaggccgcactcagaaccgtgcgcgatactctccctagttgcgccgtcagggctggcctcctacgcccagactacgcgttgctaggccacagacagctggtccgtactgattgtcctggagatgcactttttgaccttctacgcacgtggccacatttcactgctgtgtccctcaggtcgttgcactacaccgctcgaaggccaagtgtgtacacctccagcacgcgccccctgccacctgcctgcaattcttgtgctcgcacagcttctgcccggcctcccacatcccggcgacacgtttatagcggaaacctggggcctgcttttgcagggcactcggctgggaatattcccgaccccgtgacctcagcctatgccgcttctgcacagccacagacacagccagcctgtcccttcccctctagttag

SEQ ID NO: 5341 - DNA, 777 bp, Artificial Sequence
  Description of Artificial Sequence: Synthetic coding sequence
atgcttgtgctttacggccactccacacaggatctgccagagacgaatgcccgtgtagtgggtggaacagaggctgggcgaaacagttggccttcacagatttctttgcagtatcggagtggcggctccagataccatacttgtggcggaactttgatccgccagaactgggtgatgactgccgcccattgcgtggattaccaaaagacctttcgtgtagtcgccggagatcacaacctgtcccagaatgatgggacagaacagtatgtgagtgtacagaagattgtcgtccatccttactggaacagcgacaatgtcgccgcaggctacgacatagcactcctgagactagcgcagagtgttacacttaactcatacgtccagttgggcgtcctgcctcaagagggtgccattcttgcaaataattcaccatgttacataactgggtggggcaagaccaagaccaacggtcagctcgcccaaaccctgcagcaggcatatttaccctctgtcgactacgctatctgtagcagcagctcttactgggggtccaccgtgaaaaacactatggtgtgcgctggcggcgacggggtgaggtcagggtgccagggagacagtggaggccccctgcactgtctggtgaacggcaagtattccgtgcacggtgtcacttctttcgtgagctcacgagggtgtaacgtttcgcggaaacctactgtgttcactcaggtgtctgcctatatcagctggatcaataatgtcatcgccagcaactag

SEQ ID NO: 5342 - DNA, 993 bp, Artificial Sequence
  Description of Artificial Sequence: Synthetic coding sequence
atggctgccagaaggtcccagaggaggagaggcaggagaggggaacccggaaccgccctgctggtgcctctggctctaggactgggcctggccttggcatgcttgggattacttttggcggttgtttcgctggggagccgggctagtcttagcgcccaggagccagcccaggaagaacttgtggccgaggaagaccaagatccgagtgaattgaaccctcagactgaggagtcacaggatcctgcaccattcctgaaccgccttgtccggccaagaaggagcgccccaaaaggccgtaagactagagcacgccgagccatcgcagcgcattacgaggttcaccccaggccgggccaggacggagctcaggccggtgtggatgggaccgtgtccggttgggaggaagcccgcatcaatagctcatctccactcaggtacaaccggcagatcggtgagttcatcgtcacacgggctggactctattacctgtattgccagtccagcgatgctcttgaggcgtgggaaaatggggagcgctctcggaagcgacgcgcagtgttgactcaaaaacaaaaaaagcagcactcagttctgcatctggtgcctatcaatgccactagcaaagacgactccgacgtgacggaggtaatgtggcagccggctcttcggagaggtcgtggccttcaagcccaggggtatggtgtgcgcatccaggacgccggcgtttatctattatattcccaagtgctttttcaggacgtcacgttcacgatgggccaagtagtctcaagagagggacagggacgccaggagactttgtttcgttgcattagaagtatgccctctcatccggacagggcatacaattcctgctactccgcgggagtgttccatcttcatcagggcgatatcctgagtgtcattattccccgtgcccgggccaagctgaacctttcaccacacggcacctttctggggtttgtcaaactgtag

SEQ ID NO: 5343 - DNA, 2253 bp, Artificial Sequence
  Description of Artificial Sequence: Synthetic coding sequence
atggcgaagccacgactcctggtgctctattttgctttgatagtggttcctgcctgggttagttccattgtgcttactggaactagcgaacctcctgatgcacagacagtggctccagccgaggacgaaactctacagaatgaggccgataatcaagaaaacgtactgagccaactcttgggagattatgacaaagtcaaggcgatgtcggagggcagcgactgtcaatgtaagtgtgtggttagaccattaggacgggacgcttgtcagagaataaatgctggagcatcacggaaagaagatttttatacagtggagaccatcacaagtggcagctcctgtaaatgtgcttgcgtggccccccccagtgcactgaacccctgtgaaggtgattttcgattacaaaagctacgtgaagcagatagccaggacttgaaactctcgacaataatagacatgcttgagggagccttctatggccttgacctcctgaagcttcactccgtcactacaaagctggttggccgggtcgataaattggaggaggaagtgtctaagaacctgacaaaggaaaacgagcagatcaaggaggacatggaagagattcggacagaaatgaacaaaagaggtaaggaaaactgctcagaaaatatccttgattcaatgcctgacataaggtccgccctccagcgcgacgccgcagctgcctatgcccatccagagtacgaggaacgattcttgcaggaggagaccgtgtcccaacagattaattctatagagctccttcagacacgaccattggcattacctgaggtggttaaatcacaaagaccactgcaaaggcaggttcatctcagggggaggcccgctagccaacctacagtgatccgcggtatcacctattacaaggcaaaggtatccgaagaggaaaatgatatcgaagaacaacaagatgaattcttttcaggcgacaatggtgtggatcttctgatcgaggatcagctgcttcggcacaatggccttatgacatctgtgacgcgtcgaccagcagcaacgcggcagggccattcaacggccgttacttccgacctcaacgccagaaccgccccttggagcagcgcactgccacaaccttcaaccagcgatcccagtatcgcgaatcatgcatccgtgggcccgacgctgcagacaacgtctgtgtctcccgaccctacccgcgaatcagtactgcagccttcaccacaggtcccggcgacaactgtagcccatacggcgacccaacaaccagctgcacccgccccccccgccgtttccccaagggaggctctgatggaagcaatgcataccgtgcccgtaccccccaccacggtaagaaccgatagccttggtaaagacgcccctgccgggtggggaacaactcccgcctccccaactctgtcccccgaggaagaggatgacatcaggaatgtgattggccgctgcaaagacacactgagtaccatcaccggacccaccacacagaatacatacggtcgcaacgaaggcgcctggatgaaggaccccctcgccaaggatgagagaatttatgtaacaaattattattacgggaacacactcgtggagtttcggaatctggaaaactttaagcagggtcgatggtccaatagctacaagttgccgtactcatggattggcacgggccatgtggtgtataatggagctttttattataatcgggcgtttacaaggaacattatcaaatatgacctgaaacagagatacgtcgctgcctgggcaatgttgcatgatgtggcttacgaagaggccacaccctggcgatggcaaggccatagcgacgtcgactttgctgtggatgaaaatggcctttggcttatttatcccgcccttgacgacgagggtttttcccaggaggtgatcgtcctatcaaaactgaacgctgcagacttgtccacccagaaggagacgacgtggaggaccgggcttcggaggaacttctatggcaattgttttgtgatttgtggagtgttgtatgcggtcgacagctataaccagagaaacgctaatatcagctacgccttcgacacacataccaatactcagatcgtacctcggctgctgtttgaaaatgaatactcttatacgactcaaattgactacaaccccaaggatcgcctgctgtacgcttgggataatggccatcaggtcacataccatgtcatctttgcatactag

SEQ ID NO: 5344 - DNA, 678 bp, Artificial Sequence
  Description of Artificial Sequence: Synthetic coding sequence
atgaaacttggctgcgtgctcatggcttgggccttgtatctttctctgggggtgctgtgggtggcccagatgcttctggccgcaggctgtcatgccgagctgttcccagccccgatacttcgggcggtgcctagtgccgaacctcaggcaggatcacctatgaccttgagttgccagaccaagctgccgctacagcgatcagcagctcgacttcttttttctttctataaggacgggagaatcgtgcagtcgcgcggcctctcgtcagagttccagatcccgaccgctagcgaggaccactctggttcttactggtgtgaagctgccacagaggataatcaggtgtggaaacagtcaccacagctggagatacgcgtgcaaggtgcttctagctccgcagccccaccaaccctgaaccccgccccccagaagtctgcagcaccgggcacagccccggaggaggccccaggtcccctgccgcctccccccaccccctcttccgaggaccccgggttttcctcccccctgggaatgcccgaccctcatctttatcaccagatggggctcttattaaagcatatgcaggatgtcagggtgctgttagggcacctgctgatggagctgagggaactgtcaggtcaccggaaacctgggaccacaaaggccacagccgagtag

SEQ ID NO: 5345 - DNA, 891 bp, Artificial Sequence
  Description of Artificial Sequence: Synthetic coding sequence
atgtccagacaggagcctaagatgttcgtcctgctgtatgtgacaagtttcgctatatgtgctagtggacagcctagggggaaccagttaaagggcgagaactactccccgcgctatatctgctcaatcccaggactgcccggccctcctgggccgccaggggctaacggatcacctggaccccacggccgaatcgggttgccaggcagagacggacgtgatgggagaaagggcgagaaaggggagaaggggaccgccgggcttcgaggaaaaaccggtcccctcggcctggccggagaaaaaggagaccagggtgagactggcaaaaaaggccctatcggaccggagggcgagaaaggagaggtcggacctatcgggccacccggtcccaagggggatcgcggcgaacagggggacccagggctacctggtgtgtgtcgatgcggaagcatcgtcctaaagagcgcgttttccgtcggcataaccacctcttaccccgaggagagacttccaatcatttttaataaagtcctgttcaatgaaggtgaacactacaacccagccactgggaaattcatttgtgcctttccaggaatctattacttctcctacgacataaccttagctaacaagcacctagccatcggcctcgtgcacaatggccaataccgtattaaaacttttgacgccaataccggtaatcatgacgtggcctctggatctactgtaatatatctgcagccagaggatgaggtatggctggagatctttttcaccgatcaaaatggcctatttagcgaccctggttgggcagactcattgttcagtggttttcttttgtatgtggatactgactatctcgacagcatctctgaggatgacgaattgtag

SEQ ID NO: 5346 - DNA, 1275 bp, Artificial Sequence
  Description of Artificial Sequence: Synthetic coding sequence
atggggtcccttgttctcaccctctgtgcactgttctgcctggccgcttaccttgtctcgggctcccctattatgaatctcgagcaatctcctctagaggaggatatgtctctgtttggcgacgtcttctccgaacaggatggagtggattttaataccttgctgcagtctatgaaggacgagttccttaaaacactcaatttatctgacatcccaacacaggactccgcaaaagtggaccccccggaatacatgttagaactgtataataaatttgctactgacagaacctccatgcctagcgccaatattattcggtccttcaagaacgaggacttgttctcccagccagtttccttcaatggcttacgtaagtacccactgctattcaatgtatccatacctcaccatgaagaagtgatcatggccgagttacgcctgtatactctggtgcaacgtgatcgcatgatctacgacggcgtcgataggaagattaccatatttgaagtcttggagtccaagggggataatgagggcgaacggaatatgctggtgctggtatcaggggaaatttacggaactaattcagagtgggagaccttcgacgtcacggatgcaattcgcagatggcaaaagtcaggtagctccacgcaccagttggaggtccacattgaaagtaaacacgacgaggccgaggacgcgagctctgggagactggaaatcgacacatccgcccagaacaagcacaaccccctgctgattgtcttctcagatgatcagtcctcagacaaagaacgcaaagaggagttgaacgagatgatttctcacgagcagctccctgagctggacaacctggggttagatagtttttcttcaggaccaggcgaggaagcgctcttgcagatgaggtcgaatatcatatacgacagtacagcaaggataaggagaaatgctaaaggcaactattgcaagcgtacccccctttacattgacttcaaagagataggttgggatagctggattatcgcccctccggggtacgaggcgtacgaatgccggggggtatgcaattaccccctggctgagcacctcacccccacaaaacacgcgatcatacaggccctcgttcacttgaagaacagtcaaaaagctagtaaagcgtgctgcgtccctacaaagctcgaacccatttcaattctatatctcgacaaaggagttgtcacctacaagtttaagtatgaggggatggcagtgtctgaatgcgggtgtcgatag

SEQ ID NO: 5347 - DNA, 381 bp, Artificial Sequence
  Description of Artificial Sequence: Synthetic coding sequence
atgcacttgtctcagctcctagcctgtgcccttctgctgaccctcttgtcactgcgacccagtgaggctaagcctggcgccccaccaaaggtccctcgtaccccacctgcggaggagctagccgagcctcaggccgccggcggtggacagaagaagggagataaggccccaggaggcggtggagcaaacttgaagggcgatcgctctcggctattgagagatctgagggtggatacaaagtcccgggcggcttgggcacgcctgctccaagagcaccccaatgccaggaagtacaagggtgcaaacaagaagggcctcagcaaggggtgctttgggctcaagctggataggattgggagcatgtccggtctgggttgttag

SEQ ID NO: 5348 - DNA, 423 bp, Artificial Sequence
  Description of Artificial Sequence: Synthetic coding sequence
atgcgatcacctcgtatgagagtgtgcgctaagtcagttttactgtctcactggctcttcctggcctacgttctgatggtgtgttgtaaactgatgtcagcaagcagtcagcatctgcggggacatgccggccaccatcagatcaaacaggggacctgcgaagttgtggctgtccatcggtgctgcaacaagaatcgtatcgaggaaagatcccagactgtgaagtgttcatgcttccccggccaggtggccggcacgacgcgggctcagccaagttgcgtggaggctagcatcgttatccaaaagtggtggtgtcacatgaatccatgtctggagggcgaggactgtaaggttttgcctgattactccggctggtcctgcagtagcggcaacaaagtaaagactacaaaggttactaggtag

SEQ ID NO: 5349 - DNA, 1332 bp, Artificial Sequence
  Description of Artificial Sequence: Synthetic coding sequence
atgctcatgctgtttgtttttggcgttctgctccatgaagtaagcttgtctggccagaatgaggcacctccaaacacgcacagcatccccggggagccactctacaattatgcctccatcagactacctgaggagcatatccccttcttcttacataacaacaggcatatcgctactgtgtgcagaaaggactccctatgtccatataaaaagcacctggagaagctgaaatactgctgggggtatgaaaagtcttgtaaaccagaatttaggtttgggtatccagtatgttcgtacgtggacatgggctggactgacactcttgaatccgcagaggacatcttctggaagcaggctgatttcggctacgcaagggaacgcctggaggagatgcatgtgctgtgccagcctaaggagacatccgacagctctctggtttgcagcaggtatctgcaatattgccgcgccaccaacctttatctcgacctgcgcaacatcaagaggaatcacgaccgcttcaaagaagactttttccagtcaggtgagatcgggggacattgtaaattggatatcagaactttgacttctgaaggccaacggaagtctccacttcagtcttggttcgctgagctgcagtcatatacacagcttaacttccggcctattgaggatgcaaagtgcgacattgttattgagaagcctacctacttcatgaagctagacgccggagttaacatgtaccaccatttttgtgacttcattaacctgtacattacccagcatgtcaataatagtttttccactgatgtttacattgtgatgtgggacaccgacgggaagataagagtgacgatcctggccaggagcactgaataccggaagattctgaaccaaaatgagctggtcaacgcgctcaaaacagtcagcacgtttgaggtacagatcgttgactacaaataccgagaactaggcttcctggaccagctgcggattacgcataacaccgatatcttcatcggcatgcacggagccggtctcacacatctcctgttcctgcctgattgggccgccgtcttcgagctatacaattgcgaggacgaaaggtgctatctggatctggccagactaaggggtgtccactacataacctggcgcaggcaaaataaggtgttccctcaggataaagggcaccacccaactctcggcgagcacccaaaatttaccaattattcctttgacgtggaggagttcatgtatctggtgttacaggcagcagatcatgtgcttcagcaccccaagtggcctttcaagaagaaacatgatgagttatag

SEQ ID NO: 5350 - DNA, 336 bp, Artificial Sequence
  Description of Artificial Sequence: Synthetic coding sequence
atgggtccctcctcctgcctgctgctaatactgatccccctgctccagctgataaatcccgggtctacccagtgcagcctggattctgttatggacaaaaagatcaaagacgtgcttaactcacttgagtactcacccagcccaataagcaagaagttgagttgcgcatctgtcaagagccagggtcggccttcgtcctgtccagcaggaatggctgttaccgggtgcgcctgtgggtacgggtgcggcagctgggacgtccaactagaaactacgtgccactgtcagtgctcagtggttgactggacaaccgcgaggtgctgtcacctaacctag

SEQ ID NO: 5351 - DNA, 1965 bp, Artificial Sequence
  Description of Artificial Sequence: Synthetic coding sequence
atggcacccaaaaaactgtcctgcttgagatccctgctgttacctctgagccttaccctgctcctgccacaggcagacacacggtcattcgtcgtggatcgcggccacgatcgattcttgcttgacggagctccctttagatatgtctcaggtagcctgcattacttccgcgtgcctcgtgtgctatgggcggaccggctgcttaagatgcggtggagcggactgaacgcaattcagttttatgtcccttggaattaccatgagcctcagccaggcgtttacaactttaatggcagtagagatctgatcgcctttctcaacgaagcggccctggccaatttacttgtgatacttaggcccggaccctatatctgtgctgaatgggagatggggggtctcccaagttggctgctcagaaaaccggagatccatctgcggacctccgaccctgatttcctggcggctgtcgatagttggtttaaagtcctgctcccgaaaatttacccttggctctaccacaacggcgggaacattattagcatccaggtggaaaatgagtatggctcgtacagggcttgtgattttagttacatgcggcacctggccggcctcttccgagctctgttaggagaaaaaatccttttatttactaccgacggaccagagggcctcaaatgcggatcgcttcggggactctacaccaccgttgacttcgggcctgccgacaatatgacaaaaatctttacattgcttaggaagtacgagccacacggccccctcgtgaactcagaatattatacgggctggttggattattggggccagaaccacagcacccgttccgtctccgcggtaaccaaggggcttgagaatatgctgaaacttggagcatctgttaatatgtacatgttccacggcggcacgaacttcgggtactggaatggcgctgacaagaaagggcgattcctgcctatcaccacgagctacgactacgacgctccaattagcgaggccggagacccgacccccaaactgtttgctttacgggatgtcatctctaaattccaggaagtaccactaggccctcttcctccaccttcccccaagatgatgctgggaccggtgactctccacctggtgggacatctcctggcgttccttgatctgttgtgccccagggggccaatccatagtatcttgccgatgacattcgaggcagtcaagcaggaccacggattcatgctttaccgaacctacatgacacacaccattttcgagccaactcccttctgggtccccaataacggcgtccacgatcgggcttatgtgatggttgacggcgtttttcagggggtggtggagaggaatatgcgagataaactttttctgacgggcaaactgggcagtaagttagatattctggttgagaacatgggccggttgtcgttcggaagtaacagttctgacttcaaaggacttctgaaacccccaattctgggtcaaacaatcctgacacagtggatgatgtttcccctcaaaatagataacttggtaaagtggtggttccctctacaactccctaagtggccctatccacaggccccctctggtcctactttttatagcaaaacctttccgatactcggtagcgttggggatacatttctatatcttcccggatggactaagggccaggtatggataaacggcttcaacttaggcagatactggaccaaacaggggccacagcagactttgtatgtgccgaggttcctactgttcccacgtggggcactgaataaaattacactgctggaactcgaggacgttcctttgcagcctcaggtccagttcttagacaagccaatcttgaatagcacttccactctgcatagaacccacatcaactcactgtcggcagacactcttagcgctagtgagcctatggaacttagcggacactag

SEQ ID NO: 5352 - DNA, 2502 bp, Artificial Sequence
  Description of Artificial Sequence: Synthetic coding sequence
atgaacatggaaattgggcacccccatgagggaaaggacgatcttggcgacaagcgcgtaattatggggactaagttcccaatggagcttggcattagagtcgggctgggaaaggaggactcacggtgtggcgaatcaccagtggtttcgaataaatgtgagggccggatggctcctcctgagacaaaattcccactgagcaagggactggagatgggacttgaacggcaaaatatttcaaggacagtgatgcagcgcgggagtctcggtgtggactctgtgagtgcgtctcagggcaccaagccatcgctactgccaggtaggatgggccttgagaatgaatcgctgctggccggatacactcacgaacgtataattcagcctccactcgggcgagtatgtgggtcgtcacaggctgctggttcccgcagggcaccgctagcgtcagggcctgagggggttgaggagctggttggtaagcccgcctttgtcatggaacccagacaggagatggagaaggaatccacatgtgtgctgatgaagcccaacacagagatcaaactgcctgtagaggtggatattgggctgacacaggctgagggaccagatgaaactaaaaacactgaaccgcaaatgggattggtcatagagccccctcagtgccagtttgcccagcagcatgagcagagaaaggaagcaggaaatatcgagtccggagtcgagcctccagataggattagacctatttatagtggtaaattctttgacaggacgccatgctggccttccgcgggaaaagtgattccagtcgggtatcgagtggcaacgtgcctgacagagaagctacccagacttattactccccccgaagcaaaaaaatattttaattttaggtatcctcccgccggggttgagcgcgtgttctatggacgtgcgaacgacccgcagattgccccctaccttacccacggcatccgttccaaaatcagtgtgctggctaatactctgatcaatccacagccaattaccacatttcaacagaagattaaagataagaaggaatcaatctacctctcgaatcggagagctcctttgggtaaatcccacgatcaggctccaggcctgcctaaagggatggacacgaccaatacaacatttggcaccgcggttatcaaggagtacagcgccaaggacgtagtaaatccccctaagagctatgaggaagtgtttaaagaaggaaacgagggacacgatctgtacgtagtctcacacaacgactactacgccggcgaggctaaaaaccgtaagtacaaccctagcagcttccacaggtgttccgtgtacggtgtgcctaccccgcacttcaacgacggccgagccatggccaagtccctctattggttacatgagctgcagatgaaaagaggagccaagtttgtgagtaaacgcgctgacgacttcaaggaaaagttccagcacaagctgggtagggtactggaccccatagcagagaccatgaacgttcccccagattgcacatttggggcttgtctgcggccagaagagtacggagtgggagatctgatccacaatagactgcctgacgagtatctgcggggcaaagataggcaaagagccctcattgctgctgtgcgccatcatctgaagaaagtgaattaccaaaagtttgacactctgttagcagcgttcagacactacgacaagaaaggcgatgggatgatcgataaagacgagttgcaggaagcttgtgaccaggcgaacttgagtctggatgacaaactgctcgaccaactgtttgactactgcgacgtagacaacgatgggtttatcaattatcttgaatttgctaactttcttaactggaaggataagatgctcctgaaggagtacgaggagagagttattattaagggaagaaagcccgactgcgtcaacccgaccgaagcaaacgtcgaagaacctgaacagacactgctgattaaacctgaggacattgtcttgaaggaagcaggcagtactgagaagactctgcgaactctgctcagacctagcgataaagtgagcaattactataagacaaccagctccgagattaatgcaatcgtgggggcaatacctagcacctgttatcctatatgcggggtgccaacaatccggagtgacatcccagcgccgagaattaggcgaataagtgatagaaccaactacggcgaggaaggaagtgcctacagccttttgtaccctaccatctttgctcggaaaggcgtattcgaacgagattttttcaagacacggtctaaagaggagatcgccgagatcctgtgtaacattggagtcaagctaagcgatgaggagttcgaaaacgtgtggaatctggcatctaagaaacatcatagaggcgaggtgtgcgtagagaatatccgcaatgtgctggatgagctgaggcatgccgatagaatcaaatgcaaaacgctgatgtag

SEQ ID NO: 5353 - DNA, 2004 bp, Artificial Sequence
  Description of Artificial Sequence: Synthetic coding sequence
atgggcagctctcggctcgccgccttgcttctgcctctgctcctaatcgtgatcgacctttctgacagcgccggaatcgggttccggcatttgccccattggaatacacgttgccctcttgcttctcacaccgatgattccttcaccggttcctccgcatacattccttgcaggacatggtgggcactcttcagcaccaagccttggtgcgtgagggtttggcattgcagtcggtgcctctgccagcacctgctctccgggggctcgggcctacagagagggttgtttcatctgcttgtccagaaatctaagaagtcatcgacattcaaattttaccgaagacacaaaatgccggcgcccgcccagcggaagttattacccaggaggcacctgtccgagaaatcccaccatatttctatccccagcccggatatctcacacaagggactcagaagcaagaggacacagccatcagaccccgaaacttgggagtccctgccccgactggattctcagcgccacgggggccctgagttctcttttgatctccttcctgaggctcgcgctattcgggtgacaatatcctctgggcctgaggtgtccgtgcggctgtgtcatcaatgggcgctggaatgtgaggagctgtctagcccctatgacgttcaaaagatcgtgagcggcggacacactgttgagcttccatatgaatttttactgccatgtctatgcatcgaggcctcttacctccaggaagataccgttaggcgaaaaaaatgcccctttcagagctggcccgaggcttatgggtccgatttttggaagagtgtacactttaccgattactcacagcatactcagatggttatggcgctcaccctccgttgcccactcaagctggaggcggctctctgtcagaggcacgattggcatactttgtgtaaagacctgcctaacgctactgctcgcgagagcgacgggtggtacgtcctcgagaaagtcgacctgcatcctcagctgtgcttcaagttctcattcggtaactccagtcacgtcgaatgcccacatcaaacaggctcactgactagttggaacgtgtcaatggacacccaagctcagcagttgatcttacatttctcaagtagaatgcacgcgactttctcagcggcgtggagcctgccgggcctgggccaggataccttggttccgcccgtctacaccgtttcccaggctagaggcagctcaccagtgtccctagacctgattatcccatttctgcgccctgggtgctgtgtcctagtatggcgttctgatgtgcagttcgcctggaagcacctgttatgccctgacgtgagttaccggcacttggggctactgattctggccctcctggcattattgacactgctcggtgtcgtgcttgctcttacatgcaggaggccccaaagcggaccgggccccgcaagacctgtactgctcctccacgccgccgattccgaagcacagcggcgactggtgggggcattggccgagcttctgcgcgcagcgcttgggggtggccgagatgttatcgtggatctctgggagggccgacacgtggcgcgggtaggacccctaccctggctgtgggcagctaggaccagggttgccagggagcagggtacagtgcttctgctgtggtctggagccgacctcaggcccgtgtcaggccccgatccacgcgccgcacctctgttagctctcctccacgcggccccaagaccgctgctgctcctggcctatttttcgagactttgtgctaagggtgatatcccaccgccgctgcgagcgttaccgcgctacaggttactccgcgatctgcccaggctgctccgggccctagatgcccgaccattcgctgaagccaccagttgggggagattaggcgcacggcagcgccgccagagtagattggaactatgctctagactagagagggaggcggccagactcgccgacctcggctag

SEQ ID NO: 5354 - DNA, 609 bp, Artificial Sequence
  Description of Artificial Sequence: Synthetic coding sequence
atggagctgtggggagcgtacctgctgctttgcctgttttctctcttgacacaggtgacgacggagcccccaacacagaagcccaaaaaaatcgtcaatgctaaaaaggacgtagtgaacacaaaaatgtttgaggagttgaaatcaagacttgatacactggcccaggaagtggccttactcaaagagcaacaggctctgcaaaccgtctgtctcaaaggcaccaaggtgcacatgaaatgctttctggcttttacccagaccaagacgtttcatgaggcctcagaagattgtatctcaaggggaggaacgctgggcacccctcagacaggaagtgagaacgacgctctttatgagtatctgcggcagtccgtcggaaacgaggctgagatctggcttggattgaatgacatggccgcagagggcacctgggtcgacatgactggcgctcgcatcgcctacaaaaattgggagactgaaataaccgcacagccagacggagggaaaaccgaaaattgcgccgtcctgtctggagcggcgaacgggaaatggtttgacaagagatgtcgagaccagttaccctatatttgtcagtttggaatcgtgtag

SEQ ID NO: 5355 - DNA, 1839 bp, Artificial Sequence
  Description of Artificial Sequence: Synthetic coding sequence
atgctggaaggcttgggctcgccagcttctcctcgtgccgcagcgagtgcttctgtggccggttcttccggaccagccgcatgctccccgcccagttcctccgccccaagatccccggagtcacctgccccaaggagaggtggcgtacgagcctccgttccacagaagttggctgaaatgttgtcatctcagtacggcctcatcgttttcgtggcaggcttacttttgctcctggcttgggcagtacacgctgctggagtgagcaagagtgatcttctctgcttcttaacagctctcatgctgctccaactcctctggatgctgtggtatgtgggcagaagctcggcgcacagacggttgtttcggcttaaggacactcatgccggagccgggtggcttcggggatccatcactttgttcgctgtcataaccgtcatccttggctgtctgaaaatcggctatttcatcggattcagtgagtgtctctcggcaacagagggggtcttccctgtgacacattccgtacacacactgctccaggtttactttctgtgggggcacgccaaggatataatccaaagctttaaaactttagaaagattcggagttatccacagtgtgttcactaatctcctattgtgggcgaacggagtgttaaacgaatccaaacaccagcttaacgagcacaaggagaggctgataaccctgggtttcggtaacatcaccactgtgttagacgatcacacgccgcagtgtaattgtactccacctactttgtgcacagccattagccatggcatctactacttgtatcccttcaatattgaataccagatcctcgcttccacaatgttgtacgtcctatggaagaatattggccggaaggttgacagtcaccaacatcagaagatgcagttcaagtccgacggtgtcatggtcggagccgtgctgggactgactgtcctggccgctacaattgccgtggtagttgtctacctcatccacatcgggcggagtaaaactaagagcgagagtgcactgataatgttctacctgtatgccatcactctcctcatgcttatgggagccgccgggctggccggaataagaatctaccgcatcgacgaaaaatccctagatgagagcaagaacccggcccgtaaactcgattctgatctcctggtcggcacagcgtctggcagttggctgatctcatggggctctatccttgcaatcctctgcgcagaaggccacccacgctatacatggtataacctcccttattccatccttgcgattgtcgaaaaatacattcagaacctgttcatttttgagtctattcatcgagaaccagaaaagctttccgaggacatccagacgctgcgcgttgtcaccgtttgtaacggcaatacaatgccgcttgcatcaagttgtccgaagtctggaggagttgcccgtgacgtcgctccacaggggaaagacatgcctcccgccgccaatggaaacgtatgtatgcgtgagtctcacgacaaggaagaagagaaacaggaagaaagctcttggggtggatctccatcacccgtacgtttaccaagatttctacagggaaatgccaagcggaaggtgctacggaacatcgccgctttcctctttctgtgtaacatctctttatggatcccacctgccttcggctgtagacccgagtatgataacggccttgaagaaattgtcttcggcttcgaaccttggataatcgtcgttaacctggctatgccattcagtattttttaccgcatgcacgcagccgcatcgcttttcgaggtgtactgcaagatctag

SEQ ID NO: 5356 - DNA, 786 bp, Artificial Sequence
  Description of Artificial Sequence: Synthetic coding sequence
atggaacttctgcaggtgactatcctgtttctgttgccatccatttgttcctctaatagcacaggtgtgctggaagccgcaaataattccctcgtggttacgactaccaaaccctctattacaactcccaacaccgagtccttgcaaaagaacgttgtgactcccactacgggaacaactccaaagggaacaattaccaatgagctgcttaagatgtctttgatgagcacggctaccttcttgacaagcaaggatgagggtctgaaggccactacgacagatgtgagaaaaaacgactctatcatttccaacgtcaccgttacatccgtgactttgcccaacgccgtcagtactctgcaaagttctaagccaaagacggaaactcagagttccattaagacaaccgaaatcccagggagcgtcctgcagcctgacgcgtcgccctccaagacggggacgttgaccagcatcccagtgactattcctgagaatacgtcacagtctcaagtcattgggacagaggggggtaaaaatgcttctaccagtgcgaccagtcgtagctactcctctatcatcctgcctgtggtcatcgcgttgatcgttataacacttagtgtgttcgtgcttgtgggactctataggatgtgttggaaggccgaccccggtacacctgaaaacggaaatgaccagccccagtcagacaaggaatccgtgaagcttctgacagtcaaaactatatcacacgaaagtggggagcactcggcccagggaaagaccaaaaattag

SEQ ID NO: 5357 - DNA, 6408 bp, Artificial Sequence
  Description of Artificial Sequence: Synthetic coding sequence
atgcctgctctgggacctgctctcctccaggcattgtgggccggctgggtcttgacgctccagccccttccaccaaccgccttcactccaaatggaacctacctgcaacatttggctcgcgaccctactagtgggacattgtatctcggagccacaaattttctgtttcagctaagccccggcttacaactggaagcaaccgtgtcaacagggcccgtattggatagccgtgactgtctgcctcccgtcatgccagacgagtgtcctcaggctcaacctaccaacaatccaaaccagctcttactcgtctctcccggagctttggtggtttgtggaagcgtgcatcaaggggtgtgcgaacagagaagactgggccagctggagcaactcctgctgcgaccggagcggcctggcgatacccagtatgtggccgctaatgatcccgctgtcagcactgtgggattggttgcccaaggattggccggcgaaccactgcttttcgtcggccgagggtacaccagtagaggggtgggagggggcatccccccaattacgactagggcactgtggccccctgacccacaggctgcatttagctacgaggaaacggccaagctggcagtcggacgactgtcagagtatagccaccatttcgtcagcgcattcgctcggggcgcctccgcctatttcttgttcttgagacgggacttgcaggcccaatcccgggctttccgagcttatgtgtccagggtttgccttagagaccaacactactattcctacgtggaactgccccttgcctgcgagggcggcaggtacggcctgattcaggcagctgctgtagccacttcccgcgaggtggcgcatggagaggtgctctttgccgctttttcgtccgccgccccccccaccgtgggtcgcccaccaagcgccgcagctggggcctctggggccagcgcgttatgcgctttcccactggatgaggtcgataggcttgcaaataggactagagacgcatgttatacccgagaagggcgtgctgaagatggtactgaagttgcttacatcgaatatgatgtaaatagcgattgtgcccagttgcccgtggataccctggatgcttacccatgcggctcagaccatacaccctcacctatggcctcccgagttccgctagaagccacacccattctcgaatggccgggtattcagctgactgctgtcgccgtaactatggaagacggacacacgatagccttcttaggcgactcacaggggcagttgcatcgggtttacctcggaccaggtagcgacggccacccctactccacccagagtattcagcaagggagtgccgtgtctcgggacctcacttttgatggcaccttcgagcacctgtacgtcatgactcaatccaccctgctgaaggtgcccgtagcctcttgtgcccagcacttggattgtgcctcctgtttggcccatagggatccttattgtggctggtgtgtcttgctcggtaggtgctcgagacgatccgaatgctcacgaggacaaggaccagagcagtggttatggagttttcaacctgagctgggatgcctgcaggttgctgcaatgagcccagccaacatcagccgcgaggagacaagagaagtgtttctcagcgtgcccgatcttccccctctgtggccaggcgaaagctatagttgtcactttggcgaacatcagagcccggcattactgaccgggtccggggtgatgtgccccagtccagatccatccgaagcccccgtcctcccaaggggcgctgactacgtttctgtatccgtagaactccggtttggcgctgtggtgattgcgaagacgagtctttcattctatgattgcgtcgctgtgactgagcttcgccctagtgcacagtgtcaggcctgtgtgagtagcaggtggggatgtaactggtgtgtctggcagcacttgtgcacccacaaagcaagctgcgatgcagggcccatggttgctagccaccagtctcccttggtgtcacccgatccccctgctcggggcggaccctcccctagcccacccacagcccctaaggcactggccacacccgctcccgataccctccctgttgagccaggagcgccttccactgccaccgcttccgatatctcaccaggcgccagcccctctctcttgtcgccatggggcccctgggcggggagtggcagtatatccagcccaggatccacaggctcacccctgcatgaggaaccgagcccgcctagtcctcagaatggccctggcaccgctgttcccgctccaaccgactttcgcccgtctgctacccccgaggacctccttgcttctccattgtctccttctgaggtcgccgctgtgccacccgcggaccccggcccggaggctctgcatcctactgtgcccttagatctgccaccagccacagttccagcaacgactttccctggggcaatgggctcagtgaagccagcacttgactggctgacccgcgaggggggggaattgcctgaggcggatgagtggaccggcggggacgcccccgccttttccaccagtacactgctatctggcgatggtgacagcgcagaactcgaaggcccccccgcccctctgatcctgccctctagccttgactaccagtatgatacgccaggcctgtgggaattagaggaagctactctaggcgcttcctcctgcccttgcgttgagtcagtgcaggggagcactcttatgccagtgcacgttgagcgggaaattcgattgctcggccggaacctgcacctgttccaggacggtcctggtgataatgagtgcgtaatggaactcgagggcctggaagtcgtcgtagaggctcgagtggagtgtgaacccccacccgacacccagtgccacgtaacatgtcagcaacaccaattgagctacgaggcactgcagccagaactaagggtcgggctctttttgcgtcgcgctgggcgattgagggtggattccgcagagggtctgcacgtggttttatatgattgctctgtgggacatggagattgtagcaggtgccagacagctatgcctcaatacggatgcgtgtggtgcgagggcgaaaggccccgttgtgtcactcgagaagcgtgtggagaagccgaagctgtagccactcagtgtcccgccccactgatccactccgtagagccattaaccggccccgtggacgggggaactcgcgttacaatacgaggcagcaacctgggacagcatgtgcaggacgtcttaggcatggttacggtcgccggcgtgccctgtgccgtcgacgctcaggagtacgaggtgtcatcttctctcgtttgtattacaggcgctagtggcgaggaagtggccggtgccacagccgtggaggtgcccggcagaggcagaggtgtgtccgaacatgacttcgcctaccaggaccctaaggtgcatagcatttttccggctcgagggccaagagccggaggtacacgactgacactgaatgggagtaagttgcttacaggacgtctcgaagatatccgcgtggtcgtgggggatcaaccttgccatcttctccctgaacagcagtccgaacagctgagatgcgagacgtcccctcgtccaaccccagccacactgccagtcgccgtgtggttcggcgcgactgagaggagactgcagcgaggccagttcaagtatacactcgatccgaacattaccagtgcgggacctaccaaatcatttctcagtggcgggcgtgaaatttgtgttcgcggacagaacctcgacgtggtccagacgccacgaattcgagttaccgtggtgtcacggatgttgcaaccctcacaaggcctcggccggcgtcgtagggttgtacctgaaacagcgtgctccctaggacccagctgctctagtcagcaattcgaagaaccctgtcacgtgaattcaagccagctgattacgtgccgcacccccgccttgccgggcctgccagaggatccttgggtgcgggtagaattcatcctcgataaccttgtattcgatttcgccactctgaatcccacccccttctcatatgaggctgatccgacactccaaccactgaatccggaggaccctacgatgcctttccgccacaagcccggctcggtgttctctgtcgaaggagagaacctcgacttagccatgtccaaggaagaggttgtggctatgattggtgatgggccctgtgtcgtgaaaacgctcacacgccatcatctatattgcgaaccccccgtcgagcaaccattacctagacatcatgccctgagggaggctccagattcccttcccgaattcaccgttcagatgggaaatttacggttcagcctgggacacgttcaatatgatggggagagccctggagctttcccagtggccgcccaggttgggctcggggtaggcactagcctcctggcactcggtgtgatcattatcgtgctcatgtaccgcaggaagtctaagcaggctctgcgcgactataagaaagtgcagattcagctcgagaacctcgaaagctctgttagggatcgctgtaaaaaagaatttactgatttaatgaccgagatgaccgatctgacgtccgatcttctcggtagcggcattccgttcctagattataaagtgtatgcagagaggatcttctttcccgggcaccgtgagagcccattacatcgggatttgggggtacctgagagtagacggcccactgtcgaacaaggactgggacagttaagcaacttattgaattctaagctcttcctgactaagtttatacacactctggagtcccagagaacatttagcgcaagagacagggcctatgtggcttccctactgacggtcgctttacatggaaagctggaatattttaccgacattctgcgaacgttactgtccgatttagtggctcagtatgtggccaagaaccccaaattgatgctccgacgcaccgagactgtggtcgagaaactgctgacgaattggatgagtatttgcctgtacaccttcgtgcgcgacagtgtcggagagcccctgtatatgctattcagaggaatcaaacaccaagtggataagggcccagttgactctgtgaccggtaaagccaaatacactctgaatgataaccgtctgctcagagaagacgtagaataccgaccactgaccctcaatgccttgttagctgtggggccaggggccggtgaggcccagggagtgcctgtgaaggtccttgactgtgacaccatttctcaggctaaggagaaaatgctagaccagctgtataagggcgtgcccctgactcagcgaccagacccccggacattggacgtggagtggagatcaggagttgcagggcatctcattctgtccgacgaggacgtgacgtccgaagtccagggtctctggcggaggctaaacacactccagcactataaagtccccgacggagcgacagtggcgctggtcccgtgtctgaccaagcacgtgttgcgcgagaaccaagattacgttccaggtgagagaaccccaatgctggaggatgtagatgaggggggaatcaggccatggcacttggtgaagccttccgacgaacctgaaccccctaggcctagaagaggctcgctgcggggaggagagagagaacgagctaaagccattccagagatctatctcacgagactgttgtctatgaagggtaccctgcaaaagttcgtcgacgacctctttcaggtaattctgtccacctccagacctgttccccttgctgtgaagtattttttcgatctgcttgatgagcaggcacaacagcacggcatatctgaccaggacacgattcatatttggaaaactaatagcctgcctctgaggttttggatcaacatcatcaaaaatccccagtttgtattcgacgtacagacatctgataacatggacgccgtcctgctcgtgatcgcacagaccttcatggatgcatgtactctggccgaccacaaactcggccgagattccccaataaacaaacttctgtacgctagagatattccacgatacaaacgcatggtcgaacggtattacgccgacattcggcaaactgtgcccgcttccgaccaggagatgaattctgtccttgccgagctcagctggaattatagcggcgacctgggcgcccgggtagctctgcatgaactttacaaatatataaataaatattacgaccagattattacagccctagaggaagatgggaccgcccaaaaaatgcagctgggctaccgcttacagcagattgccgccgctgtggaaaacaaagtaactgacctctag

SEQ ID NO: 5358 - DNA, 297 bp, Artificial Sequence
  Description of Artificial Sequence: Synthetic coding sequence
atgaagctaatggtgctggttttcaccattgggctgactttgcttctgggggtccaggccatgcccgccaaccggctatcttgctatcggaagatccttaaagatcacaattgccacaacttaccagagggggtagctgacctcacccagatagatgtgaatgtccaagaccacttttgggatggaaaggggtgtgagatgatctgctactgcaatttctcggagctgctctgttgccccaaagatgtgttcttcgggccaaaaatcagctttgtgatcccctgcaacaatcaatag

SEQ ID NO: 5359 - DNA, 1443 bp, Artificial Sequence
  Description of Artificial Sequence: Synthetic coding sequence
atgaagcgcagcgttgctgtttggttgcttgtcggcctgagcctcggcgtgcctcagtttggcaagggagatatatgtgatccgaacccatgcgaaaacggtgggatatgtttgccaggccttgccgacggaagtttttcctgtgagtgcccagacggctttacagaccctaactgttcctccgtagttgaggtggcctcagatgaggaggagccgacctctgccggcccttgcactccgaacccatgtcacaacgggggtacatgtgagatttctgaggcctatcggggagacacctttattgggtacgtctgcaagtgccccagaggctttaacgggattcactgtcagcataatattaacgaatgcgaggtggaaccctgtaagaatggcgggatctgtaccgaccttgtggctaattacagttgtgagtgccccggcgagttcatgggtaggaattgccagtataaatgttccggtcctttgggtatcgagggaggcatcattagtaaccaacagataacagcctccagtacacacagggcactatttgggctccagaaatggtacccgtactacgccaggctgaacaaaaagggtttgatcaacgcttggaccgctgccgagaatgaccggtggccatggatccagataaatttgcagaggaaaatgagggtcacaggcgttattacccaaggcgcgaaacggatcgggagccccgaatacatcaagtcatataagattgcgtactccaacgacgggaaaacctgggcaatgtataaggttaagggtacaaacgaggatatggtgtttagaggcaatattgataacaacaccccctatgcaaatagtttcaccccacctatcaaggcacaatatgtcagattatatccacaggtttgcaggcgccactgcaccctgcggatggagctcttgggatgcgaattatccggctgttcagaacctctggggatgaaatcgggccatatccaggattaccagatcacagctagcagtatttttagaactttgaacatggatatgtttacctgggaacctcggaaagcccggctggacaagcagggcaaagtcaatgcctggacatctggccacaatgaccaatctcagtggctacaagtggacctcctcgtccctaccaaggtgaccggaattatcactcaaggcgccaaggattttggccacgtccagtttgtcgggagttataaactagcctattcgaacgatggtgagcactggacagtataccaggatgagaagcagcgaaaggacaaagtctttcaaggcaacttcgacaatgatacccatcgcaagaacgtcatcgatccacccatttatgcacgtcatatccggatcttgccttggtcatggtatgggcgaatcacccttcggtcggaacttctgggatgtacagaagaagagtag

SEQ ID NO: 5360 - DNA, 1323 bp, Artificial Sequence
  Description of Artificial Sequence: Synthetic coding sequence
atggcagtgaagcttggcacactcctgctggctctggccctgggtctggctcagccagcctcagcaagacggaagcttctagtgtttctgctggacggattccgcagcgactacatcagtgatgaggcactggagtccctccccgggttcaaggaaattgtttccaggggcgtcaaggtcgattacctcacaccagatttcccctcactctcttatccaaactactatacactgatgacagggcgacactgtgaagtccatcagatgattggcaactacatgtgggacccaactaccaacaaaagtttcgatattggtgtaaataaggacagcctgatgcccttgtggtggaatggcagcgagcccctttgggtcaccctcactaaagctaagcgaaaggtctatatgtactattggccgggttgtgaagtcgagatcctgggtgttagaccaacatactgtctcgaatacaaaaacgttcccaccgacattaatttcgcaaacgccgtctccgatgccctggatagctttaagtctggacgggctgatctcgctgccatatatcatgaacgtatcgacgtggagggccatcactatggcccagcatcacctcagcggaaggatgcactgaaggccgtggacaccgtgctaaaatacatgaccaagtggatccaggaacgcggtttgcaagaccgactcaatgttatcatcttttctgatcacggtatgaccgatatcttctggatggacaaggtaattgagctcaataaatatatatcgctgaacgaccttcaacaggtgaaggaccgaggcccggtcgtgtctctgtggcccgcccccggtaagcacagtgagatctacaacaaattaagcactgttgaacatatgacggtatatgagaaggaagcgattccatccaggttttattacaagaagggaaagttcgtctccccactgaccctggtggctgacgagggttggtttatcaccgagaaccgtgaaatgctcccattctggatgaatagcactggacgtagagagggttggcagcggggatggcacgggtacgacaatgaattaatggatatgaggggcatattcctggctttcggccccgatttcaagagtaactttcgcgctgcgccaatccggagcgtcgatgtctacaacgtgatgtgtaacgtggtcggaataacccccctgcccaataacggatcttggtcgcgcgtcatgtgcatgttgaaaggccgagccagcacagctcctccagtctggcccagccattgcgcgttggccctgattttgctgttcctgctggcatag

SEQ ID NO: 5361 - DNA, 351 bp, Artificial Sequence
  Description of Artificial Sequence: Synthetic coding sequence
atggagtctagccgggtgaggctgctacctctcctgggagcagccctgctgctcatgctcccgcttctgggaacacgggctcaggaggacgctgagttacaaccccgggccttagacatttattccgcagtggatgacgcttcacatgagaaagagttaatcgaggctttgcaggaggtgctgaagaagctgaagtcaaaaagggtccccatctatgagaaaaagtacggtcaggtgcccatgtgcgacgcgggtgagcagtgtgctgtacgaaaaggggcacgcataggtaaactgtgcgactgcccacgcggtacttcttgtaatagctttttgctcaaatgtttatag

SEQ ID NO: 5362 - DNA, 1365 bp, Artificial Sequence
  Description of Artificial Sequence: Synthetic coding sequence
atggccaggcctaataaatttttgctctggttttgctgctttgcctggctgtgctttcctattagtttgggctcacaggccagtggaggcgaagcacagattgctgcctcagccgagctggaatcaggcgccatgccctggagtctgcttcagcacattgatgagagagacagagcgggattgttacccgcactttttaaagtgcttagtgttggccgcggggggtcccctagactgcagcccgatagtcgcgccctccactacatgaaaaagctgtataagacctacgctaccaaggagggtattccaaagtcaaacaggtcacatctgtacaacacggtgcgcctcttcaccccgtgcacacgccataaacaggcacccggggaccaggtgaccggaatattgccctcagtggaactgttgtttaacctggatcgaatcactactgtggaacacctattaaaatctgttttgctatataatattaataactccgttagctttagtagtgctgtgaagtgcgtatgcaatctgatgattaaggagcctaagtccagctcacggacactgggacgcgcgccgtattctttcacgttcaatagccaatttgaattcggcaagaagcacaagtggattcagatcgacgtcacctcactgctgcagccccttgtcgcttcaaacaagcgatctattcatatgagtattaattttacttgcatgaaggaccagctggagcacccctcagcccagaatgggctgttcaatatgactcttgtgtctccttccctaatcctttacctgaatgacactagcgcccaggcttaccactcttggtatagtctgcattataagcggcgtccttcacaggggcccgaccaggaaaggtccctatcagcctaccctgttggggaggaagcggctgaggatggtaggtcatcacaccacagacaccggcgaggccaggaaacggtctctagcgagctgaaaaaaccacttggtcctgccagcttcaatctgagtgagtactttaggcagtttctgttgccacagaatgaatgcgaacttcacgattttaggttgagcttctcccagctgaagtgggacaattggatagttgctccccaccgatacaacccccggtattgcaagggagattgtccccgggccgtgggacatcggtatgggagcccagtgcacacaatggtccagaacattatctatgagaaactcgactccagcgtgcctcggccttcgtgcgtacctgctaagtactcaccgctgtctgtcctgactatcgaacctgatggatcgatcgcctacaaagagtatgaggatatgatcgcaactaagtgtacttgtaggtag

SEQ ID NO: 5363 - DNA, 234 bp, Artificial Sequence
  Description of Artificial Sequence: Synthetic coding sequence
atgtggcacctgaagctttgtgctgttctgatgatcttccttctgctgttgggtcagatcgacggatcgccaattcctgaagtgagtagtgctaagcgcagacccaggaggatgacccctttttggcgaggggttagcttacgccccatcggtgcatcttgcagagacgactcagaatgcattacccgcctgtgcagaaaaaggaggtgtagtctgtctgtcgcccaggagtag

SEQ ID NO: 5364 - DNA, 912 bp, Artificial Sequence
  Description of Artificial Sequence: Synthetic coding sequence
atgagcgagccccagccagatctcgagccaccccagcacggcctgtatatgctctttcttttggttctggtattctttctaatgggtctggtgggatttatgatatgccatgtgctcaaaaaaaaagggtaccgttgcagaacttccagaggttccgagcctgacgacgcccaactccagcctcccgaagacgatgacatgaatgaagacacagtcgaacggatcgtgagatgcattattcagaatgaggcaaatgccgaggccctgaaggaaatgctgggagatagtgaaggggaagggacggtgcaactcagcagcgttgatgccacttcgtccctgcaggatggcgcccctagccatcaccatacggttcacctcggctcagcggccccctgccttcactgtagtagaagcaagagaccacctctggtcaggcaggggcgtagcaaagaaggtaagagcaggcctagaacaggggagactacagtgttttcagtgggccggtttcgcgtaacccatatagagaaacgatatggactgcacgagcacagggacggctccccaacagatagatcttggggatctggcggtggccaagatccgggtggtgggcaaggcagtggtggagggcagcccaaggctggaatgccagccatggagcgcctccccccagagcgtccccaacctcaggtactggctagtcccccagtccaaaatggtgggctgcgcgacagctccctcaccccacgtgctctggaaggaaatccccgggcttctgccgagcccaccctgcgggccggcgggcgcggcccgagccctggcctgcctacacaggaggccaatggccagccgtccaaacctgatacttccgaccatcaggtgtccttgccacagggagcaggctctatgtag

SEQ ID NO: 5365 - DNA, 795 bp, Artificial Sequence
  Description of Artificial Sequence: Synthetic coding sequence
atgaggacattgtggatggctctctgcgccttgtctcgactgtggcctggcgctcaggcgggctgtgccgaggccgggcgatgctgtcccggcagggatccagcatgcttcgctagggggtggcgacttgatagagtatacggcacatgcttctgcgaccaggcgtgcagatttactggagactgctgctttgactacgacagagcgtgcccagcccgcccatgtttcgtcggtgaatggtcgccttggagtggttgcgcggatcagtgcaagcctacaactcgagttcggaggaggtccgtgcagcaggagcctcagaatggaggtgccccatgtcctccactggaagagagagcaggatgtcttgagtactccaccccccagggccaggattgcgggcacacctacgtgcctgcctttattaccacaagtgcatttaataaggagcggactcgccaggccacgtcaccacattggtcaacccacaccgaggatgcggggtattgcatggagtttaagacggaatccctgaccccacactgcgctctggaaaactggcctcttactaggtggatgcagtacctcagggaggggtataccgtgtgcgtggactgtcagcccccagctatgaacagcgtgtccctcagatgctccggcgacggccttgactccgacggcaaccagactcttcattggcaagcgattggcaaccctaggtgtcaaggcacctggaagaaggttagacgtgtagatcagtgtagctgtccggccgtacatagcttcatcttcatctag

SEQ ID NO: 5366 - DNA, 312 bp, Artificial Sequence
  Description of Artificial Sequence: Synthetic coding sequence
atgcgccagaggttactgccaagcgtcacgtccttacttctggtcgcgctgttgtttcccggaagcagtcaagcgcggcacgtgaatcattccgcaaccgaggccctcggagaactaagggagcgtgcacccgggcagggtaccaatggcttccagttgctccgccatgccgtgaagcgagaccttctgccgccccgcacacctccctatcaagtgcacatttcgcaccgtgaagcacgcggccccagctttagaatctgcgtggacttcttgggaccccgctgggcgagaggctgcagtacagggaactag

SEQ ID NO: 5367 - DNA, 3867 bp, Artificial Sequence
  Description of Artificial Sequence: Synthetic coding sequence
atggcgtccgtcgcatgggccgttctgaaggtgcttctgttattgcccacccagacttggagcccagtcggagctggcaacccacctgattgcgatgcccctctcgcatctgctcttcctagaagttcgttctcaagctcctctgaactgtctagctcccacggacctggatttagccgtctgaacaggagagatggagcgggtgggtggaccccactggtatcaaacaaataccaatggctccaaattgatttaggagagcgaatggaggtgacagctgtagctacccaaggtggttatgggagttccgattgggtgaccagctacttgttaatgttcagcgatggggggcggaactggaaacagtatagaagggaagagagtatttggggtttccctggcaacaccaacgctgactccgtcgttcattacagacttcagcctcccttcgaggcccgtttcctacggttcctgccactcgcatggaacccgcggggtagaattgggatgcgaatcgaggtgtacgggtgcgcgtataagtcggaggtcgtctattttgacggacagtcagcgctgctctatagactcgataaaaaaccattgaagcccataagagatgtgatttcactaaaatttaaagccatgcagtctaatgggatattacttcatagggagggccagcatggaaaccatatcaccttagaactgatcaaaggcaaactcgtcttctttttaaatagcgggaacgccaaacttccaagtaccattgcccccgttacacttaccctcggttcattactagatgaccagcattggcacagcgtgttgattgaactgctggacactcaggtgaatttcacagtagacaagcacacccaccatttccaggctaagggggatagttcctacctggaccttaactttgaaattagctttggcggcattcccacacctggcagatcccgtgccttccgccgaaagtcattccatggttgtctggaaaacttatactacaacggcgtcgatgtgacagaactggccaagaaacacaagccacagatcctgatgatgggtaacgtgagctttagttgcccgcagcctcagaccgttcccgtgacgtttttgtccagccgatcatatctagctctgcctggcaatagcggggaggacaaagtgtctgtgacatttcagttcaggacttggaatagagcggggcacctcctgttcggtgaactgcgcagaggtagtgggagttttgtgctcttcctgaaagacggtaaactcaagctttcactgtttcagccagggcagagcccaaggaacgtgacagccggcgctggtctgaacgatggtcagtggcacagcgtgtcgttctctgctaagtggagccatatgaacgtggtggtagatgacgatactgcagtgcaacccctggtcgccgtgctgatcgattctggggacacttactacttcgggggctgtctggataactcttcaggcagtgggtgcaagagtcccctgggagggtttcagggttgcctcaggctcattacgatcggggacaaagctgtcgatccgattctggtgcagcagggggccctcggcagtttccgtgatctgcaaatcgacagttgcggtattacggacaggtgcttgccgtcctactgcgaacatggtggtgaatgcagccagtcatgggatacattcagttgcgattgtctgggaacgggctatacaggtgagacttgccattcatcactgtacgagcaatcatgcgaagctcataaacaccgagggaaccctagcggattgtattacattgacgccgacggctctggccctctaggcccgtttttagtatactgtaatatgactgctgatgccgcatggaccgtggtccagcacggaggtcccgacgccgtcacattacgaggagcaccttctgggcacccacggtctgctgtgtcatttgcctatgctgctggagcaggacagcttcgtagtgccgtcaacctggccgaacggtgtgagcagagactggctctgcgttgcggcactgccaggcggcccgattccagagatggaaccccgctttcctggtgggtggggcgaactaatgagactcacacatcatggggtggaagtttacctgacgctcagaaatgcacgtgtggactcgaaggaaattgcatcgatagccagtactactgcaactgcgatgccggccgcaacgagtggacttctgacactattgttctgtcacaaaaggaacacctgcccgttacccagatcgtgatgacggacgcgggtagaccacactctgaggctgcttataccctcggtcccttgctgtgtagaggcgaccagagcttctggaactcagcctcctttaacaccgaaactagctacctccacttccctgcttttcacggggaacttactgcggatgtgtgtttcttttttaaaaccaccgtgtcgtccggtgtgtttatggagaatctgggcatcaccgatttcataagaatcgaactgagagccccaacagaggtgaccttctcattcgacgtgggaaatggcccctgtgaggtgacagtgcagagtccgactcccttcaacgacaatcagtggcatcatgtccgggccgaacggaatgtgaagggcgcaagcctccaggtagatcaactgcctcagaaaatgcagcccgcccctgcggacgggcatgtgaggttacagctcaacagccagctgttcataggcggaacagccacacgccagcggggtttcctagggtgcataaggagcctgcagttgaacggagtggcgctggacttagaggaaagagccacagtcacacccggcgtcgagcccgggtgcgcaggccattgtagtacctacggacacttatgccgcaatggaggtcggtgtcgcgagaagcggcgcggagtgacttgtgactgcgcattcagcgcatatgatggacctttctgctcaaatgaaattagcgcgtactttgcgactgggtcttccatgacttaccacttccaggagcattatactctctccgaaaactccagcagccttgtaagcagtttgcacagggacgtcacgctgaccagagagatgattactctgtcattccgaactacgcggacacctagcctcctactttacgtgtcttctttctacgaggagtatctgtccgttattctcgctaacaacggctcgctgcagattcgctataagctggaccgtcatcaaaaccccgatgcttttacgttcgatttcaagaatatggctgacggacagctgcaccaggtaaaaatcaacagagaggaggccgtggtcatggtagaggttaatcaaagcacaaagaagcaggtcattctctcctccggaacagaatttaacgctgtcaaatccctcattctggggaaggttcttgaagctgctggggccgaccccgacactagacgggctgccacatccggtttcactgggtgtcttagcgccgtcagatttggaagggccgcacctctcaaggccgccctgcgtcccagcggcccctcaagagtaacagttagaggccatgtggcacctatggctagatgcgcagcgggcgccgccagcggaagccccgcaagggagttagcccctcggctggcaggcggggccgggcggagcggccccgctgacgagggcgagcctctcgtgaatgccgacagacgtgactcagcggtgattggcggggtgatcgccgtggttatttttattcttctatgtattacggcgattgctattagaatctatcagcaacgcaaactgagaaaagagaacgagtctaaagtgagcaagaaagaagagtgctag

SEQ ID NO: 5368 - DNA, 369 bp, Artificial Sequence
  Description of Artificial Sequence: Synthetic coding sequence
atggtgccaggcccccctgagtccgtcgtacggttctttctgtggttctgttttctgctaccacctaccaggaaggcctcatgtgaccctagagacctcaaaagctgtaacaggccctgcgtgtggagcagacttctcaagcctaatagcagtttgtctaatcttgagaccgcatatttcccccagatactacgatttctccgaccctggtatttttctcgaagccatcttaactatcatcaaaaggccccagctcgctgggagtggctttactccatttataggaagggaacgaaggcacaaaggcgtaatgttcttagatctccttgtgctcctccgcagccttcctggccttgttccgtgatttag

SEQ ID NO: 5369 - DNA, 1887 bp, Artificial Sequence
  Description of Artificial Sequence: Synthetic coding sequence
atggctcccagcgccgatcctggaatgagtcgaatgctaccctttttgcttctcctgtggttcctgcctattaccgagggtagccaacgagccgaacccatgttcactgctgtcaccaattccgttttgccaccagattacgactccaacccaacccagttaaattatggagtggcagttactgatgtggaccatgacggggactttgagattgtggtagcagggtacaacggacccaatctggtgttgaaatacgatagggcccagaaacggctagtcaatattgctgtggatgagcgcagctcaccatactatgctttaagggatcggcaagggaatgcgataggtgtcacagcttgtgatatcgatggcgatggcagagaagaaatctattttcttaacacgaataacgcattttccggtgtagccacttatactgacaaactattcaaattccggaacaacaggtgggaggacatcctctctgatgaagttaacgtggccaggggcgtggcaagcctatttgcaggacggtccgtggcttgcgtagaccgaaaaggaagcgggaggtacagtatctatatcgctaattacgcttatggtaatgtggggccagatgccctcattgaaatggaccctgaagcctctgatttaagtaggggcattctcgctttgcgtgatgtggctgccgaagctggagtaagtaagtatacagggggtaggggggtgtcggtggggcctatcttatcctcctcagccagtgacattttctgtgacaatgagaacggaccaaattttctgttccacaatagaggtgacggcaccttcgtggatgccgcagcgtccgctggggtggatgatccacaccagcacgggagaggagtagcgctcgccgacttcaatcgggatggaaaggtggacatcgtctacgggaattggaatggcccgcacagactgtacctgcagatgagcactcacgggaaggtgaggttccgtgacatcgccagccctaaattttcgatgccatctccggtgagaaccgtgattacggctgactttgataatgaccaagagctcgaaatattttttaacaacatcgcatacagaagttccagcgctaatcggctttttcgggtgattcgcagagagcacggggatccccttattgaggagttgaaccctggagatgcgctggaaccagaaggacgcggtactgggggagtagtgacagacttcgatggggatggcatgctcgatttgatactgtctcatggtgagagcatggctcaaccgctgtctgtgtttcgagggaatcagggatttaacaataactggcttagagtagttccaaggaccaggtttggtgcatttgcccgtggggcaaaggtagttctctacacaaaaaagagcggcgcccacctccgaataatagatgggggttcaggatatctgtgcgaaatggaaccagttgcacacttcggacttggcaaggacgaagctagtagcgtcgaggttacatggcctgatggaaaaatggtcagtcgcaacgtcgcctctggggaaatgaacagcgtgctagagatcctgtacccgagggatgaagacacattgcaagatcccgcccctttggagacgcccatgaatgccagcagctcacacagttgtgcccttgaaacatcgccttacgtctccacccccatggaagcgaccggagcgggccccaccaggtcagccgttggggcgaccagccccactcggatggcccagccagcatggggtctttctgcttcacatcgcgccccagctccaccacccccgcccctgctgctgcccctccctctgcttctgccccttctggagctgcccctgcttcacagatcaagctag

SEQ ID NO: 5370 - DNA, 1008 bp, Artificial Sequence
  Description of Artificial Sequence: Synthetic coding sequence
atgcaaggtcaaggccggcggaggggcacctgcaaagacattttctgttctaaaatggcatcatacctgtatggagtgctgttcgctgtaggcctgtgcgccccaatctattgtgtgtcgccagccaacgctcctagcgcctacccgcgtccttctagcaccaaaagcacccctgcctcacaagtttacagcctgaatacagacttcgcgttccggctttatcgcagattagtcctggagactccttctcagaacatatttttttcccccgctagaattaacagccacgtcaagaaaaagacccagggcaaggtagtcgacattatccagggtctggatctgctcaccgcaatggtactggtcaatcatattttcttcaaggccaaatgggaaaagccctttcatccggagtatacacggaagaacttccctttcctcgtgggcgagcaggtgaccgtgcatgtgccaatgatgcaccaaaaggagcagttcgcattcggtgttgatactgagctcaattgtttcgtcctgcaaatggactataaaggggacgcggttgctttctttgtgttgccatcaaaggggaagatgcgccagttggagcaggccctgagtgcgcgcacactgcgcaagtggtcacacagtctgcagaaacggtggattgaggtattcatcccgcgcttcagcattagcgcttcttacaacctggagaccattctgcctaaaatggggatacagaatgtcttcgataaaaacgcagatttttctggaattgccaaacgagattcgttacaagttagtaaagccacccacaaggcggtgcttgacgtgtctgaagaaggtacagaagccacagccgccactacaacaaaatttatcgtccgctccaaggacgggcccagctatttcacagtcagctttaatcgtactttccttatgatgatcacgaataaagcaacagacgggatcttattcctgggaaaagtggagaatccgaccaagtcatag

SEQ ID NO: 5371 - DNA, 768 bp, Artificial Sequence
  Description of Artificial Sequence: Synthetic coding sequence
atggtgctgctgctagtaatccttattccagtactcgtgtcgtccgccggaacatcagcccactacgagatgctgggtacatgccgcatggtgtgtgacccctacggggggaccaaggccccaagcaccgcagctacacctgatagagggctgatgcagagtttgcccacgttcatccagggccctaaaggcgaagctggccggcccggaaaggcagggccaagaggacctccgggcgagcccggccctcccgggcccatggggccaccaggtgaaaagggcgagccaggtcgtcaaggcctgcctggccctccaggcgcccctggactcaacgcagccggcgcaatctcagctgccacctactccaccgtgcctaagatcgccttctatgctggtctcaaaagacagcatgaagggtacgaagtgctgaaattcgatgatgttgttaccaacttgggcaaccattacgatcctacgacaggcaaatttacatgctcaatccccggaatttatttctttacataccatgtcctgatgcgggggggcgatggaacgagtatgtgggccgatctttgcaagaacaaccaagttagagcatccgcaatcgcgcaggatgccgaccagaattacgactacgcctccaattcagtggtgcttcatcttgagccaggcgacgaggtgtatattaaacttgatggaggtaaggctcatgggggcaataacaataaatacagcaccttcagcggttttataatttatgcagactag

SEQ ID NO: 5372 - DNA, 1617 bp, Artificial Sequence
  Description of Artificial Sequence: Synthetic coding sequence
atgtctttttcagccaccattctcttcagtcctcctagcgggtctgaggcccgttgctgctgttgtgcatgtaaatccgagaccaacggaggaaatactgggtcgcagggcggcaaccccccacccagcacaccaattaccgttacaggacacggtctggccgtccagtcttcagaacagctcttacacgtcatttaccaaagggtcgacaaggccgttgggttggccgaggctgcattggggttggctagagctaacaatgaattactgaaaagacttcaagaggaggtgggcgacctgcgtcaaggtaaggtgagcatccccgacgaagacggagaatctagagcacacagctcaccccctgaggaacccggacccctgaaggaaagccctggtgaagcattcaaggctctcagcgcagtcgaggaggagtgcgactcagttggatcgggcgtccaggtcgttattgaagagttaaggcaactgggtgctgcatcagtcggtcccggtccactcggcttccccgccacccagcgcgacatgcgactgccaggttgcaccttggctgccagtgaagccgcccctcttctgaacccccttgtggacgattatgttgcgtccgagggcgcagtgcagagagtcttggtgcccgcttacgcgaagcaactgagccctgccactcaattagccatccagagagctacacccgagactgggcccgagaacggcacgaagctccccccccctcgacctgaggatatgctgaatgcagccgcggccctggatagtgctctggaggagagtggtcctggcagtactggcgaactccgccactcgttggggctgacggtatcaccctgccgtaccaggggaagtggacaaaagaacagcaggcgaaaacgcgatttagtccttagcaagcttgtgcacaacgtgcataaccacatcaccaacgacaaacgcttcaatggatctgagtctattaagagctcttggaacatcagcgttgttaagttccttcttgagaaactgaagcaggagctggtgactagtccccacaactacacagacaaggagttgaagggggcatgtgtggcctacttcttgactaagcgccgggagtaccgcaattctctcaatccttttaagggtctgaaagagaaagaggaaaaaaaattacggagccgccggtatcgactgttcgcaaataggtctagtattatgcgccactttgggcccgaagaccagaggctgtggaatgacgtgactgaggagttgatgtcagatgaggaggatagccttaatgagcccggggtctgggtcgcccggcctcctagatttcgggcgcaaagacttacagagttgtgctatcatctggatgcaaactccaagcacggcactaaagcaaaccgagtgtacggcccaccatctgatcggcttccctctgctgaggcgcagcttctgccacctgagctatataatcctaacttccaagaagaagaggatgagggcggcgacgaaaacgcgcctggatctccgtcctttgatcagcctcacaagacatgttgcccggacctcaactcatttatcgagattaaagttgaaaaggatgaatag

SEQ ID NO: 5373 - DNA, 2853 bp, Artificial Sequence
  Description of Artificial Sequence: Synthetic coding sequence
atgctccttctcgggatactgaccctggcattcgcaggccggaccgccggaggctccgagccggaaagagaggtggttgtcccaatccggctggatccagacataaatggaagacggtactattggcgaggaccagaggactcaggggatcagggccttatttttcagatcacggctttccaggaggacttctacctccacttaacccccgacgcccagttcctcgctcctgcattcagcacagaacacttgggggtaccacttcaaggtctgaccggggggagttccgacttacgaagatgcttctactcaggcgatgtaaatgcagagcctgactcatttgcagcggtcagcctctgcgggggactccgaggtgcgtttgggtaccggggagcggaatacgtaatcagtccactccccaatgccagcgccccagccgcacaacgcaacagtcaaggcgcccacctgcttcaacgtcgtggagtaccaggaggcccatctggagaccctacaagtagatgcggcgtggcctcaggttggaatcccgcaatactgagggccctggatccttacaaaccccgccgcgctgggtttggcgagtcccgtagccgacgccggtctggaagagcaaaacgctttgtgtctatcccccgttatgtggagacactggttgtcgcagacgagtcaatggttaagttccatggtgcggacctggaacactatttactgacactccttgccactgcggcaagactgtatcggcatccctctatcctgaaccccatcaatatcgtggttgtgaaagtgctgctcctccgagacagggactcagggcccaaggtcacgggtaacgccgcgctgacgctgaggaatttttgtgcctggcagaaaaaacttaataaggtatctgacaaacatccagaatattgggatacggcaattctgtttacccgccaggatctatgtggggccaccacgtgcgacaccctgggcatggccgatgtgggaaccatgtgcgatcctaaaaggagttgtagcgttatcgaagatgacggtttgccgagtgccttcacaaccgcacacgaactcggccacgtgttcaatatgccacatgataacgtgaaagtgtgcgaggaggtgttcggcaaacttcgtgctaaccacatgatgtcacccacactaattcagatcgacagagccaatccttggtctgcttgctccgcagccataatcactgactttctggacagtggacacggcgattgcctcctcgaccagccaagcaaacctatttctctgcctgaggatttgcccggcgcctcctatacactatcccagcagtgcgagttagctttcggggtcggaagcaagccatgtccgtatatgcagtattgcacgaaactttggtgtacagggaaggccaaggggcagatggtgtgtcagacacggcatttcccctgggccgatgggacctcgtgcggagaaggaaagctttgtctaaagggcgcctgtgtggagcggcacaatttgaacaaacaccgggttgatgggtcatgggctaaatgggacccttacgggccgtgttctcgcacctgtgggggaggggtgcagctggcacggcgtcagtgcactaatcccacaccagccaatggcggtaagtattgtgaaggtgttagagtcaaataccgatcatgtaacctggagccatgtccatcttccgcgagcggcaaatcattccgggaggagcagtgcgaagcctttaacggatataatcacagtacaaaccgcctaacccttgccgtggcttgggtgccaaaatattcgggggtgtctccaagagataaatgtaagcttatctgtagggccaatggcaccgggtacttttacgttctcgcccctaaggtggtggatggaacactgtgttctcccgattctacatctgtttgcgtacagggcaagtgcattaaggcaggctgtgacgggaatttaggcagcaagaaacgcttcgacaaatgcggcgtgtgtggcggggacaacaagtcttgcaaaaaggtgaccggactctttacgaaacccatgcacggatataactttgtcgtcgctattcctgcaggtgcatcctcaattgacatccggcagcggggatataagggcctcataggcgacgataattacctcgccctgaagaatagtcagggaaagtacctcttgaatggccatttcgtcgtgagcgcagttgagagagacttagtggtcaaggggagcctgttgaggtatagcggaacaggcaccgctgttgaatccctacaggcctccagaccgattcttgaacccttgacagtggaagtattaagcgtgggtaaaatgaccccacctcgggtcaggtatagtttctaccttccaaaggagcctcgagaagataagtcctctcacccaaaggacccgaggggtccttctgtcctgcacaactctgtgctgagccttagcaatcaggttgagcagccagatgatcgcccccccgcacgctgggttgctgggtcttggggcccatgttctgccagttgcggctctggtttacagaaaagggctgtggactgtcgtggctctgccgggcagaggactgttcccgcatgcgatgccgcgcatcggcccgtggaaacccaggcatgtggcgagccctgtcccacctgggaactttccgcctggtctccctgcagcaagtcatgtggtcgcgggttccagaggagaagcctgaagtgcgtggggcacggcggcaggctcctagccagagaccagtgcaaccttcaccggaaaccccaggagttggacttttgtgttctaaggccctgttag

SEQ ID NO: 5374 - DNA, 1521 bp, Artificial Sequence
  Description of Artificial Sequence: Synthetic coding sequence
atgacgtctaagcctcactccgactggatcccttactctgtcctagacgacgaaggccgcaatctgcggcagcaaaaactggatcgtcagcgcgctcttctcgaacaaaagcagaagaagaaacgtcaggagccacttatggtgcaggccaatgctgatggtcggccgagatctcggcgcgcaaggcagagcgaagagcaagctccattggtggaatcctacttgtcctcttctggatcaacatcataccaagtacaggaggccgactcattggcgagcgtgcagctgggcgccacccggcctaccgcacccgcatctgcgaaaaggacaaaggccgccgcaacagcaggagggcagggtggcgctgctcgcaaggagaagaaaggcaaacacaaaggcacgtccggcccagcagcactggccgaagacaagagcgaggcccagggacccgtgcagattctcacagtaggacagtcagaccacgcgcaagacgctggcgaaacagctgccggcggcggcgagcgacccagcggccaggacttacgagccaccatgcagaggaaggggattagctcatccatgtcttttgatgaggacgaagaagatgaggaggagaactccagctcatcatcgcagctcaatagtaatacacgcccttcgagtgccacctctcgaaagtccgtgcgcgaagctgcatccgctccaagtcccacggccccggaacagccggttgacgtggaggtccaggacttggaggaatttgctctgagaccagcacctcagggcatcacaattaaatgtagaatcactcgtgataagaagggcatggatagaggcatgtaccccacatacttcctgcacctcgatcgggaggatgggaagaaagtgtttttgctagctggaagaaagcgaaaaaagagcaagacaagcaactatctgatctcagttgaccccacagacctaagcaggggcggcgatagttacatcgggaagctgaggagcaatctaatgggaacgaaattcacagtctacgataatggagtaaatccacagaaggcgagttcttccacccttgaaagcggcaccctaagacaggagttggcagctgtgtgttacgagaccaacgtgctcgggtttaagggcccaaggaagatgagtgttatcgttccagggatgaacatggtgcatgagagagtgtctatcaggcctcggaatgagcacgagacactcttggccaggtggcaaaacaagaacactgagtctataatcgagttgcagaataagacccccgtctggaacgacgatacacagtcctacgtattaaacttccacggcagggtcactcaagcttccgtcaaaaatttccagatcatacacgggaatgaccccgattatatcgttatgcagtttggccgtgtggccgaggacgtgttcaccatggattacaattatccgttgtgcgccttgcaggcatttgctatcgcgctgagtagcttcgactctaagctcgcctgcgagtag

SEQ ID NO: 5375 - DNA, 594 bp, Artificial Sequence
  Description of Artificial Sequence: Synthetic coding sequence
atggctaaaaatggtctggtgatctgtattttggtgattaccctgctcctggatcagacaacatcacacacctctcggctcaaagcccggaagcacagcaaaagaagagttcgggataaggacggcgacctgaagacgcaaatcgagaaactgtggaccgaagttaacgccttgaaggagatacaggctctacaaacagtgtgcctgcggggaaccaaggtgcacaaaaagtgctatctcgcctcggaaggcttgaagcacttccatgaggcgaatgaagattgcattagcaagggcggtatactggtgattccccggaactctgatgagattaatgcactgcaggattatgggaagaggtcgctccctggtgtgaacgacttttggcttggaattaatgacatggtcaccgaagggaagtttgtggacgttaatggaatcgccatctcgttcctaaattgggaccgagcgcagccaaatggaggcaaaagagagaattgtgtattattttcacagtcagctcaaggcaagtggagtgacgaggcttgtcggtcttcgaagcgatacatttgtgagttcaccattccacaatag

SEQ ID NO: 5376 - DNA, 2424 bp, Artificial Sequence
  Description of Artificial Sequence: Synthetic coding sequence
aagaagaaacgcaaaatctccctcttaccaaagccacctaagcacgatgcccctctaacaattgagtttccaaacctagacaagacatccgccgagtggttaaaggtgaacgggctcaaagctaagaagctttccctctaccaggttctggccccaaacgctttcagccccgtcgaggaattcgtgcccatcctacagaaaacagtgagcagcacaattcatgagaaggccatgatccagttcgaatggcatgacggaaccgttaagaatatccacgtggacccaccctttctctacaagtatcagcaacagcttagtcgtgccatgcgaatgtacgaacggaggatcgagtggctaagcttggcttcaaggaggatctggggtacagtctgcgaaaagagggttgttgttcttctggatatctccgccacaaacagcatgtatatcatccatattcaacattctctccgcttgctgttggaagaacagctaagcaataaagactgcttcaatctaatcgccttcgggagcactattgagagctggaggccggagatggtacctgtcagccacaacaacctccagagtgcgtggcgctgggcactaaatctacggtgccgcggaagcagaaacgttctttccgcgctgcgaaaggccgtagaggtagacttcaaggacaaagacaaacatcagtctcagggcatctacctgtttaccggcggtatacccgaccaggatatgcccacactgtcagcctacatggccgaggcatgcggcgggtgtgacctccagctcaacgtgtgcctattctatgtgggcgagcccaaaatggacaccacacctcctgctaggtacgcctcacataccgacaccgccgcagcttacaaagaggttacacgggccgctggcggtagattccattggtttggcgacaccggcatctacgagagcgatgacattaactctataatgtccgagatggaaaaggcgctgaattactctcagaagtgcgccttcctcatggcatccctgaaaaaccactccggtaaggtgctgggctcaagcgccctgcccaaggagaaacctaagacactccagctgagaagccaacccaagaagctgtgtccaccccgacccaccgtgcctctgggggctagaatgagtattaaagacgaccccgatcgtgagaagagcccacccctgaagtcactgaagtggagaccactgtcttcgagagtcggcatctctcctgcagccgctcagccgaccaaggagggaatgatggagctccgccggaagacaaagtctcgcgaagccgagacaagcctgctgctattctatacagaaaagggtaatgacgtgggctcagtctacaagaagtacccccaaggccggggcttacggagaacaagttcgagtattgatctgcctcgcaaggacacggtgtgtagcagccaggaatgggtcgcaaaatacgggcttaagaagctgaagctcgagattagccgatgcatgggcccgaactgcacccaccagaaaagtggtcaacggagcgcctcagcaaaacattgtagcatcttccccagtgtcgagatccacggggttgtgaggcatatccaatggacaccacgcgaaatggaggtgtatatcaggcatctggaaaaagtcctccgtcggtacgtgcagcggctgcagtggttattgtctggaagcaggcggctcttcggcactgtgctcgaaagtaaagtatgcatattgttagacactagtgggagtatgggaccatacctccagcaggtgaagacggaactggtgctgttgatctgggagcaactgcgaaagtgttgcgattcttttaatctgctgagtttcgctgaatcttttcagtcatggcaggacactttggtggaaacaacagatgctgcctgtcacgaggctatgcaatgggtgactcatctccaggcccagggtagtaccagcatccttcaggcgttgctaaaagcatttagcttccacgatctcgaaggactgtatctgttgactgatggcaagcccgacacatcctgcagtctagtcttaaacgaggtgcagaaactgcgggagaaacgagatgttaaggtgcacaccatatctttgaactgttctgatcgcgccgccgtagaattcctccgcaagctggcctcattcacaggcggtcggtaccactgcccagttggcgaggacactttgtcaaaaatccacagcttgcttaccaaaggattcattaatgagaaggaccctacactgcccccattcgagggagacgacttgaggatcctcgcccaggaaatcacaaaggcacgttccttcctctggcaagcacagagctttaggtcccagctgcagaagaaaaatgatgctgaacctaaggtcacgctgtcttag

SEQ ID NO: 5377 - DNA, 639 bp, Artificial Sequence
  Description of Artificial Sequence: Synthetic coding sequence
atggtgtctcgcatggtgtcgaccatgctctccggattgctgttctggctggcttcaggatggacacctgctttcgcgtattcccctcggaccccagaccgggttagcgaagccgatatacagagacttctgcatggtgtaatggagcagctgggtatagcacgccctagggtcgaatatcctgcccaccaagccatgaatctagttggaccacagtccattgaaggcggcgctcacgagggtcttcaacatcttggccccttcggaaatattccaaatatagtagccgagctgactggtgacaatattcccaaagatttcagcgaggatcaggggtatcctgatcccccaaacccttgccccgttggtaagactgccgacgacggttgtttagagaatacgcctgataccgccgagttctctagagagtttcagctgcatcaacatctgttcgatccagagcacgattatcccggcctggggaaatggaacaagaaactcctctacgagaaaatgaaggggggcgagaggaggaaacggagatccgttaatccctatctgcagggtcagagattggacaatgtcgtggcgaagaagtctgtcccacacttcagcgacgaagacaaggacccagagtag

SEQ ID NO: 5378 - DNA, 1524 bp, Artificial Sequence
  Description of Artificial Sequence: Synthetic coding sequence
atgtgtactaaaacgattcctgtgttgtgggggtgcttcctgttatggaacttgtatgtgtcttcgagtcagactatctatcccgggattaaagcgcgaatcacacagagggcacttgattatggtgtgcaggctgggatgaaaatgattgaacagatgctgaaggaaaaaaaactgccagatctatccgggtcagagagcttagaattcctcaaagtagactatgtaaattacaactttagtaacattaaaatcagtgcgttttcattcccaaatacatcgctggccttcgtgccaggggtcggtataaaagcactgacaaatcatggtactgccaacatttcgacagattggggctttgagtcacctctgtttcaggatacaggaggggctgacctttttctctcgggtgtgtatttcaccggaatcattatattgacgcggaatgacttcggacacccaacgttgaagcttcaggactgttacgcgcagctgtcacatgctcatgtgagtttctctggagagctgtctgtgctgtataatagtttcgcagagcccatggagaagcccatcctgaagaatttgaatgagatgctgtgtccaattatcgcatctgaagttaaagcactcaatgctaacctttccactctcgaggtgcttaccaaaatagacaattacactctgctcgattacagcctgattagcagccccgagattactgaaaattatctggatctgaacctgaaaggagtcttctaccccctagagaatttgactgatccgcctttctccccagtgccctttgtgttacctgagaggtcgaactctatgttgtacattggtattgcagagtacttctttaagtccgcctcattcgctcatttcacagccggtgtattcaacgtcactttatcaaccgaggagatatcgaatcacttcgtgcaaaatagtcagggccttgggaacgtactgtctcgcattgccgagatctatatcctttcccagccgttcatggtgagaatcatggccacagaaccccctattataaacttacagcctggcaattttactttggatattcctgcctcaatcatgatgctcactcaacccaagaactctacagtggagaccattgtctctatggattttgtggccagtacaagcgtgggtttggtcattttgggccagaggttggtttgctctctcagcctgaatcggtttcgactagccctccccgaatctaaccgcagcaacatcgaagtgctgcgtttcgaaaatatcctgtcgtcaattttgcacttcggagtcctgcctctggcaaatgcaaagctgcaacaaggtttccccctatctaatccccacaagttcttattcgtcaactcagatatcgaggtcctggaggggtttctactaatcagcactgatcttaagtatgaaacttctagcaagcaacagcctagctttcacgtgtgggaagggttgaacttgatcagtcgacagtggcggggtaagagcgccccttag

SEQ ID NO: 5379 - DNA, 474 bp, Artificial Sequence
  Description of Artificial Sequence: Synthetic coding sequence
atgcacccctggttagggtcagccctcggattcccgaaatgcaggggaattcatctgtgtgcatgcggcaacggttggacccctggcgagacgctttcccaaaacaaaacggaaattaccaagaataaggtcacttgctggaggcctcatgggtgcgaacccaataccggtctcggatatcaaggcagtcatactagtaaatacacactcttaccctggaacttgctcaagaccaaaccactcccccccagccacggcaaggaaggtggcaaggaggccaaggtgccctcaggcgacaactcgggccgcggagaggtccccagggcgcaggagggacaggctgcttgtgggcgcgccgccagcggagattcacaggagggaatgcgccggggctacgaggaaagagcaacagcacagcgtcctgccgtgcggagtgctgagacaacagcccatggcacctggatatacccctag

SEQ ID NO: 5380 - DNA, 213 bp, Artificial Sequence
  Description of Artificial Sequence: Synthetic coding sequence
atgtccaataatatggcaaagatcgctgaagcccgaaaaaccgtggaacagcttaaactggaagtgaacattgataggatgaaggtcagtcaggctgcagctgagctcctggccttttgtgagactcacgccaaggatgatccgctggtcacccctgtgccagccgctgaaaaccccttcagggacaagaggctgttctgtgtcctcctgtag

SEQ ID NO: 5381 - DNA, 645 bp, Artificial Sequence
  Description of Artificial Sequence: Synthetic coding sequence
atggccttgctgctctgtttagtgtgtctgaccgctgcgctggctcacgggtgtttgcattgtcacagcaacttttcaaagaagtttagcttctatcgccatcacgtcaactttaagagttggtgggtcggagacatccccgtctcgggagcattgctaaccgattggtccgatgacacaatgaaggagctgcacctcgccattccagccaaaattacgcgtgaaaagttagatcaggtggccaccgctgtataccagatgatggaccagctgtatcagggcaagatgtatttcccagggtactttccaaacgaactgcgaaacatcttcagggagcaggtccatctcattcagaacgccattatagagtcacgcattgattgccagcacagatgcgggatttttcaatacgagacaatttcttgtaataattgcaccgacagtcacgtggcatgtttcggctataactgcgagtcaagcgcacaatggaagtctgccgttcagggtctgctgaattacataaataactggcacaagcaggatacctccatgtcactggtgagcccagcactgagatgtcttgaacctccacatttggctaacctgacactggaggatgccgcagagtgtctgaaacagcactag

SEQ ID NO: 5382 - DNA, 459 bp, Artificial Sequence
  Description of Artificial Sequence: Synthetic coding sequence
atgtcccctcatctcactgcattgcttggcctggtgctgtgccttgcccagactattcacacccaggagggagccttgccccgcccatccattagcgctgagcctggtacagttatctctccaggatcacacgtgaccttcatgtgtcgcggccccgtgggggtgcaaaccttcagactcgagagggaggacagagccaaatacaaggattcctacaatgtgtttcgactcggtccttcggaatcagaggcacggtttcatatcgatagcgtctctgaaggtaatgctggcttgtatcgctgcctttactataagccaccagggtggtctgaacacagcgactttctcgagctgcttgttaaggaatccagcggcggtcctgattcacccgatacagagcccggatctagcgcaggcaccgtcccaggcaccgaggcctctgggttcgacgctccttag

SEQ ID NO: 5383 - DNA, 900 bp, Artificial Sequence
  Description of Artificial Sequence: Synthetic coding sequence
atggcgccatggagtcacccaagcgcccagttacagccagtcggaggggacgcagtgagcccggctttgatggtgctgctgtgcctcggactctctttgggacctcgtacgcacgtccaggcagggaacctgagtaaggccactctctgggccgagcctgggtctgtcattagtcgaggcaatagcgtgacaattaggtgccaaggcactctcgaggcgcaagagtacagactggtgaaggaaggatctccagaaccctgggacacccaaaacccactcgagcccaaaaataaggcccgcttcagtattcccagcatgaccgagcaccatgccggtcgttatcgctgttattactacagccccgccggctggtccgagccaagtgatccacttgagctggttgtgactggcttttacaacaaacctacacttagcgctctcccttctcccgtcgtaactagcggcgaaaatgtgaccttacagtgtggttccaggctgagatttgataggtttatactcacagaagaaggcgaccataagctcagttggacactggattcccagttaaccccatctggtcaattccaggcactgttccctgtgggaccagtaacgccctcgcacaggtggatgctcaggtgctacggctcccgtcgccatatactgcaggtctggagtgaaccatcggatctgctggaaataccagtatctggggcagcagataacctatccccaagtcagaacaagagcgacagcggcacagcaagccacttacaggactacgccgtggagaatctgattagaatgggcatggctggcttgattttggtggtgttgggcattttaattttccaagattggcatagccagcgcagccctcaggctgcagctggaaggtag

SEQ ID NO: 5384 - DNA, 618 bp, Artificial Sequence
  Description of Artificial Sequence: Synthetic coding sequence
atgaaggtccttttactgaccggactaggagcactgtttttcgcctattattgggacgacaacttcgacccgggagggctggactatctcgtgttaaatcatatcgggggggcccccgccggtacgagggcaaggagtccccaggcaacaaggtggcttatgcaggtgaattttgtgagctacgtgcagctcacctccagggccctcccaagcctgacggactccaaagggtcattagttgtggtgtcttccctgctggggcgagttccaaccagttttagcaccccctacagcgcggccaagtttgcactcgatgggttctttggatctttacggagagagctagacgttcaggatgtgaacgtggcaatcacaatgtgcgtgctggggcttcgcgatcgcgccagtgcagccgaagcagtgagaggggtgactagagtgaaagccgctccaggtcccaaagccgccctcgccgtcattcgggggggggccacccgggccgccggcgttttttatccctggcgatttcgcctcctctgtttactccgaaggtggctgcctcgcccccgtgcgtggttcatacggcaggaattgaacgtcactgctgccgcggcctag

SEQ ID NO: 5385 - DNA, 795 bp, Artificial Sequence
  Description of Artificial Sequence: Synthetic coding sequence
atgctgcggtgcgggggtcgcggcttacttctgggcctcgccgtggccgctgcagctgtgatggcggcgcgactgatgggatggtggggacctcgagcagggtttcggctgtttatcccagaagagctaagcagatatcgcggcggtcctggcgatccggggctctaccttgccctgttggggcgcgtctatgatgtgtccagcggcagacgccactacgagcccggaagtcactactctggcttcgctgggcgggatgcgtcccgggcctttgtgaccggggattgttccgaggccgggctggttgacgacgtcagtgacctcagcgcggctgaaatgttaacactgcacaattggttatcattttatgagaagaactatgtttgtgtgggccgcgtgactggaagattttacggagaggatgggctacccacacccgctctgactcaggtcgaggcagctatcacacggggacttgaagctaacaagctccaactacaagagaaacagacgttccccccatgtaacgcagaatggtcgagtgctaggggttctcgcctgtggtgctcccagaaatccggcggcgtatctagggattggataggcgtgcccaggaagctgtataaacccggggccaaggaaccaagatgtgtttgcgtgagaacgacagggcccccttctggccagatgccagataatccgccgcaccggaatcgaggagatctcgaccatccgaatctggcagagtacactggctgtccgcctctggctattacgtgtagtttcccattgtag

SEQ ID NO: 5386 - DNA, 468 bp, Artificial Sequence
  Description of Artificial Sequence: Synthetic coding sequence
atgagtaaacggctcctcctcctgctcctcctcagcatggggggcacatgggcctccaaagagccactgaggccacgctgccgccctatcaacgcaacactcgctgttgaaaaggaaggctgcccagtgtgcatcacagtcaataccaccatatgcgcaggctactgtccaactatgacacgagtgctgcaaggcgtgctccctgccctgccacaagttgtatgtaattacagagacgtcagatttgagagcatcaggttaccaggctgcccccggggcgttaatcccgtcgtgtcctatgcagttgccctttcttgccagtgtgctctgtgtaggcgttcaacaaccgattgcggtggtcccaaagaccatcccctcacttgcgatgaccctcggttccaggattcgtcatcctccaaggccccaccaccaagtttgcccagtcccagccgcctcccgggaccctag

SEQ ID NO: 5387 - DNA, 498 bp, Artificial Sequence
  Description of Artificial Sequence: Synthetic coding sequence
atggagatgttccagggtctgcttctgctcttactgttatcgatgggtgggacttgggcctctaaagagcctctccgccctaggtgtcggcccattaacgccaccctggctgttgagaaagaaggatgcccagtgtgtattactgtgaatactaccatctgtgcgggttactgtcctacaatgaccagggttttgcagggtgttctgccagccctgccccaggtggtgtgcaactacagggatgtgcgatttgagtccattaggctccctggctgtcctcggggcgttaacccagtcgtgagctatgctgtggccctgtcctgtcagtgcgctctttgtaggaggtctaccaccgattgtggcggccctaaagaccaccctctaacttgtgatgatcctaggtttcaggactcaagtagttcaaaagctcctcctccctctctaccatctccaagcaggttgcctgggcctagtgatacgcccatccttccccagtag

SEQ ID NO: 5388 - DNA, 990 bp, Artificial Sequence
  Description of Artificial Sequence: Synthetic coding sequence
atgctgcccttgctattgggcttactgggcccagccgcctgttgggccctgggccctactcccggacctggcagctccgagctgcgcagtgccttctctgccgcccgaaccactcctttggagggtacctccgagatggccgtcacttttgataaggtatatgtcaacattggcggtgactttgatgtggccactgggcagttccgctgccgggtgcccggtgcctacttctttagcttcactgctgggaaagcgccccacaagtctcttagcgtgatgttagtgcggaaccgcgacgaggtgcaagcactggccttcgatgagcagcgtcgaccaggggccagacgcgccgcaagccagtccgcgatgcttcagctggattacggggacacggtttggttgcgattacatggagcaccacagtatgccttaggcgcccccggtgctactttctctgggtacttggtatatgcagatgccgacgcggatgcacccgcccgggggcctccagccccacctgaaccgcggagtgcatttagtgccgcgcgcactagaagcctcgtgggctcggacgctggtccaggacctcgacaccagccactggcattcgatacagaattcgtgaacatcggaggcgatttcgacgccgccgcaggggtcttccgctgcagactgcctggcgcgtacttcttcagctttactttgggaaagctgccccggaaaaccctatccgtaaagttgatgaagaatagggacgaggtgcaagccatgatctacgacgatggcgcctctcggcgtcgagaaatgcagtcacagtctgtgatgctggccttgaggcgtggcgatgctgtgtggttactgagtcatgaccacgatggctatggtgcctactctaatcacgggaagtatattacgttttctgggtttctggtctaccccgatctggccccggctgcaccacctggtctcggagcatcagaattgttgtag

SEQ ID NO: 5389 - DNA, 873 bp, Artificial Sequence
  Description of Artificial Sequence: Synthetic coding sequence
atgcggcgccccgccgctgtgcctctcctgctgctgctgtgctttggctctcagcgcgcaaaggctgccacagcatgcggccggcccagaatgctgaaccgcatggtgggcggccaagacacccaggagggcgagtggccctggcaggtgagcatccagcgcaacggctcccacttttgtgggggctcgttgatcgctgagcagtgggttctgaccgcagcccactgctttcggaataccagcgaaacttctttatatcaagtgctgctgggcgcacgacagcttgtgcagcccggtccccacgccatgtacgctcgcgtcagacaggtcgaatcgaatcctctgtatcaggggactgctagtagcgctgatgtggccttggtggagctggaagcccctgttccctttacgaattatattctgccggtatgtctaccagatcccagtgtgatcttcgagactggcatgaattgctgggttaccgggtggggctcacctagcgaggaggacctgttgcctgaaccgcgtatactgcagaagctcgcagtgcccattatcgataccccaaaatgtaatctgctttacagtaaggacaccgaatttggttaccaacccaagactataaagaacgatatgctgtgcgccgggtttgaggagggcaagaaggatgcttgtaagggtgactctggagggcccctggtgtgcctcgtgggacagtcttggctgcaggccggcgtgataagttggggcgagggatgcgcgcggcagaataggccgggcgtgtatatacgggtgacagctcatcacaactggattcatcggataattccaaagctgcagttccagcccgccaggctggggggtcagaaatag

SEQ ID NO: 5390 - DNA, 792 bp, Artificial Sequence
  Description of Artificial Sequence: Synthetic coding sequence
atggcattcctgtggctgttgagctgctgggccctgctgggtacaaccttcggatgtggtgtgccagctatccatcccgtgctgagcggcctgtcccgaattgtgaatggagaggacgccgtccctgggtcatggccatggcaggtttcgctgcaggataaaacaggattccatttttgcggagggagtcttatttctgaagactgggtcgtgactgcagcgcactgcggcgtccgaacctctgacgtggttgtcgctggggagtttgaccagggctctgatgaggagaatatacaagttctgaaaattgcgaaggttttcaaaaatcccaagtttagcatcctgaccgttaacaatgatattacactgctgaaactcgctactccagcgagatttagccaaactgtgagtgcagtctgcctgccatcagccgacgacgactttccagccgggacactctgcgcaacgaccgggtgggggaagacgaaatacaatgctaataaaaccccggacaaactgcagcaggccgctcttccccttttgtctaacgcagagtgcaaaaagagttggggaagacggataacagacgtgatgatctgcgccggagccagcggggtgtcctcttgcatgggtgactctggtgggccactcgtgtgccagaaggatggagcttggacgctggtggggattgtatcttggggttctaggacgtgcagtacaactacaccagcggtgtacgcacgggtggcgaagttaattccctgggttcagaagattctcgcagccaactag

SEQ ID NO: 5391 - DNA, 228 bp, Artificial Sequence
  Description of Artificial Sequence: Synthetic coding sequence
atgggcgccgcaatttcacaaggtgccctgattgccatcgtgtgcaacggcctcgtgggctttttgctgcttctgttgtgggtcatcctgtgctgggcgtgtcatagcagatctgccgacgtagatagcctgtcagagtcgcggacccaggagtcggcttgcctcgaactggatcctgctgcccaaagcttggctagcctcgcccccattggggcccagtggccatag

SEQ ID NO: 5392 - DNA, 762 bp, Artificial Sequence
  Description of Artificial Sequence: Synthetic coding sequence
atggctcggtctctgctgctgcccctccagatactgctgctgtctctcgctctagagacggccggcgaggaagcccaaggcgacaagattatagatggagctccctgcgcgcgcgggtcccatccatggcaggtcgcacttcttagtggcaatcagctgcactgcggcggagtgctggtcaatgagcgctgggttctaacagctgcacactgcaagatgaatgaatatactgttcatttgggctctgacacgctcggggaccggcgggcgcagcgaatcaaagccagcaagtcctttagacaccccggctattctacccaaacccatgttaacgacctcatgctcgtgaagctgaacagccaggctcggctcagctctatggtcaagaaggtccggctcccatcaagatgcgaacctccagggactacctgcacggtgagcggctgggggactacaacatccccagatgttacgttcccatcggatcttatgtgtgtggacgtcaaactgatctcccctcaggactgcacaaaggtttacaaggatttgctcgaaaacagcatgttatgcgccggcatccccgacagcaagaaaaacgcctgtaatggagattccggaggtccccttgtatgccggggcactttgcaggggcttgtcagttgggggacttttccatgtggacagccaaatgatcccggcgtgtatacccaggtatgtaaattcacaaaatggattaatgacaccatgaaaaaacatcgctag

SEQ ID NO: 5393 - DNA, 480 bp, Artificial Sequence
  Description of Artificial Sequence: Synthetic coding sequence
atgaaagcatggggaaccgtggttgtcaccctggcgactcttatggtggtgactgtcgatgcaaaaatatacgagcgctgcgagctggcagctagactcgagagagcggggctaaatgggtacaaggggtatggagtaggcgactggctgtgcatggcccactatgagagtggattcgacaccgcatttgtcgaccataaccccgatggaagcagcgagtacgggatttttcagctgaactccgcatggtggtgtgacaatgggattacccctaccaagaatctctgccacatggactgccatgatctccttaatcgacacattctggacgacatccggtgtgcgaaacaaatcgtgagtagccaaaacgggctctcggcttggacctcctggcggttacactgtagcggacatgacttgtctgagtggctcaaagggtgcgacatgcacgtcaagattgaccctaagatacacccttag

SEQ ID NO: 5394 - DNA, 501 bp, Artificial Sequence
  Description of Artificial Sequence: Synthetic coding sequence
atggctcagacgaatagcttcttcatgctgatttcttcccttatgttcctctccctaagtcagggtcaggaatcacaaaccgagcttcccaatccccgcatatcgtgtcccgagggaactaatgcatatcggagttattgttattatttcaatgaagatcctgagacttgggtcgacgcggatctttactgccagaacatgaactccggaaatcttgtgagtgtccttacacaggctgaaggggccttcgtcgcgtccctgattaaagaatcttcaaccgatgattccaacgtgtggattggcctgcatgaccctaagaagaaccgtcggtggcactggagtagcgggtccctcgtgtcttacaaatcttgggacaccggaagtcctagttctgctaacgcaggctactgcgccagtctcacaagctgtagcggtttcaaaaagtggaaggacgaaagctgcgaaaaaaagttttcctttgtatgcaagttcaagaactag

SEQ ID NO: 5395 - DNA, 528 bp, Artificial Sequence
  Description of Artificial Sequence: Synthetic coding sequence
atgcttcctcccatggctctgccttcagtctcttggatgctcctgtcttgtctcatgctcctgagccaggtgcagggcgaagaaccacaaagggaattaccaagcgctcggatacgttgtcctaagggctccaaggcatacggatctcactgctacgcgttattcttaagcccaaaatcatggacagacgccgatttagcttgtcaaaagcgacccagcgggaatctcgtgtccgtgctatctggagccgagggcagctttgtcagctcacttgtgaaaagtattggaaactcttatagttatgtttggatagggctgcacgacccaacacaaggcactgagcccaacggggagggttgggaatggtcatcatctgacgtgatgaattatttcgcgtgggagcgcaaccctagtacaatctcctcgcccggtcattgtgccagcctcagcaggtctaccgcattcttgagatggaaggactacaactgcaatgtcagattgccttacgtgtgcaagttcacagactag

SEQ ID NO: 5396 - DNA, 1686 bp, Artificial Sequence
  Description of Artificial Sequence: Synthetic coding sequence
atgggggcaaggacccctctgccatccttttgggtgtcgttctttgccgagacagggattctgttcccaggcggaactccatggcctatgggaagccaacattcgaagcagcacaggaaaccaggccctcttaagaggggtcatcggcgtgaccggaggacgacgcgtcgcaaatattggaaagaggggagagaaatcgctcgagtgctggatgacgaagggagaaatctgaggcagcagaagctcgaccggcaacgggccttgttggaacagaagcagaagaagaagaggcaggaacctctgatggtgcaggcaaacgccgacggccgcccgcggtctagacgggctcgacaatctgaggaacaggcgcccctcgtggagtcttacctctcttcttcaggctccacctcctaccaggtacaagaagctgacagccttgcgagcgtgcagttgggtgcaactagaccaacagccccagctagcgctaagagaacaaaagcagcggccaccgccggcggacaaggaggagctgccaggaaagagaagaaaggcaaacacaaggggaccagtggcccggccgctctcgctgaagacaaaagcgaggcccagggcccagttcagatcttgacggtgggccagtctgaccatgcccaagacgcgggcgagactgccgctggtggtggagagaggcccagtggccaggatttgcgcgccacaatgcagcgcaagggtattagttcttccatgtcatttgatgaagatgaggaagacgaggaagaaaacagctctagttccagtcagctgaacagcaacacgcggcccagctccgctacatctcgaaaaagcgtgcgagaagccgcctccgcacctagtcccacagcccctgagcagcctgtagatgttgaggtccaggacctcgaggagttcgcacttcgccccgcaccacagggaatcacaatcaagtgtcgcatcaccagggacaagaagggcatggaccgcgggatgtaccccacatacttcctgcatctggacagagaggatggaaagaaggttttcttgcttgctggcaggaagcgtaaaaagtctaagacatccaactacttaatcagcgtcgatcctacagacttaagccgcgggggtgatagctacatcggtaagttgcgaagcaatctcatgggaaccaaatttacagtatacgacaatggggtcaaccctcagaaggcatcatcctctacgctggagtcgggcaccctgcggcaggagctggccgcggtgtgctacgaaaccaacgtcctcggatttaaagggcccaggaagatgagcgtcattgtgccgggcatgaatatggtacacgagcgggtatctatcagaccacgcaatgaacacgagacactgcttgctaggtggcagaataaaaataccgaaagcatcattgagcttcagaacaaaacccctgtatggaacgatgacactcagtcatatgtcctgaatttccacgggcgggtaacccaagcaagtgtgaaaaattttcagataattcacggaaacgatcccgactacattgtgatgcagttcggacgcgtcgcagaagatgtttttacaatggactacaactatccactgtgcgccttgcaagcgtttgccatcgcactgagttcattcgattcgaagctggcttgcgagtag

SEQ ID NO: 5397 - DNA, 1272 bp, Artificial Sequence
  Description of Artificial Sequence: Synthetic coding sequence
atgatgtatcgaccggatgtggtgcgagctaggaagcgtgtctgttgggagccctgggtgattggactcgttatttttatctcgctaatcgtcctggccgtttgtatcgggcttacagtgcactacgtgcgttataaccagaaaaagacctataactactatagtacactgtccttcactactgataaactgtacgccgaattcggtcgtgaggccagcaacaacttcacggagatgtctcaacgcctggaatcaatggtcaaaaatgctttttacaagagccccctaagggaggagtttgttaagtctcaggtcattaagttcagtcaacagaagcacggtgttctggctcacatgctgctgatatgccggtttcattccacggaggaccctgaaaccgtcgataagattgtgcaactggtgctgcatgagaaactgcaggacgccgtaggccctcccaaggtggacccccactccgttaaaataaaaaaaattaataagacagaaacagactcctacttgaatcattgctgcggaactcgccgtagtaagacactaggacagagccttcgcatcgtgggtggcaccgaggtggaagaaggcgaatggccttggcaggccagcctacagtgggacggcagccacagatgtggcgccaccctaatcaatgccacatggctcgtcagcgccgcacactgcttcactacttacaagaaccctgctaggtggaccgccagctttggcgtgaccataaagccatctaagatgaaacgtggcctgagaagaatcattgtgcacgagaaatacaagcacccctcacatgattatgacatttcactggcggagttatctagtccagtgccatatacaaatgccgtgcatcgagtttgcttacctgacgcatcctacgagttccagcccggcgatgtgatgttcgtgacgggtttcggcgcattgaagaatgacggctatagccagaatcacttgagacaggctcaagttacactgatagacgctactacgtgtaatgagcctcaagcctataatgatgccattacacctaggatgctgtgcgcaggctcactggagggtaaaactgacgcctgtcagggggacagcggcggccctctggtttcctccgacgcaagggacatatggtacctggccggcatcgtcagttggggcgacgagtgtgccaagcctaataagcccggagtatacacacgggttacagcccttcgggactggatcacgagcaagacgggcatctag

SEQ ID NO: 5398 - DNA, 282 bp, Artificial Sequence
  Description of Artificial Sequence: Synthetic coding sequence
atgaagccggtgctccctctgcagttcctagttgtgttctgcttagctctgcagctcgttcccggttctcctaagcaacgggtactcaagtacatactggagccccctccttgcattagcgcacctgaaaattgcacccatctctgcacaatgcaggaagactgtgaaaaaggcttccagtgctgtagctctttttgtgggatcgtctgttcaagcgaaaccttccagaaaagaaatcggataaagcacaaaggctcagaggtgatcatgccagcaaactag

SEQ ID NO: 5399 - DNA, 1530 bp, Artificial Sequence
  Description of Artificial Sequence: Synthetic coding sequence
atggactttctgctggccttggtgctggtgagttccctgtatttacaggcagccgcagagttcgacggtcgctggccgaggcagatcgtaagctcaatcggcctctgtagatacggaggacggatcgattgctgctggggatgggcccgccagtcttggggccagtgccagccagtctgtcagcccaggtgcaagcatggagagtgtatcggacctaataaatgtaaatgccatcctggatacgcaggtaaaacttgcaatcaggacctaaacgaatgcggactcaagccaagaccctgcaagcacaggtgtatgaacacctatggcagctacaagtgttactgcctgaatggttacatgctgatgccggacggatcctgcagctctgcactcacatgcagtatggctaactgccagtacggatgtgatgtggttaaaggtcaaatacggtgccaatgccccagtcccggtctccagctggcaccggatggcagaacctgcgtggatgttgatgagtgcgccaccggaagggcttcctgccctcggttcaggcagtgcgtaaatacatttggctcctacatctgcaagtgccataaaggattcgacttaatgtacattgggggtaagtaccagtgccatgatatagacgagtgctctttgggacagtatcagtgtagttcctttgccagatgttacaatattaggggttcctataagtgcaagtgcaaggaaggctaccagggggatggtttgacatgtgtgtatattcctaaggtgatgattgagccgtccggtccaattcacgtacccaagggaaacggtaccatcctcaaaggagacactggaaacaacaactggatccccgatgttggatctacatggtggcccccgaaaaccccttatatacccccaatcattacaaaccgtcctacatcaaagccgaccacacgccctactccgaaacctaccccgatcccaactcccccaccccctccccctttgcccacagaacttaggacacctctgccccctacaacacccgagaggccaacaacaggcctgaccaccatcgcccccgccgcaagcacacctcccggaggtataactgtggacaatcgcgtgcagacagatccacagaagccacgcggcgacgtgttctcggtactagtgcacagttgtaatttcgaccatgggttgtgtgggtggattcgggaaaaagacaacgacctgcactgggagcccattagggatcctgctggagggcaatacttgaccgtttccgctgcaaaggccccaggggggaaagctgcccggctggttctgccactgggaagactcatgcattccggtgatctgtgtttgtcgttcaggcacaaagttacaggactccacagcggcacactccaagttttcgtgaggaaacatggtgctcacggtgctgccttgtgggggcgtaacggaggccacgggtggcgacagacacagattactcttcggggcgccgatataaaatcagaaagtcagcggtag

SEQ ID NO: 5400 - DNA, 381 bp, Artificial Sequence
  Description of Artificial Sequence: Synthetic coding sequence
atggacaagtccttgctcttagagttacccatcctgctctgctgctttagggcgctgtcaggctccctttccatgcgaaacgatgcagtcaatgagatcgtggccgtgaaaaacaacttcccagtcatagaaatcgtacagtgccgcatgtgccatctccaatttcccggtgagaagtgctctcggggcagggggatatgtaccgcaacaactgaggaggcttgtatggtagggcgaatgtttaagcgtgacggaaacccttggttgacatttatggggtgcctcaaaaattgtgcagacgtgaagggcataaggtggtccgtgtatcttgtaaacttccggtgctgccggagccatgatctctgtaacgaggatctgtag

SEQ ID NO: 5401 - DNA, 537 bp, Artificial Sequence
  Description of Artificial Sequence: Synthetic coding sequence
atggagcttctgcaggtaactattctcttcctattgccttctatctgctcatccaattcgaccggagtgctggaggccgccaacaactcccttgtggtgactactactaagccgagtattacgacacccaatactgaaagcctgcagaaaaatgtagtgactcctactacaggcaccactccaaagggcaccatcaccaatgaacttctgaagatgagtttaatgagcactgccacctttttaaccagcaaagacgagggcctcaaggctacgacaactgatgttcgcaagaacgactccatcattagcaatgtgacggtgacttctgtgacactccccaatgctgtatccacactccagagctctaaaccgaagacagagacccagtcatcgatcaaaaccacagagataccgggaacgcctgagaatgggaatgaccaaccacagtctgacaaggaaagtgtcaaactgctcactgtgaagaccatttctcatgagtctggcgagcactcagcacaggggaaaaccaaaaactag

SEQ ID NO: 5402 - DNA, 2544 bp, Artificial Sequence
  Description of Artificial Sequence: Synthetic coding sequence
atgtttaagtgctggtctgtggtcctggttttgggatttatctttctggaaagtgagggtcgcccaacaaaggaggggggatacggtttgaaatcgtaccagcccttgatgcggctgcgacataaacaggagaagaatcaagagagctcaagggtcaaggggttcatgatacaggatggcccttttgggtcttgtgagaacaagtattgtgggctggggaggcactgtgtcacttcccgggagacgggacaagcggagtgtgcctgtatggacctgtgcaagaggcactataaacctgtctgtgggagcgacggggaattttatgagaatcactgcgaggtgcatcgagccgcttgtctgaagaaacagaagatcaccatcgtgcataacgaagactgtttctttaaaggggataaatgcaagactacggagtactcaaagatgaagaacatgctcctcgaccttcagaatcagaagtacattatgcaggaaaatgaaaatcccaacggggatgatatcagcaggaagaagctcctggtcgaccagatgttcaagtacttcgatgcagacagcaatggcctggttgacatcaatgagctaacacaggtcattaagcaggaggaactcggtaaagacctgtttgactgcaccttatatgttcttctcaaatacgacgattttaacgctgataaacacctggctctcgaggagttctatcgggccttccaggtgattcaactcagcctgcctgaggaccaaaagctgtccattactgctgccaccgttgggcaatccgcagtgctaagttgtgccatacagggaactctcaggccgccaattatttggaaacggaacaacattatcttgaacaaccttgatctagaggatatcaatgacttcggagatgatggtagcctatacatcacaaaagttacgaccacgcacgttggcaactacacctgctatgccgatggctatgaacaggtgtaccagactcacattttccaagtgaacgttccgcccgtaatacgagtgtacccagaatcccaagctcgagagccaggcgtgacagccagtctgcgttgccatgcagagggtatcccgaagcctcagctcggctggctaaagaatggcatcgatatcactcctaaactcagtaaacagctgacccttcaggcaaacggcagtgaagttcatatctcgaatgtccgatatgaagacaccggggcctatacatgcattgctaagaatgaggctggtgtggatgaggacatttcttcactgtttgtggaagactcagcccgtaagacactggcaaatatcctgtggagggaagagggactgggcatcggcaatatgttttacgtgttctatgaagacggtattaaagtgattcaaccaattgaatgcgagtttcaacggcacatcaaacctagtgaaaagctgcttggttttcaggatgaagtgtgcccgaaagcggaaggggacgaggtgcaaagatgtgtctgggcaagcgccgtaaacgtgaaggacaagttcatctacgtggcacagcctaccttggatcgcgtgctgattgtcgacgtccagagccaaaaggttgtacaggccgtgtcaactgaccctgttccggtcaaacttcattacgataagtcacatgaccaggtctgggtgctgagctggggcactctagagaagacatcccccactctgcaagttattacattggcctcaggcaatgtgccccatcacacaatccatacccagcccgtggggaagcagtttgaccgcgttgatgatttttttatcccgacaacaacattgatcatcacacacatgagattcgggtttatcctccataaagacgaggcagccctgcagaagatcgatcttgagaccatgtcttatatcaaaacaatcaacttgaaagactacaagtgcgtcccacagtctctggcttacactcatctggggggctactattttattggctgcaagccagatagcacgggcgccgtgagcccccaggtcatggtggacggcgtcaccgactctgtgataggcttcaattccgacgtgactggcacaccgtatgtgtcccctgacggtcattaccttgtgagcatcaatgatgtgaaaggcctcgtcagggtgcagtacataacaatacgcggtgagatacaggaggcctttgacatctataccaatctccacatctccgacctcgctttccaacccagctttactgaagctcaccagtacaacatctatggctccagcagtacgcagacagatgtgctgttcgttgaactgtcttcagggaaggtcaagatgatcaaaagcctgaaggagccactaaaggccgaagagtggccttggaatcgaaagaacaggcagattcaagacagcgggctgttcggccaatatttgatgacaccgtcaaaagattcgctattcatattagacggaaggctcaacaaactcaattgtgagatcacggaggtggagaaaggaaatacagtcatctgggttggggatgcatag

SEQ ID NO: 5403 - DNA, 273 bp, Artificial Sequence
  Description of Artificial Sequence: Synthetic coding sequence
atgaggctatctgtgtgcctcttgctgctcacactggcactgtgctgctatagggccaacgcagttgtatgccaggcccttgggtccgaaatcactgggtttctgttagctgggaagcccgtttttaaattccaactggcaaaatttaaggcaccactggaagctgtggccgcaaagatggaggttaaaaagtgcgtcgacactatggcgtacgagaaacgagttctcattactaaaacccttgggaagatcgccgaaaaatgtgatcgttag

SEQ ID NO: 5404 - DNA, 1044 bp, Artificial Sequence
  Description of Artificial Sequence: Synthetic coding sequence
atgagtagttggtccaggcagaggccaaaatctcctggcggaatacagccccatgtgagtagaacccttttcctgctgctgctcctcgccgcctccgcctggggcgtcactttatctccaaaggactgccaggtatttaggtcagatcacggaagctctatttcctgccagccccccgccgaaatacctgggtatttgccagctgacacagtgcatttggcggttgagttctttaaccttacacacttgcccgcaaatttgttgcagggagcgtccaaacttcaggagctgcacctatccagcaacggattagaaagcctaagtccagagtttctgcggcctgttccccagttaagagtattggacttaactaggaatgctctgaccgggttaccaccggggttatttcaagccagtgcgacacttgacaccctggtcctgaaggagaatcagttggaggtgctggaggtgagttggcttcatggtctgaaagcattggggcatcttgacttaagcggcaaccggcttcgaaagttgccacccggactcctcgctaattttacattgctgcgcaccttagacctgggtgaaaaccagctggaaacacttccacccgacttgctccggggccccctacagctggagcgactgcacctcgagggcaataaactgcaggtattaggaaaagacctcctgctccctcagccggacttacggtacttattccttaacgggaacaaacttgcccgtgtggcggctggcgcgtttcagggcttgcggcagctcgatatgctggatctgtctaacaattctttggcctctgttcccgaggggctttgggcctccctgggacagccaaactgggacatgagggacgggttcgacatatctggtaacccttggatctgtgaccagaatctaagtgacctctacaggtggctgcaggcacagaaggacaaaatgtttagccagaacgacacccgttgtgccggccccgaggcagtgaaaggtcagacgctcctggccgtggcgaagtctcaatag

SEQ ID NO: 5405 - DNA, 1407 bp, Artificial Sequence
  Description of Artificial Sequence: Synthetic coding sequence
atgcccccttggggagccgcactggcacttattctggcggtgctggccctgctggggctgttgggacctcgcctccgcggaccatggggaagagctgttggggagcgaaccctgcccggcgcacaggaccgtgacgacggagaggaagcagatggaggaggtccggctgaccaattcagtgacggcagggaaccactccccggaggctgcagtttggtgtgcaagccaagcgcccttgctcaatgtcttctgagggcactgcgaagaagcgaagccctcgaagccggaccaagatcttggttttccggcccacatttgcagacgctatgccacttcgttctgcctgttgctcccgggccagagttagctcgggagtacctgcagctggccgacgacggcctcgttgccctcgattgggtggttgggccatgtgtacgcggcaggagaatcactagcgcagggggactccccgcggtgctcttggtgatccctaacgcctgggggaggctaacccgcaatgtgcttggcctgtgcttacttgcccttgaaagaggatattacccagtgatctttcatcggagaggacaccacggctgtcccctggtttcacctcgcctgcaaccattcggggacccatccgacctgaaagaggctgtcacctatatccggtttagacaccctgccgcccctcttttcgcagtttccgaaggtagcggttccgccctgctcctgagctacctgggtgaatgcgggtcttcttcttacgtcaccggtgcagcctgcatcagtcccgttcttagatgccgtgaatggtttgaggcgggtttgccctggccatacgagcgcggcttcctcttacaccaaaaaatcgcgctgtcccgatatgccactgccctggaagataccgttgatacgtcccggctgttcagatccagatcattgcgagagtttgaagaggcactcttctgccacactaagtccttccctatctcttgggacacgtactgggaccgtaatgacccattgagggatgtcgacgaggccgctgtgcccgtgctgtgtatttgttctgccgacgatcccgtatgcggaccacccgatcacacgttaactactgaactgttccattctaatccctatttcttccttctcctgtcgaggcacggaggacattgcggttttctgaggcaggagccacttcccgcttggtcacacgaagtgatcctcgaaagctttagggctttgacggagttctttaggactgaggaacgtatcaagggccttagccgccatcgtgcttcctttctgggcggccgacgcagaggaggtgcattacagaggcgggaggtatcttccagctccaatctcgaggaaatatttaattggaaacgttcctatactcggtag

SEQ ID NO: 5406 - DNA, 423 bp, Artificial Sequence
  Description of Artificial Sequence: Synthetic coding sequence
atgtttttcaccatcagtaggaaaaatatgagtcagaaactctcactgctgttgctcgtcttcgggttgatctgggggctaatgctgctccactatacctttcaacaacctcgccaccagtcttctgtgaagctgcgagagcagattttggatttaagtaaaaggtatgtcaaggctctcgcagaagagaacaaaaataccgtcgacgttgaaaacggggccagtatggccggatatgctgacttaaagcggaccattgctgtgttgctcgatgacatactacagagacttgttaagttggaaaacaaggtggactatatcgtcgtgaatggaagtgcagccaacaccactaacggcaccagcggaaacctggtccctgtcactaccaacaaaaggaccaacgtgtcaggttccattaggtag

SEQ ID NO: 5407 - DNA, 993 bp, Artificial Sequence
  Description of Artificial Sequence: Synthetic coding sequence
agaggcgcactagtgggagcacctaggtccgctagggcctcttgcctgcgcggcagacgtccaggccgtcgccagccgtgcggccgttgtcccgaccccccaaggtccggccccggccaggctgggcgagccagatgtgcgagagacgttgccgcgcagaccgccctcgccccaagggctcttgccctcggagccggtgccgctggaccaggctggcggggggccgtccccaggcgaccggcagcccgcgtgtccagagcagcccagcggcaggaacaggaacttgtgaggttacaccgtgaacaagagtgcgagctccaaccagagcctgccccaccccgacccagcggtccagccacagccgaggaccctggtcggcgccccgtactgcctcaacgacccccagaggagcgacctcctcagcccccgggctccacaggagtgatcgccgaaacgggacaggcggggcctccggccggagctggcgtgtcggggtaccccaagtccccgcctgtagccagccccggggcacccgtgccctccttagtttctttttccgctggtctcactcagaagccatttccttcagacggcggcgtggtactatttaataaggtgttggtcaatgacggcgatgtgtacaatcccagtacaggcgtgtttacggccccatatgacggaaggtatctaatcaccgctacgctaactccagagagagacgcttatgtcgaagcagtgctgtcagtcagcaatgccagcgtggcccagctgcacaccgcgggttatcgccgcgagtttctggaataccatcgacctccaggagccctccatacctgtggaggccccggcgctttccacctgatcgtccatctgaaagctggcgacgcagtgaacgtggtggtgacgggcggcaagctggcccataccgacttcgacgaaatgtattctactttttctggggtatttctctatccgtttttgagccatctctag

SEQ ID NO: 5408 - DNA, 585 bp, Artificial Sequence
  Description of Artificial Sequence: Synthetic coding sequence
atgtcggcattgtggctcttattgggccttttggccctcatggatctgagcgaaagttccaactggggctgttacgggaatattcagagcctcgatactcccggcgcctcatgtggaataggcaggaggcacgggctaaactattgtggcgttagagccagcgagagactggccgaaatcgatatgccatacctgcttaagtatcagcccatgatgcaaacgattgggcagaagtactgcatggacccggcagtgattgccggtgtccttagcaggaaatctcctggcgataaaatcctggtcaatatgggggatcgtacctcgatggtgcaagaccccggcagccaggcacctacctcttggatcagtgagtctcaggttagccaaaccacagaggtcctaacgacaagaattaaggaaatacagcggcgcttcccaacatggactccggatcagtatctccgaggcggcctttgtgcctatagtgggggcgcggggtacgtgaggtcttcccaggatctgtcatgcgacttttgtaatgatgtgttagctagggcaaaatatctgaagcgtcatgggttttag

SEQ ID NO: 5409 - DNA, 273 bp, Artificial Sequence
  Description of Artificial Sequence: Synthetic coding sequence
atgaaatttttagctgtgctcgttctcctaggagtatccatttttctggtttctgcacagaacccaaccacagccgccccagccgatacatatccggcaaccggacccgctgacgatgaggcgcctgacgcggagactacagcagccgcgacaacagcaaccaccgcagcccctacgactgctacgaccgcagcaagtacgaccgcacgaaaagatatccccgtcctacctaaatgggtgggcgaccttcctaacgggcgagtctgtccatag

SEQ ID NO: 5410 - DNA, 1914 bp, Artificial Sequence
  Description of Artificial Sequence: Synthetic coding sequence
atgagccgaatgttgcctttcctgctcttattgtggtttctgccgattacggaaggcagtcaaagagcggagccaatgtttacagcggttaccaattctgtcctgccccctgattacgatagcaacccaacacagctcaattacggtgtcgctgttacggatgtggatcatgatggcgattttgagattgtggtggcaggttacaatgggcccaatctggtgctcaaatacgatcgagcccagaagcgtctcgttaacatcgccgttgacgagagaagttcaccttattacgcattaagggatcggcaggggaacgccatcggggtaaccgcctgcgacattgacggagatggcagagaggagatctatttcctgaatacaaataacgccttttccggtgtcgccacgtacaccgacaagctgttcaaattccgaaacaatcgatgggaggatattctgtcagacgaggtgaatgtggcaaggggggtggcaagcctgtttgccggtagatcagtggcctgcgtcgacagaaagggcagcggccgctatagtatttacatcgcgaactacgcttatggcaatgtcgggccggacgccctcatagagatggacccagaggcctctgatctatcccgcggtatcttggctctacgggacgttgccgccgaagccggagtctcgaaatacacgggcgggcgcggcgtttctgtgggccctatcttatcatcatccgcttctgacatattttgcgacaacgagaatggtccgaactttttgttccataaccggggtgacgggacattcgtcgacgccgctgcctctgcaggtgtggacgatccacatcagcacggtcgcggtgtggccctggctgactttaacagagacgggaaggtggatattgtgtacggaaactggaatggcccccacaggctttatctgcagatgagcacgcatgggaaggttagattcagggatatcgcttctcccaagttcagcatgccttcccccgtacgcaccgtaatcacagccgacttcgataacgaccaggaactggaaattttctttaacaatatcgcatatcgatcttcctcagccaacaggctgtttcgcgtgataaggagagaacacggtgatccccttatagaggagctcaaccccggcgatgcgttggaacccgaggggcggggtacaggtggagtagtgacagatttcgacggtgacggaatgttagatctgatcctctctcatggtgaaagcatggcccaaccactctcggtgttcaggggaaatcaggggttcaacaacaattggctgagagtggtaccaaggacgcggttcggggccttcgcccgcggcgcgaaagtggtcctgtacacaaagaagagcggggcacatctgaggatcatcgacggtggtagcgggtatttatgcgagatggagcctgtcgcccatttcggactgggcaaagatgaggcctcatctgtggaggtgacatggcccgacggaaaaatggtgtctcgcaatgtggcctctggcgaaatgaactcagtgctcgagatcctctaccccagggacgaagatacacttcaggacccagcaccgcttgagtgtggccaaggcttttcacagcaagagaacggacattgcatggatacgaatgaatgtatccagttcccctttgtgtgtccccgcgataaaccggtatgtgtgaacacctatggctcataccgctgcagaacaaacaaaaaatgttcaaggggatatgaacctaatgaggatggaacagcctgtgtcgcccaagtcgcctttctcggcggttattcctcggcagcctctcgtattagcgagccactcagtcgggcaagctacttatccttggggttgggtctatgcctccagctgtacgctctctag

SEQ ID NO: 5411 - DNA, 600 bp, Artificial Sequence
  Description of Artificial Sequence: Synthetic coding sequence
atggccctgaatggcgccgaagtggatgacttctcatgggaacctcctaccgaggctgagaccaaagtgctgcaggctcgccgagagcgccaggatcgcatttctaggctcatgggggactacctgttgagagggtatcgtatgttaggagagacatgcgccgattgcggtactatattgctacaggacaaacagaggaagatctactgtgtcgcctgccaggagctggactctgacgtggataaagataatccagccttaaatgctcaggccgcactgtcacaggcacgggaacatcaactcgcgtccgccagcgaactgcctttgggctcaagacccgctccgcagcccccggtgccaagacctgaacactgcgagggtgcagctgcaggattgaaggcagcccaggggccgcccgcccccgcggttccaccaaataccgacgtgatggcgtgcacgcagacggccctcctgcagaaactcacctgggcatccgccgaactggggagctcaacaagcctggagacatctattcaattgtgtgggctcatccgggcctgtgcagaggctctgcgtagcttgcagcagctgcagcattag

SEQ ID NO: 5412 - DNA, 813 bp, Artificial Sequence
  Description of Artificial Sequence: Synthetic coding sequence
atgaagttaggttgcgttctcatggcttgggccctttacctgtcgctcggcgttctgtgggttgcacagatgctgttagcagccagtttcgagacacttcagtgcgaggggcccgtctgcacggaggagtcaagctgtcatactgaggacgatctaacagacgcacgcgaggctggcttccaagtaaaggcttataccttcagcgaaccctttcaccttattgtatcttacgagctgtttcccgcgccaattttaagggcagtcccaagtgccgaacctcaggctggctcaccgatgacccttagttgtcagacgaagctgcccctccagaggtccgctgcccgtctcctgttcagcttttacaaagatgggcgcattgtgcagagtaggggactgagctccgagttccagatacctacagcctctgaggatcactctggctcatactggtgtgaagcggccacagaggataaccaagtgtggaaacagtcacctcaactggagataagagtacagggtgccagcagctctgctgccccacctactctgaaccccgccccccagaaaagcgccgcccccggaacagccccagaagaggctcccggacctctgccacccccacccactccctctagtgaggatccagggttcagctctccacttggcatgcctgatccacacctgtaccatcagatgggactgctgctgaaacatatgcaggacgtgagagtgctcctcgggcacctactgatggaacttagagagctttcaggccaccgtaagcctggcactaccaaagccaccgctgagtag

SEQ ID NO: 5413 - DNA, 2421 bp, Artificial Sequence
  Description of Artificial Sequence: Synthetic coding sequence
atgcgcctgtcccccgcacctcttaaactctcacgcacaccagcgcttctcgcactggccctccctttggcagccgcgttagccttctcagatgagactctggataaggtgccaaagtctgagggttactgttcaaggatcctgcgggcccagggtacccggcgtgagggatacacagagtttagcttacgagttgaaggcgacccagatttttacaagccaggtacctcgtatagggtgaccctgtccgctgccccaccttcctatttcagggggtttacgctcatagcacttcgcgaaaaccgtgagggtgataaagaagaagatcacgccggaaccttccagatcatagacgaggaggagacgcagttcatgagcaattgtccggtggctgtgacagagagtacccctcggcgacgcacccgaattcaggtgttctggatcgcaccacctgctgggactggctgcgtcatcctgaaggcttcaattgtgcagaaacgtataatatattttcaggacgagggaagcctcaccaagaaactctgcgaacaggactccacatttgacggcgtgaccgacaagccaatcctggattgctgctgcggcaccgctaaataccgattaaccttttatggaaactggagcgagaagacacaccccaaagactatccccgacgggctaatcattggtccgctatcattggcggatctcatagcaagaactatgtactatgggagtatggcgggtacgcatccgagggggtcaagcaggtggctgagctcggttcaccagtcaagatggaagaagaaattcgtcagcagtccgatgaagtgctcaccgtcatcaaagctaaggcccagtggccggcatggcaaccgctcaacgtcagagccgccccatcagccgagttctccgtcgacagaacgcgacacctgatgagctttctcactatgatgggtccctcgcccgattggaacgtgggcctcagcgcagaggacctatgcacgaaagagtgcggatgggtccaaaaggtggtgcaggacttgatcccctgggacgcaggtaccgacagtggagttacttacgagtctccgaacaagcctaccattccccaggagaaaatccgaccattgacatcgctagaccatccccagtcgcccttctacgaccccgaaggtggctccatcacccaggtagctcgagttgtcatcgaacggatcgctaggaagggagagcagtgcaacattgttcccgacaacgtggacgacatagttgccgaccttgcccctgaggaaaaggacgaagatgacacacccgagacctgcatctatagtaactggtcaccttggagcgcatgcagctctagtacctgtgacaagggaaagcgcatgaggcagaggatgttgaaggctcaactggatctctctgtcccctgccccgacacgcaagacttccagccctgtatggggccaggctgctctgatgaggatgggtcaacttgtacgatgagcgagtggataacctggagtccatgtagtataagctgcggcatgggtatgaggagtcgagaacggtacgtgaaacagtttccagaagatggctccgtgtgtacactgcccaccgaagagaccgagaaatgcactgttaacgaggagtgttcgccttcctcttgtcttatgaccgaatggggagagtgggacgagtgcagcgccacctgtggcatggggatgaagaagcggcatagaatgattaaaatgaacccggcggacggttctatgtgtaaggctgaaacctcccaggctgagaaatgcatgatgccagagtgtcatactatcccctgcctcctttctccatggagtgaatggagcgattgttctgttacatgtggcaaagggatgaggaccaggcagaggatgctgaaaagcctggccgagctgggcgattgcaacgaagatttggagcaggttgagaaatgcatgcttccggagtgtcccatcgattgtgagttgactgaatggtcccagtggtcagagtgcaacaaatcctgcggtaagggtcacgtcatccgtacccgtatgattcagatggaaccacagtttgggggggccccctgccccgagaccgtccaacgcaaaaaatgcaggattcgcaagtgcttgaggaacccatctatccagaagctcagatggagagaagcaagagaatctaggagatctgagcagttgaaggaagaatccgagggagagcaatttcccggttgccgcatgagaccgtggacagcatggtctgagtgtacaaagctgtgcggcggcggcatccaggagagatacatgacagtcaagaaaaggtttaagagctcacagtttacctcttgcaaagataagaaggagatacgggcttgcaatgttcacccttgctag

SEQ ID NO: 5414 - DNA, 4242 bp, Artificial Sequence
  Description of Artificial Sequence: Synthetic coding sequence
atgagacatggggtggcatgggctctgctagtggctgcagccctgggactcggggccaggggcgtgagaggggccgttgccctagcagatttctacccatttggcgccgagcggggagacgccgtgacacccaaacaggacgatggcggtagcggcctcaggccgttatcagtgccattccccttcttcggagccgagcacagcgggttgtatgttaacaacaacggcatcatctctttccttaaagaagtttctcagtttactcccgtggctttcccaattgccaaagatcggtgtgttgtcgcagcattttgggcagacgtggacaatcggagagctggcgatgtgtactacagggaagcaactgatcccgccatgttaaggagagcaacagaggatgtcaggcactactttccagagttactggatttcaacgctacctgggtcttcgtggcgacgtggtacagggtgactttttttggcgggtctagtagtagtcccgtgaatacattccagacagtgttaatcactgacggaaagttatcatttacaatcttcaactacgagtccattgtctggaccacaggtacacatgcgtcatcgggaggaaatgctaccgggttgggcggcatcgcagcccaggcagggttcaatgccggagacggtcagcggtattttagcatcccaggctcacgcacagctgacatggcggaggtcgagactacaaccaacgtgggcgttcccggaaggtgggcatttaggattgatgatgcccaagtaagagtcggaggatgcggtcacaccaccagcgtgtgtcttgccctgcgcccttgcctaaatgggggtaagtgcattgacgattgtgttactggaaacccgagctacacctgctcgtgcctgtccggctttacaggacggcggtgccacctcgacgtaaatgaatgtgcctctcagccttgtcagaacggaggcacgtgcacccatgggatcaactcctttcgatgccaatgtccagcaggcttcggaggaccaacatgtgaaacagctcagtcaccttgcgacacgaaggaatgccagcacggcggccagtgccaggtcgagaatgggagcgcagtgtgcgtgtgtcaagccggttacacgggcgcagcatgcgaaatggacgtggatgattgtagccctgatccctgcctcaatggaggatcgtgcgttgacttggtgggaaattatacctgcctatgcgccgagcctttcaagggcctaaggtgtgaaaccggagaccatccggtcccggatgcgtgcctctccgccccctgtcataacggaggtacctgcgtggacgccgatcagggttatgtgtgtgaatgtccagaagggtttatgggactggactgcagagaacgtgtccctgacgattgcgagtgcaggaatggtggtcggtgtttaggggcaaacacaacgctgtgccaatgtccccttggcttctttgggcttctgtgcgagtttgaaatcacagctatgccgtgtaatatgaacactcagtgtccggacggaggatattgcatggagcatggaggctcatacctgtgtgtgtgtcatactgaccacaacgccagtcactccctcccttcgccctgcgattccgatccctgctttaacggcggctcctgtgacgcccacgacgacagttacacttgtgaatgcccacggggcttccatggcaagcactgtgaaaaggcccggcctcacctgtgcagctcagggccatgtcggaacggcggcacttgcaaggaggccggcggggagtatcactgttcttgtccttaccggttcaccggaaggcactgcgaaatcgggaagcctgactcatgcgccagcggaccatgtcacaacgggggcacttgctttcactacatcggtaaatataagtgcgactgtcctcctggcttttccggccgccactgtgaaatcgctcccagcccctgcttccgaagtccctgtgtgaatggagggacctgcgaggacagggataccgatttcttttgccattgccaggctggctacatgggtaggagatgccaggcagaagtggattgtggacctcccgaggaggtaaagcacgcgactctccgcttcaacggtacccggcttggggctgtggccctctatgcttgcgacaggggatactctctcagcgctcccagtagaatccgcgtttgtcaaccccatggagtttggtccgaacctccgcagtgcttagagatcgatgagtgtcggtcacagccatgcctgcacggagggtcttgtcaggatcgagttgctggctacctatgtctgtgctctacagggtacgaaggagctcactgtgaacttgaaagggatgagtgtcgggctcatccatgccgcaatggtggttcctgccgcaatctgccaggcgcttatgtttgccgctgcccagcggggttcgtgggggtgcattgtgagacggaggtggatgcgtgtgacagcagcccttgccaacacggcgggcgatgcgaatctggcgggggcgcgtacctctgcgtttgtccggaatctttctttgggtaccactgcgagactgtgagcgacccatgcttctcctccccttgtggggggcgcggatattgcctcgcgagtaacggaagccacagttgcacatgtaaggtggggtacactggtgaggattgtgcaaaggagctcttcccccccacagctttaaaaatggagagggtggaagaatctggtgttagcatctcctggaatccaccaaatggtcccgctgcacgtcagatgctggacgggtacgctgtcacctacgtgagttccgacggctcgtaccggagaaccgacttcgtggacaggactcgaagcagtcatcagctccaggccctcgctgctggccgggcctataacatatcagtgttcagcgtgaagcggaactcaaataataagaatgatatatcccgacctgccgtgctcctggcgcgaacgcgcccaaggccagttgagggatttgaggtgaccaacgtcacagcctccactatctctgttcaatgggcgttgcaccggatcaggcacgccaccgtttctggggtccgtgtgtcaattagacatcccgaagccctgagggaccaggctacggatgtcgataggagcgtcgaccgctttactttccgtgccttgctccccggcaagaggtacactatccagttgacaacactttcagggttgcgtggggaagagcatccgaccgaaagtctggccacagcccccacacatgtttggacaagaccattaccccctgcaaatctcacggccgcgagggtgaccgctacaagcgcgcatgtggtgtgggatgcaccgactccaggaagcctcctggaggcgtatgtaataaatgtaaccacatctcagagcaccaagtcccgctatgttccaaacggaaagctcgcatcatacaccgtgcgggacttgttgcctgggcgaagatatcagctttcagtgattgccgttcaatctaccgagctgggtcctcagcactcggagccagcacacctttatatcataacctctcctcgcgacggggcagaccgccggtggcaccaaggggggcaccatcccagagtgctgaaaaacagacctcctcctgccagactaccagagctgcgtctcttgaacgatcattcggcccctgagacacccacccagcccccacgatttagtgagctcgtggatggccgcgggcgggtctccgctaggtttggtgggtcgccgtccaaggccgccactgtgagatctcagcctactgcatcagcacagttagaaaatatggaagaggctcctaagagggtgtccctagctctccagctcccagagcatggcagcaaggacattgggaacgttccaggcaactgcagcgaaaacccttgccagaatggagggacctgcgtccccggtgcagatgcccatagctgcgattgcgggcctggcttcaaagggcgcagatgcgaactcgcttgcattaaagtctcccgcccgtgcaccaggcttttttccgagaccaaggcttttcccgtatgggagggaggcgtgtgccaccacgtttacaaaagggtgtatagggtgcatcaggacatctgttttaaagaatcttgtgaaagtaccagtctgaaaaaaactcccaaccgtaaacagtccaagtcccagacactcgaaaagagctag

SEQ ID NO: 5415 - DNA, 1008 bp, Artificial Sequence
  Description of Artificial Sequence: Synthetic coding sequence
atgttcctagccaccctcagtttcctcctgccttttgcacacccattcggaaccgtttcctgtgagtacatgctaggaagtccccttagtagtctcgcacaagtgaacctatcaccattttctcaccccaaggtccacatggatcccaattattgccaccctagcaccagcctacacctctgttccctcgcatggagtttcacccggctcctccaccccccactgagccctggtataagccaggtggtgaaggaccacgtcactaaaccaaccgcaatggcacaggggcgagtggctcacttgattgagtggaaggggtggtccaaaccatctgattcacccgccgctctggagagcgctttctcctcgtacagcgatctgtcagagggagaacaggaggcgagatttgctgctggtgtcgcggagcaatttgctattgccgaggccaagctccgggcctggtcaagcgtggacggcgaggactcaacagacgattcttacgacgaggattttgccggcggcatggacaccgacatggctgggcagctgcccctagggcctcacctccaggatctttttacgggacatagattttctaggccagtgaggcaggggagcgtagagcccgaatctgactgtagccaaaccgtctccccggatacactctgctcatccctctgctcccttgaggatggtctcttgggctccccggctagactggcctcacaacttctaggggatgagctactgctggcaaaactgcctcctagtcgagaatctgctttccggagcctcggcccactggaggcccaggacagcttatataactctccactaacagaatcttgtctcagtccagcagaagaggagcccgccccttgcaaagattgtcagccactttgccccccactcaccgggtcctgggagaggcagcgacaggccagcgacttagcatctagcggggtggtttcactggacgaagacgaggctgagcctgaagagcagtag

SEQ ID NO: 5416 - DNA, 828 bp, Artificial Sequence
  Description of Artificial Sequence: Synthetic coding sequence
atgcagccaccaggcccaagagaccccctcatccgactgtgttttttcagagaggaaggcactaatgtggttcagaaaatctgcttttcaacccaaatcattagacatttcgaatctaaactatctgatacgatcgaggtgtaccaagagcggattcagtggctgactgagaacagcaagaaggcttttggcctcataaaaggtgctagagtgtccattttaattgatgtgtccgccataagtagtgggcctcagaaggaagaattccaaaaggacctgatgagtcttatcgacgagcagttgtcccacaaggagaagctatttgtactgagcttcgggacaaacgctggctccctctggcccgatccgatggaagtctccgcatccactcttcaggagctcaaactgtgggtgaagacactgcaacctgacggcggatcaaatctgctgcaagctctcaagaaaatattcacattaaagggattagactcactggtcgcaattatgaggagttgtcctgaccaaccttccgagatcctgtccgactatatccagcaaagtactatgggtcgggacctgataattcactttataacctacaggtgtgatgaccaaatgccaccagctgtgctgaaaaacctggctgaagctgtcagggggtactatcattgttattcccctaagatggaacactacacttcccgggacatggacgagctgctcgccgagatacagaaagcccagtccctgttgagccacgtacaggcacttcagcacagcagcccctgtgaggcactgacctgcacaatggaggaaccacgtaattag

SEQ ID NO: 5417 - DNA, 438 bp, Artificial Sequence
  Description of Artificial Sequence: Synthetic coding sequence
atgctgacgcgtttagtactatctgctcacctgtcatcaacaacatcgccaccttggactcacgctgcaatttcctgggagctagataatgtgctcatgccaagtccccgcatctggccacaagtgaccccaacaggaaggtctgcaagcgtgagatctgaggggaacacatcaagtctatggaattttagtgcaggccaagacgtgcatgccattgtgacacgaacttgtgaatccgtactgtctagcgctgtgtatacccatggctgcggctgcgtgcgctctgccacaaacatcacatgtcagtcaagtggacagcagcgtcaggctgctaggcaggaagaggagaattcaatctgtaaagctcatgatagccgggagggcagacttggataccctctctcagcgcaccaaccaggatccggggggccgaattag

SEQ ID NO: 5418 - DNA, 777 bp, Artificial Sequence
  Description of Artificial Sequence: Synthetic coding sequence
atgactcctccaaagctccgcgccagcctctcgccttcccttctgcttctcctttcgggttgcttactggctgccgctcggcgcgagaaaggcgcagcatctaacgtggcggagccagtaccaggacccactggcgggtccagcggtagatttctctctccagagcagcacgcctgttcctggcagttgctgctgcccgcccctgaagcagcggccggtagtgagttggctcttcgttgccagagccccgatggagctagacaccaatgtgcctaccgtggccacccagagcgatgcgcggcctacgccgcccgtagagcgcacttttggaaacaggtcctgggcggcctgaggaagaagcgtcgcccatgtcacgacccagccccactacaggctcgactgtgtgcaggtaagaaggggcatggagcggagctccgactggtcccccgcgcctctccccctgcaaggccaactgttgcagggttcgctggtgagtcgaaacctagggcccggaatcgtgggcggactagagagcgcgcgtccggacctgccgcgggcaccccgccaccacagtcggcccctcccaaggagaatccatccgagcgcaaaacaaacgaggggaaaaggaaagctgcacttgttccaaatgaagaacgtccaatgggaactggcccagatccggatggcctggatggaaacgccgagctgactgagacctattgcgcggaaaagtggcattcactgtgcaacttcttcgtgaatttttggaacggctag

SEQ ID NO: 5419 - DNA, 393 bp, Artificial Sequence
  Description of Artificial Sequence: Synthetic coding sequence
atggctcgcagacactgtttcagctactggctcctggtttgctggctggtcgttacagtggccgagggccaggaggaggtgttcacaccccctggtgatagccagaacaatgccgatgcaaccgactgccaaatcttcacactgaccccccccccagctccaaggtcacctgtcacacgagcgcagccaataaccaaaaccccacggtgtcccttccatttctttcctaggaggcctcgaatccattttcgatttccaaatagacctttcgtcccctcccgctgcaaccaccggttcccttttcagccattttattggccccatcgatatctgacttatcgatatttcccaaggcgtcggttgcagaggggcagctcgtccgaagagtcgtag

SEQ ID NO: 5420 - DNA, 600 bp, Artificial Sequence
  Description of Artificial Sequence: Synthetic coding sequence
atgtaccctgcaacagccgtccctcaaataaatatcaccatcctgaaaggcgagaagggagataggggcgatcggggactccagggtaaatatggcaagacgggctcagcaggtgctcgcggccacaccggcccaaaaggacaaaagggaagcatgggggcacccggcgaacgctgcaagtctcattacgcagctttttcagtggggaggaaaaaacccatgcacagcaatcactattaccaaacagtaatctttgataccgaatttgttaatttatatgatcattttaatatgtttacgggcaagttctattgctacgtgccggggctgtacttctttagccttaacgtccatacatggaatcagaaagaaacatacttacacatcatgaaaaacgaagaagaagtggtgattctcttcgctcaagttggcgataggagcatcatgcagtctcagtccttgatgcttgagcttagagagcaggatcaggtgtgggttaggctgtacaagggtgagcgcgaaaatgctatcttctcagaagagctggatacatacatcaccttttctggatacctcgtgaagcatgccactgaaccatag

SEQ ID NO: 5421 - DNA, 702 bp, Artificial Sequence
  Description of Artificial Sequence: Synthetic coding sequence
atggcgctgaaaaacaaattttcctgcctatggatcctgggcctttgcctggtcgctacaacgtccagcaagattccatcgataaccgaccctcatttcatagataattgcattgaggcccataatgaatggaggggaaaggtgaatcccccagctgccgacatgaaatatatgatttgggataaggggctggcaaagatggcaaaggcatgggccaatcagtgcaaatttgagcacaacgactgccttgacaagtcgtacaagtgttacgccgcgtttgagtacgtgggggagaatatatggttgggggggattaagtcatttactcccagacacgctataactgcctggtataacgagacccagttctatgatttcgattctctgagctgcagccgggtatgcgggcactacacccaattggtgtgggcgaactcattctacgttggttgtgccgtggcaatgtgcccgaacctcggcggagcaagcactgctatcttcgtttgcaattacggccccgccggcaattttgccaacatgccaccttatgttcggggagaaagttgtagtttgtgctcaaaggaggaaaagtgcgtaaaaaacttgtgcaaaaacccgttccttaagcccactggcagggccccgcagcaaaccgcttttaatccgtttagcctcgggtttctgctgctccgcattttttag

SEQ ID NO: 5422 - DNA, 669 bp, Artificial Sequence
  Description of Artificial Sequence: Synthetic coding sequence
atggcactccatatacacgaagcatgtattctcctgttagtcatacctggtctggtgacatccgcagccatctcccatgaggactaccctgccgatgagggagatcagatcagcagcaatgataatcttattttcgatgactatcgcgggaaaggatgcgtggatgacagcgggtttgtatacaagttgggggagcgcttcttcccagggcacagtaattgtccctgcgtatgcgcccttgatggccctgtgtgtgaccagccagagtgccctaaaatccacccaaagtgcactaaagtcgaacataatggctgctgtccagagtgtaaggaggtgaaaaatttctgtgagtaccatggcaaaaattataagatcctggaggaatttaagccaagcccgtgtgagtggtgtcgctgcgagcccagtaatgaggtgcactgtgtggtcgccgattgcgctgttccagagtgcgtgaatcctgtgtacgaacccgaacagtgctgtccagtgtgtaagaatggtccaaattgctttgcaggaactaccattatcccagccgggatcgaggtcaaggtggatgagtgtaacatatgccattgtcacaatggcgattggtggaaacctgcccaatgttctaaacgcgagtgccaggggaagcagacagtgtag

SEQ ID NO: 5423 - DNA, 957 bp, Artificial Sequence
  Description of Artificial Sequence: Synthetic coding sequence
atgctgcccctgactatgactgtactcatcctcctactcttgcccaccgggcaggcagcccctaaagacggcgtgacgcgtcctgattcagaagttcagcatcagctgttgcccaatccattccagcccggccaggagcagctggggctgctccaaagctatcttaaaggacttggcaggactgaagtccagctcgaacatctatcgcgagagcaggtcttactctatctttttgcccttcacgattacgaccagagcggtcagctggatggcctcgaactgctctcgatgttaaccgctgcgttggctccgggcgccgctaatagccccactaccaacccagtgatccttatcgtcgacaaggtgctcgaaacacaggacctgaatggagatgggctcatgacccccgcagaactcatcaacttcccaggggtggcactgcgacatgttgagccaggggagcccctcgctcctagtccccaagagccacaggccgttggtcgacagagcttgctcgctaagagccctttaaggcaggagacgcaagaagctccaggccctagggaggaggctaagggtcaggtcgaggccagacgcgagtccctcgatcccgtgcaagaacctggcgggcaggccgaggcggacggcgatgttccgggaccaaggggtgaagccgagggccaagcggaggccaaaggggatgcacccggccctaggggcgaagctggtggccaagctgaggccgagggagacgcaccgggcccaaggggcgaagccggaggccaggccgaagctgagggggatgcccccgggccacggggagaggccggcggtcaggccgaggcccgcgaaaatggtgaggaggcaaaagaactgccaggtgagactttggaaagcaagaacacccaaaatgatttcgaagtgcacatagtgcaggtcgaaaatgacgagatttag

SEQ ID NO: 5424 - DNA, 393 bp, Artificial Sequence
  Description of Artificial Sequence: Synthetic coding sequence
atgctggcaccactgtttctgtgttgtctccggaacctcttcagaaaactcatctcctttcaaccccctcaactgggccgtaccaatatgcactatagcaagctcccccgaacggctatcgagaccgaattcaagcaaaacgtcggaccgccaccgaaggatttaacggccgaggtttacttcccttcaattaaatccaggtcacaccttccggcagtcttctacaaccagtacttcaagcacccaaaatgcgtcggcgagtatggtcccaagaatggtgcggagcggcagattgaggaacgcaaggtcctacctaccactatgatgtttagcatgctggcggattgtgtcttgaagagcacacccattcccatactgggtgtggccatgtag

SEQ ID NO: 5425 - DNA, 4362 bp, Artificial Sequence
  Description of Artificial Sequence: Synthetic coding sequence
atgatgcttccgcagaattcctggcacatcgacttcggccgttgctgttgccatcaaaacctgtttagcgcggtggtgacttgcattctgcttctaaattcctgttttctcatctcctcattcaacggtactgacttggaactcagactggtgaatggggatggcccctgctcaggaaccgtagaggttaagttccagggccaatggggtaccgtttgtgacgatggctggaataccaccgcaagcaccgtggtatgtaagcagctcggttgcccattcagctttgccatgttccgctttggccaggccgtcacgaggcacggcaaaatctggctggatgatgtgtcttgctacggaaatgagtctgccctgtgggagtgccagcatagggaatggggttcacataactgttaccacggagaagacgttggggtgaactgttatggcgaggctaatctcggactgcgcctcgtggatggaaataatagctgttctggacgggttgaggttaaattccaggagaggtggggcaccatctgtgacgatggctggaatcttaacaccgcagccgtggtctgcagacagctcggttgccctagtagcttcatcagttccggcgtcgtcaatagcccagctgtcctgaggccaatttggttagatgacatcttgtgccagggaaatgaactcgccctgtggaattgtcggcaccgggggtggggaaaccacgattgttctcataacgaggatgtcactcttacttgctacgattccagcgacctggagctaaggctggttggggggaccaaccgctgtatgggcagagtggagctcaaaattcaggggcggtggggaacagtgtgccatcacaagtggaataacgcagccgccgatgtggtgtgcaagcaattgggttgcggaactgcgctgcattttgcagggctcccacacctgcagtctggctccgatgtggtgtggctcgatggtgtgtcttgctcaggaaatgagtctttcctttgggattgtcgccactctggcacggtcaactttgactgtttgcaccaaaacgacgtctcagttatctgtagcgacggtgctgatctcgaattaaggttagctgacggtagcaacaactgctccggacgggttgaggtcagaatccatgaacaatggtggacaatttgtgatcagaattggaaaaacgaacaagccttggttgtgtgtaaacaactcggatgtccgttcagtgtctttggctctcgccgggccaagccaagtaacgaagctagagacatatggatcaacagtatttcttgcaccggtaatgagtctgctctgtgggattgtacctacgacgggaaggccaaaagaacctgtttcagaagatctgacgccggggttatatgttctgataaagcggacctggaccttcgacttgtgggcgcccactccccttgctacggccgcctggaagtcaagtatcagggagaatggggcactgtctgtcacgaccgctggagcaccaggaacgccgcagtggtgtgcaagcagctgggctgcggtaagcccctacacgtgtttggaatgacctacttcaaagaggccagcggtcctatctggctggatgacgtctcttgtataggaaatgagagcaatatctgggactgtgagcacagtgggtggggtaagcacaattgcgtccatagagaagacgtcattgtgacatgttctggagacgcgacctgggggttgagattagtgggcggctcaaaccgctgtagcggcaggcttgaagtctactttcagggccgatggggaacagtctgtgacgatggctggaacagcaaagccgcagccgtggtgtgctctcaactggattgtccaagtagcattataggcatgggactcggaaacgcttcaaccggatacgggaaaatctggttggacgatgttagttgcgatggtgatgaatctgacctgtggtcatgcaggaattctggctggggcaacaacgactgctcccatagtgaggatgtgggagtaatttgcagcgacgcctccgatatggagcttaggctcgtcgggggttccagtcgttgtgccgggaaagttgaagtgaatgtgcagggagccgtgggcattctctgtgccaacggatgggggatgaacatagccgaagtcgtgtgccgccagcttgagtgcgggtctgcgataagagtcagccgcgagccacatttcaccgagaggacgttgcacatcctcatgagtaactccgggtgtaccggcggcgaagccagtctctgggactgtatacgatgggagtggaagcagacagcttgtcatctgaacatggaagccagccttatatgtagtgcgcatcggcagccgcgtcttgtcggggctgatatgccgtgttccggacgcgtcgaggtgaagcacgctgatacttggcggagcgtgtgcgacagcgacttttccctacatgccgccaacgtgctctgcagggagttaaactgtggagatgccatctcactgagcgtcggcgaccactttggcaagggcaacggcttgacgtgggctgagaagttccaatgtgagggctctgagactcacctggctctgtgccctatcgtacagcaccctgaagacacgtgtatccactcacgtgaagtgggcgtagtttgcagccgctacacagacgttcgattggtgaatgggaagtcccaatgcgacgggcaggtcgagataaacgtactcggacattggggttccctctgcgacactcactgggatcctgaggacgcccgtgtgttgtgtcgccagctctcctgcgggactgccctgagtacaacggggggcaagtacatcggggagcgcagtgtaagggtgtggggacacagattccactgccttggaaacgagtcgctcctcgataattgtcagatgactgtgcttggagctccaccttgtatacacggcaacacagtttctgttatctgtaccggcagcttgacacagccgctttttccctgcctggctaacgtgagcgatccgtacctgagcgccgtacctgaaggcagtgctctaatctgcctggaagacaagcgactgagactcgtggacggcgatagtaggtgtgctggccgggtggaaatctaccatgacggcttttgggggacgatttgtgatgatggttgggacctgagcgacgcccacgtcgtctgtcagaagttaggatgcggagtggcctttaacgctacagtcagcgcacacttcggagaaggctccggacccatttggctggacgatcttaattgtacgggaatggagtctcatctgtggcagtgtccctctagaggatggggacagcatgattgtaggcacaaagaggatgctggggtgatttgttctgagtttaccgctcttcgcctgtactcagaaacggaaaccgagagttgcgccggccgattagaggtcttctataacgggacctgggggagtgtgggaagacgcaatattacgacagctattgccggtatagtttgtaggcagctcggctgtggggagaatggggtagttagccttgcccccctcagcaagactggaagtggcttcatgtgggttgacgatatccagtgccctaaaacccatatcagcatctggcagtgtctgtcagccccctgggagcggagaatctccagtcctgcggaagagacctggatcacatgcgaggataggatcagagtgaggggtggtgataccgagtgttctggcagagtggaaatctggcatgcaggaagctgggggaccgtgtgcgacgatagctgggacctggctgaagctgaggttgtctgccagcagcttggctgtggtagtgcccttgcagcactgagggatgcatccttcggccaaggaactgggaccatctggttggacgatatgcggtgtaagggaaatgaatcttttctgtgggactgccacgccaagccatggggccaaagcgattgcggacataaggaggatgccggcgttcggtgtagtgggcagagtcttaagtctcttaacgcctcatctgggcacctggccttgatcttgagctccattttcggcctcctcctgctcgtgctgttcatcctctttctgacctggtgcagagtgcagaagcagaagcatctacccttgcgggtctccacccgcaggagaggcagtttggaagaaaacttgttccatgagatggagacctgcctgaagcgggaggacccacatgggacccgcaccagtgacgataccccaaaccatgggtgtgaggacgccagtgatactagcctgcttggagtactgcccgcgagtgaggccactaagtag

SEQ ID NO: 5426 - DNA, 759 bp, Artificial Sequence
  Description of Artificial Sequence: Synthetic coding sequence
atgctgcctccgccgaggccggccgccgcgctggccctccctgttctgttactgctcttagtggttctgacacccccccctacaggtgcccgcccaagtcccggcccagattatttgaggcgaggatggatgagacttctggcagaaggcgaaggctgtgcaccatgtcgccctgaagagtgcgctgctcctagagggtgcctagccggcagggttcgggacgcttgtggctgctgttgggaatgcgccaacctcgagggccagctgtgcgacctggatccgtccgcccacttctacggccattgtggggagcaactggaatgccggcttgataccggaggcgatctgtctcgcggagaagttcctgagcccctttgcgcctgtaggtcgcagtcacccttatgcggttcagacggccatacctacagccagatttgtagattgcaggaagctgcacgcgctagacctgacgcaaatctgaccgtggcacaccccgggccctgtgagagcggaccccagatcgtcagccacccatacgacacttggcgcggcccacggctgcagaccctgggaaccgaagatactctaaccacattggtgggcgctggaggaatggcgcgggctgtggcttgtggcgaagctcccggcgagcacctggccctccaggttctgtgcctgagcggaaagagacggcacttatggcaggtcgggtctactggtagctccgagggagtgccctccggaggctctttttggtag

SEQ ID NO: 5427 - DNA, 1323 bp, Artificial Sequence
  Description of Artificial Sequence: Synthetic coding sequence
atgaaactcgccttgctgctgccatgggcctgctgttgtctctgtgggagcgccttggccactgggttcctgtaccccttttctgccgctgccctgcagcagcacgggtaccccgaacctggagctggatcaccggggtctggttatgctagtagacgacactggtgccatcacactgtcactagaactgtgtcttgtcaggttcagaatgggtccgagaccgtagtgcagcgcgtgtatcagagctgccggtggccgggaccctgcgccaatcttgtgtcttaccggaccctgattagacctacatacagggttagttatcgcaccgtcactgtcctcgaatggcggtgctgccctggatttactgggagcaattgtgacgaggagtgcatgaactgtacacgactgtcagacatgagtgagcggctgaccaccctggaagctaaggtccttctgcttgaggccgcagagcgcccctcctctcccgacaatgacttacctgctccagaatctacgccaccaacgtggaacgaagatttcctgccagatgcaattcccctagctcatcccgtgccacgtcagcgcagaccaacaggaccggccgggccccccgggcagaccggacctccagggccagctggacccccaggatccaagggagaccgaggccagacaggggagaagggcccagcgggccctcctggtctgctgggaccacccgggccgcggggcctgccaggggaaatgggccgcccaggtccccccggaccgcctgggcctgccgggaatcctggccccagccccaacagccctcagggggcactctactccctacaaccacctactgataaggataacggggatagtaggcttgcctctgccattgtggacaccgtcctggctggggttcccggcccccgaggaccacctggccctccagggccgcctggtccccgcggcccgcctggtccacccggcacccctgggtcccagggcctcgctggcgagcgcggtaccgtcggccctagcggcgagcccggggtaaagggggaagaaggggagaaggccgcaacagccgagggcgaaggggtgcagcagctgagagaggcactaaagatcctggcagagcgagttttgattctggaacacatgatcgggatacatgatcccttggcttctcctgaaggctccggccaggacgcagccctcagagctaacctcaagatgaagcggggcggcgctcagccagacggcgtactggccgccctactgggaccagatcccgggcaaaaaagtgtggaccaggccagttccagaaagtag

SEQ ID NO: 5428 - DNA, 1341 bp, Artificial Sequence
  Description of Artificial Sequence: Synthetic coding sequence
atgcttcatccggaaacatccccaggccgagggcacttgctagctgttttgctggctctgttgggcacagcatgggcagaagtttggccccctcagcttcaggagcaagcacccatggctggagcccttaaccgcaaagagagctttctcctgctttctttgcacaatcgcctgcgttcctgggtccagcctccagctgcagacatgcgccggcttgactggtccgattccctggcccagttggcccaggcacgggcggctctgtgtgggattcctaccccctcactagcctctggcctgtggaggactctgcaggttgggtggaacatgcagttgctacctgccgggctcgcctctttcgtagaagtggtctcattgtggttcgctgagggccaacggtatagtcacgccgctggggagtgcgcacggaacgcaacttgcacacactatactcagctggtgtgggctacgagctcgcaactcggctgcggccggcacctatgtagcgctggacaggctgccatcgaagcatttgtgtgcgcttacagcccacgaggtaactgggaagtgaatgggaagaccatcgtgccttataagaaaggggcatggtgctccctgtgtacggcctccgttagcgggtgcttcaaagcctgggatcacgcgggcggtttgtgcgaggtgcccaggaacccatgccgaatgtcatgtcagaaccacggacgcctgaacatctcaacttgtcactgccactgtccgcctggctatactggccgctattgtcaagttcgatgcagtctccagtgcgtgcacggcagattcagggaggaggagtgttcctgtgtgtgcgatataggctatgggggagcccaatgtgctacaaaggtgcattttccatttcatacctgtgatctgcgcatcgatggagactgcttcatggtcagctcagaagctgatacctattatcgggcccgtatgaagtgtcagcggaaaggtggggtcctagcccagattaaatcacaaaaggttcaggatattctcgctttctacctcggcaggctggagacaaccaatgaagtgatcgactctgacttcgagaccagaaacttctggatcgggctcacatataaaaccgctaaggacagcttccggtgggctaccggtgagcatcaggctttcacctcattcgcctttgggcaacccgacaatcacggctttggcaactgtgtggaacttcaggccagtgcagcattcaactggaataatcaacgatgcaaaactaggaataggtatatttgtcagttcgctcaggagcatatttcacgttggggccccggctcatag

SEQ ID NO: 5429 - DNA, 219 bp, Artificial Sequence
  Description of Artificial Sequence: Synthetic coding sequence
atgcaacgcctggtgctgttgctcgcaatttctctgcttttatatcaggatctgcccgtccgaagtgagtttgagctagataggatttgtggttatggcacagcgcgatgtagaaaaaagtgtcggagtcaagaatacaggatcggaaggtgccccaacacctacgcctgctgcctgcgaaagtgggatgagtctctgttaaaccggacaaagccttag

SEQ ID NO: 5430 - DNA, 2349 bp, Artificial Sequence
  Description of Artificial Sequence: Synthetic coding sequence
ctttggttgttactgtgggccgccgcatggcggctgggcgcgagcgcctgtcctgcactttgcacctgcactggaacgactgtggattgccatgggacagggctccaggccatccctaagaatatcccaagaaatacagagcggctggagcttaacggaaacaacataacccggatccacaaaaacgatttcgccggactcaaacagctccgggtgttgcagctgatggaaaatcagatcggcgcagttgagcggggggcattcgacgacatgaaagaacttgagcgcctacgactcaataggaatcaactccacatgctgccggaacttttgttccagaataaccaagccctttcacgccttgacctgagcgagaacgcaatccaggcgatcccacgcaaggcatttagaggcgccaccgatttgaagaacctacaactagacaagaatcagattagttgcattgaggaaggggctttcagagccctcaggggactggaggtactcaccctgaataataataacatcacgacaatacctgtaagttctttcaaccacatgcccaaattgagaacttttaggctccactctaaccaccttttctgtgactgtcacctggcatggctgagtcaatggctccgacagaggccaaccatcgggcttttcacacagtgcagcggccctgcgagcctcagaggcctgaacgtagctgaggtacaaaaatcagaattcagctgtagtggccagggagaggcaggaagagtgccgacttgtaccctgagctctggaagttgtccagctatgtgcacctgctcaaacggcatagtcgactgccgcgggaagggcctaacagcaatccctgccaatttgcccgagacaatgactgaaatacgcctggaactgaatggtatcaagtccattcctcctggagccttttccccttaccgcaagttacggcgtatctgtccactttcattctgttcgccctgcagagatctctccaataaccagatcgcagaaattgccccggatgcattccagggactgcgcagccttaactcactcgtgctgtacggcaataaaataaccgacctgccgcgcggagtgtttggtggtctgtacaccctgcaactgctcttgcttaacgccaacaaaatcaactgtatccgcccagatgctttccaggacctccaaaatctctcgctgctgagcctgtacgataacaagatccagtcgctggccaagggtacctttacaagcctcagagctattcagacccttcatctggctcaaaacccttttatctgcgactgtaacctaaagtggctggcagacttcttgaggacaaacccgatagaaacctcaggagcaaggtgcgcgagcccaaggagactggcaaacaaacgtatcggccagattaagtcgaaaaaattcagatgctccgccaaagaacaatacttcattcctggaacagaggactaccaactgaactccgagtgtaactctgatgtggtgtgcccacacaagtgccggtgtgaagcaaacgttgtcgaatgttcgtccctgaagctgacaaagatccctgaacggataccgcaatcgaccgctgagttgcggctgaacaacaatgagattagcatattggaagctaccggaatgtttaagaagctgacccacctgaagaaaataaacctatcaaacaacaaggtcagtgagattgaagacggtgccttcgagggcgccgctagcgtttccgagcttcacctaactgccaatcaactggaatctatcaggtccggaatgtttagaggcctggacgggctccgcactttgatgctgagaaataatcgtatcagctgtatccacaatgactcgtttactgggctaaggaatgtgagactgctgtctctctatgacaaccagattacaacagtttcccctggcgcttttgacacactgcagtcactctccaccctaaatcttctggccaacccgtttaattgcaactgtcaactggcttggcttggaggctggctccgcaagcgaaaaatcgttaccggcaaccccagatgtcaaaacccagattttctacgtcagatcccacttcaggacgtggcctttccagattttcgttgtgaggaaggacaggaagaaggaggctgcttgcctcgccctcagtgtcctcaggagtgtgcctgtctcgacactgtagtgcggtgctctaacaaacaccttcgtgcactgccaaaggggattcctaagaacgtcacagagttatatctggacggcaatcagtttacactcgtgccgggacaactatctaccttcaaatacctccagctggtctag

SEQ ID NO: 5431 - DNA, 411 bp, Artificial Sequence
  Description of Artificial Sequence: Synthetic coding sequence
atgagcaatgttccccataaaagctcactgccagagggaatcaggcccggaactgtattgcgcatccgaggccttgtcccacccaatgcatcacgctttcacgtaaacctcctgtgcggtgaggagcaggggtccgatgctgcactgcactttaatcccaggttggataccagcgaagtcgtattcaattccaaggagcagggcagctgggggcgcgaagagcggggccccggcgtgcccttccagcgtggacagccattcgaggtactcatcattgcatccgacgacggatttaaggccgtagtaggggacgcccagtaccatcactttaggcatcggctgcccctcgcacgagtgagactggttgaggttggtggtgatgtccagctcgactctgtgagaattttctag

SEQ ID NO: 5432 - DNA, 1926 bp, Artificial Sequence
  Description of Artificial Sequence: Synthetic coding sequence
atgcctcctccactgcctctgctgctcttaactgtgttagtggtggccgccgccagacctgggtgtgaattcgaacgtaaccctgccgcaacatgtgtggatctgcagttgcggacctgctcagacgctgcttacaaccacacaacattcccaaacctcttacaacacaggtcctgggaggttgtcgaggctagttctgaatatatcttactctctgttcttcatcagcttctggaaggacagtgcaatcccgatttgcgactactaggatgcgcagttcttgcccccagatgcgaaggcggatgggttcgaaggccatgtcgccacatttgtgagggcctgcgtgaagtgtgccagcctgcgttcgacgcgatcgatatggcttggccgtatttcctggattgtcatagatactttacacgagaggacgaagggtgctacgaccctctagagaaactcaggggcggtctggaggcggatgaggctcttcctagtggactgccgccaacttttatacgcttttcacaccatagttacgcgcagatggtccgcgtgttgaggcggaccgcctcgcggtgcgcccacgtggccaggacctactctatcggccgaagttttgatggcagagagctgctcgtcattgaattctcatcacgccctgggcagcatgagctgatggaaccagaagttaaattgataggaaacatccacggcaacgaggtggccggacgtgagatgctgatctatctagcccaatatttgtgctcggagtatctgcttggtaatccccgcatccagcgcttactaaacaccacacgaattcatcttctgccgtctatgaaccccgatggatacgaggtcgcggcagccgagggcgctggatataacggctggacctcgggcagacagaacgcccagaacctggatttaaataggaactttcctgacctgacatcagaatactaccgcctagctgagactcgaggagccagatcagaccacatccctatcccacagcattattggtgggggaaggtagcacccgagactaaggctatcatgaagtggatgcagactattcccttcgtcctttcagcctctctgcacggcggagacctcgtggtgtcctaccctttcgatttctctaagcacccccaagaggagaagatgtttagcccaactcctgatgaaaagatgttcaaattgctgtctagagcttatgccgatgtgcatcccatgatgatggatcgcagtgaaaatcgctgtggaggcaatttcctaaagcgggggtcaataattaatggtgctgactggtactccttcacaggcggcatgtctgatttcaattacctgcacacaaattgtttcgagatcaccgttgagctaggatgcgtaaagttccccccagaagaagccctgtacattctgtggcaacacaacaaagaatccctgctgaacttcgtggaaactgtgcatagaggaattaaaggtgtcgtgactgataaattcgggaaaccagtaaagaacgcccggatcagcgtgaagggcatcagacacgatatcacaacggccccagatggggattactggagactgctgccgcccggcattcatatcgttattgcacaggcacccggctatgccaaggtaatcaaaaaagttatcattcccgcacgaatgaagcgtgccggtagggttgattttattctgcagcctctagggatgggccccaagaatttcattcacgggctgaggcgaacagggcctcacgaccccctgggtggggccagtagtttaggcgaggccacagaacccgatcctctgagggcccgtagacaaccaagcgctgatgggtcgaaaccatggtggtggtcctactttacctctcttagtacccatcggccaagatggctactgaagtactag

SEQ ID NO: 5433 - DNA, 1305 bp, Artificial Sequence
  Description of Artificial Sequence: Synthetic coding sequence
atggcctctcttggactacttctgctgctgctgctgacagccctgccccccctctggagctcctcattacctgggcttgatactgctgaatccaaggccacgatcgctgacctcatacttagcgcactagagcgcgccactgtatttttggaacaaagactgccagaaattaacctggacggcatggtgggagtgagagttcttgaggagcagctcaagtcagttcgcgaaaaatgggcccaggaaccactgttgcagcccctcagtttgcgggtcgggatgctaggggaaaaactggaagccgccatccagagaagtctgcactatctgaagctatccgatcccaagtaccttcgcgagtttcagctcaccctacagccggggttctggaagctgccgcatgcttggatccacaccgacgccagcctggtctatcccacctttgggcctcaagacagcttttccgaggagaggagtgatgtatgcctagtccagctgctcgggaccggcactgacagctcggaaccctgtggcttaagcgacctctgtcgcagtctcatgaccaaacccggttgtagcggatattgcctgagccatcaactgctgttctttctatgggcccgcatgcgggggtgtacacaaggccccttacagcagtcccaagattatattaatctgttctgtgccaacatgatggatttgaacagacgggccgaggccataggctacgcctatcccacacgggacattttcatggagaataatgtgaccgggcatcccgtgttttacctacccttgtgcgattcgtttcttccccccaaagctgcccctgtgaccgagttgtacaccgatgggcccgtaatgttttgtgggatgggcggattctctgacttctacaaacttcgatggctcgaagcaatactatcctggcagaaacagcaggaaggatgcttcggcgaacccgacgcagaagacgaggaacttagcaaggcaattcagtaccagcagcacttctctcggcgggtaaagagaagagagaagcagttccccgattctcggagtgtggcccaggcaggagtgcagtggcggaacctcggaagtctccagccactgcctcctggatttaaacagtttagttgcttgatcctgccctcctcgtgggactataggagtgtcccgccctatttagccaatttttacatcttcttggtggagacaggcttccatcatgttgctcatgctggactagaactcctgatctcaagagatccacctaccagcggctcccaatccgtgggtctgtag

SEQ ID NO: 5434 - DNA, 555 bp, Artificial Sequence
  Description of Artificial Sequence: Synthetic coding sequence
atgatgtcatttctgcttggcgctattctgactctgttatgggcgcctacagcccaggccgaagttctcctgcaacccgatttcaacgccgagaagtttagcgggttatggtatgtggtgtccatggcatctgactgccgggtgtttctcgggaaaaaggaccatttaagcatgagcactcgagccattcgtccgacagaggaaggcggcctgcacgtacatatggaatttccgggcgctgatggatgtaaccaggtggatgccgagtatctgaaagtgggaagcgagggccacttccgcgtcccggcactggggtacctggatgtccggatcgtagataccgactactcctctttcgctgtcttatatatatataaagagttggagggcgcccttagcactatggtgcagctgtactcacgcacgcaggacgtatcacctcaggctcttaagagcttccaggacttctaccctacactgggcttgccaaaggatatgatggtgatgctgccccagagcgacgcttgtaaccccgaatccaaggaggctccttag

SEQ ID NO: 5435 - DNA, 219 bp, Artificial Sequence
  Description of Artificial Sequence: Synthetic coding sequence
atgcagcgcctcgtcctgctgctcgcaatcagcctgctgctgtatcaagatctgcctgttagatctgagttcgaactagacagaatatgtggctatgggacagcacggtgccgaaaaaaatgccggtcacaagagtaccggattggtaggtgtccaaatacctatgcttgctgcctcaggaaatgggacgagtctcttttgaatcgaacaaaaccctag

SEQ ID NO: 5436 - DNA, 2247 bp, Artificial Sequence
  Description of Artificial Sequence: Synthetic coding sequence
atgggacgagccggcgccgccgccgtgataccagggctggcgctgctatgggccgtgggccttgggtctgctgccccacctcccagactgcgcctctctttccaagaattgcaagcctggcacggactacagaccttctccctggaacgcacctgctgctatcaagctcttttagtggatgaggaacgaggtcggctgttcgttggggccgagaatcacgttgcttccttgaacctggacaacatctcaaaaagggccaaaaagttggcatggcccgctccggtggagtggagggaggaatgcaactgggcaggcaaggacattgggacggaatgcatgaatttcgtgaagctgctccacgcgtataacagaacccatctgttggcttgcggtactggtgccttccacccaacctgcgcctttgtcgaagtgggtcatcgcgctgaggagcctgtattgcgtctggaccccggaagaatcgaggacggaaaaggaaagagtccgtatgacccacgccaccgggcagcctccgtgctggtaggggaagaactctattctggcgttgcagctgacctcatgggacgagattttactatcttccgatccctaggccagcggcctagtctgcgaacggaacctcacgactcccgctggttaaatgagcctaaattcgtgaaggttttttggatacctgaatcagagaatccagacgatgataagatttacttcttttttagggagaccgccgttgaagcggcccctgctctcggcaggcttagcgtgtctcgggtggggcaaatttgcagaaacgacgtgggcggacagagatcccttgttaacaagtggaccacatttctgaaagccagattggtctgttccgtgcctggagttgaaggtgacacacattttgaccaactccaagatgttttcctcctttcctccagggaccaccgaactcccctgctgtatgccgtgttttcaacctccagtagtatttttcaaggcagcgccgtgtgcgtctactccatgaatgacgttcgacgtgcctttttggggccattcgcccacaaggagggtccaatgcaccagtgggtgtcttaccaggggcgtgtaccctatccccgacccgggatgtgcccgtctaaaactttcgggacattctctagcacaaaggattttcccgacgacgtgatccagtttgcccggaaccaccccttgatgtacaacagtgtgctgcccactggcgggagacccctcttcctgcaggtgggagctaactacaccttcacccagatcgccgctgaccgtgtcgctgccgcggacgggcactatgatgtgctctttatcgggacggacgtgggtacagttctgaaggtaatttccgtcccaaaaggcagccgccctagcgccgaaggcctgctcttagaggagcttcacgtgtttgaggactctgctgcggttactagtatgcaaatctcatctaagcgtcatcagctttacgtggcctcccggtccgcagtggcacagatcgccctccatcgttgtgccgcgcacggccgagtgtgtaccgagtgttgcctggcacgggacccgtactgcgcctgggatggtgttgcatgcactaggttccaaccttctgcaaaacgaagatttcgacggcaggatgtccgcaatggtgatccgagtacactgtgctccggcgacagcagtagacctgctttattagaacacaaagtttttggagtagaaggttcatcggcctttctggaatgtgagcctcgctctctgcaggcccgcgtggagtggacatttcagagagccggcgtgaccgctcacactcaggtcctggcagaggagaggactgagcgaaccgctcgcggcttacttcttcgacgactgcgcaggcgtgattctggtgtctacctttgcgctgcggtggaacagggctttacacagccactgagacgactatccttacacgtcttatcagctacacaggccgaacggctagcccgcgccgaggaagcagccccagccgcccctccagggccaaagctctggtatagagacttcctccagctggtggaacctggtggcggcggctccgccaactccctaaggatgtgccgcccccagcccgcactgcaatccttgccacttgagagtcgaaggaaaggtagaaatcggcgcacccacgctcccgagcccagggccgagagaggaccgcgctcggccactcactggtag

SEQ ID NO: 5437 - DNA, 369 bp, Artificial Sequence
  Description of Artificial Sequence: Synthetic coding sequence
atggtgctgctgtgcttgtttcttgcctctctggctgcgaccccgcgcgcgggtgtgacgggagcctggccaacgagcggtctgtccattctggcacagctgcaaccatcctgcgaactgcgatggactcagctgtctcggtcttcctggcgggatcttgtgatgactacatccttgtggagccttgcctactttcagcacttctcacaggagacaacgacacaggaacaactggacgagatggaggagattccccgggagagccaatgtggaagacaagactttcatgccctatcgtgccctacagccagccctcgagatcgcgtgctgctgtgctgcccaggttggcgggccatggtgccgtcctag

SEQ ID NO: 5438 - DNA, 570 bp, Artificial Sequence
  Description of Artificial Sequence: Synthetic coding sequence
atgctgctgggacagctgtctaccctcctttgcttactgagtggcgccctccccactggctccggacgacccgagccgcagagtcctcggccccaaagctgggccgcagctaaccagacctgggcgttgggccctggagctttgcctccccttgtgcctgctagtgccctgggatcttggaaagcgtttctcggtctccaaaaagccagacagctcgggatggggcggctgcagcgggggcaggatgaggtggccgctgttacattaccactgaatccgcaggaggtcattcaggggatgtgcaaggctgtgccattcgttcaggttttctcccgtccgggttgctctgcaatccggctaagaaaccatctctgtttcgggcattgctcaagtctttacatacccgggtccgatcctacacccctcgtgttatgcaattcctgcatgcctgccaggaagcggtgggcacctgtggtgttgtggtgcttgactgggtcctccgcttcccgacgccgtgtcaagatctccactatgctcatcgaaggctgccactgctcaccaaaggcctag

SEQ ID NO: 5439 - DNA, 2505 bp, Artificial Sequence
  Description of Artificial Sequence: Synthetic coding sequence
atgaagcacacattagccctcctggcccctcttttgggactgggcctgggcctggccttatcacagctggcagctggcgccaccgactgtaagttcctgggaccagctgagcaccttacttttacaccagcggcacgtgctcgatggttggccccaagagtacgcgctcccgggctgttagattcactttacggcaccgtccgtagattcctgagtgtggtgcaactgaatcccttcccttccgaactcgtcaaggcactgctgaacgagcttgctagcgtcaaagtgaatgaggtggtccgatacgaggctggctatgttgtgtgcgctgtgatcgctggcctgtacctgctgttagtgcctacggctggcctgtgcttctgctgttgtagatgccacaggcgctgtggagggagggtcaagacagagcacaaggccctggcgtgcgagcgggcagccttaatggtatttctactgctgacaaccctgttgctgctgatcggcgtggtatgcgcttttgtgacaaatcagaggacccacgaacaaatgggaccttccattgaagccatgcctgagaccctcctgtcactgtgggggttagtcagtgacgtgccacaggagctccaagccgtggcccagcaattctctttgccccaggaacaggtaagtgaggaacttgacggagtcggcgtgtcaattggaagtgctattcacacacagttgcgctcatctgtttaccctctgttggccgccgtggggagcctggggcaggtgctgcaagttagcgtacaccatctgcagactttaaatgcaaccgtagtcgagttgcaggcggggcagcaggatttggaaccagccatacgagagcatcgggatcggctgcttgagctactccaggaagcccgttgtcagggggactgtgctggggccctaagttgggctcgaactttggagctaggggccgacttctcacaggtcccctccgtcgatcatgtgctgcaccagctcaagggggtgccagaggctaacttcagcagcatggtgcaagaggagaactccacattcaacgctctacccgctctagccgccatgcagacaagcagcgtcgtgcaggagttgaaaaaagccgtggcccaacaacctgaaggagtgcgtactctggcagagggattccctggcctggaagccgcctcgcggtgggcacaggctctgcaagaagtggaagaatcttcacgtccctacttacaagaggtgcagcggtacgaaacatatcgctggatcgtaggctgtgtcctttgtagtgttgtcctgttcgtagtcctgtgcaacttgttaggcctgaacctcggtatctggggcctctccgcacgcgatgatcctagccatccagaagcaaagggagaggcaggcgcgaggtttcttatggctggcgtgggcctgtcttttctgttcgccgcacccctcatcttgctagttttcgctacgttccttgttggtggaaacgttcagacactggtgtgtcaaagttgggaaaacggggagttatttgaattcgcggacacacccggcaatctgccacctagcatgaacctctcccagcttcttggccttcggaaaaacatcagcatccaccaggcgtaccagcagtgcaaagagggggcggccctgtggactgtgctccagctcaatgattcatatgatcttgaggaacacctggatatcaatcaatacacaaacaagcttcgtcaggagttacagagcctgaaggttgacactcagagtctcgacctcctgtcctctgccgcccgccgtgacctcgaggcccttcaatcgagtgggctgcagagaatccattacccagatttcctcgtccagattcagcgacccgtcgtcaagacgtctatggagcagctggctcaggagctacaaggactcgctcaggcccaggataactccgtgctcggacaacggctgcaagaagaggcgcagggcctccggaacctgcaccaggaaaaagttgtcccgcagcagagcctggtagcaaaacttaatctatctgtccgcgcactagaatcctccgctccaaatttgcagctggaaacttctgacgtgctggccaatgtcacctacctgaaaggggaactccctgcatgggctgcacgcattctaagaaacgtttccgaatgctttctcgctcgggagatgggctacttcagtcagtacgtggcgtgggtgcgggaagaggtcacccagagaattgctacctgtcagcctctcagcggcgccttagacaacagcagagttatcctgtgcgacatgatggcggatccatggaatgccttttggttctgcctggcttggtgcaccttttttttaatccctagcataatcttcgctgtcaagacctcaaagtattttcggcccattcgcaaaaggctgtcaagtacttccagtgaggagacccagctgtttcacattccccgagttactagccttaagttgtag

SEQ ID NO: 5440 - DNA, 2505 bp, Artificial Sequence
  Description of Artificial Sequence: Synthetic coding sequence
atgaaacataccttagcgctgctcgccccgttgctgggactcgggcttggcttggccctctcacagctcgccgccggagcaacagactgtaaattcctcgggcccgccgaacatctcacctttactccggctgcccgagcacgctggctcgctccacgggttagagcccctggcttactagattcactgtatggcacagtccgcagatttttgagcgtagtacagctgaatcccttcccttcagagctcgtaaaagccctcctaaatgagctggcctccgtgaaagtgaacgaagtggttcgctatgaggcaggatatgtagtctgcgctgtgatcgctgggctctacctgttactggtacccaccgcaggattatgcttctgttgttgccggtgtcacaggaggtgtggtggccgggtcaaaacagagcataaggctctggcttgcgagcgagccgcgctgatggtgtttctcctgttgactacactcttattactgatcggcgtggtgtgcgcattcgtcactaatcagaggactcacgaacagatggggccaagtattgaagccatgccagagactctattgtccctgtgggggttagtttccgatgtgccgcaagaactgcaagctgtggcacagcaattttctttgcctcaggagcaggtttcagaggagctggatggcgtgggtgtatctattgggtccgccatacacactcagctcagatctagtgtttacccactgcttgcagccgttggcagtctgggtcaggtgctgcaggtgagcgtgcatcacctgcaaacattaaacgccaccgtagtggagctgcaggctggtcagcaagatctggagccagcaatccgggaacatcgggatcggctgctcgagctcctccaagaagcacgctgccagggagactgcgccggagctctctcatgggccaggacccttgaactcggagcggacttttcacaagtaccctcggtcgaccatgtgcttcatcagttgaagggagtgccagaggctaactttagtagcatggttcaagaggagaatagcacattcaacgctttaccagccttagcggccatgcaaacgagcagcgtggtccaggagctgaaaaaggccgttgcacagcaaccggagggcgttcgcaccctcgctgagggattccctgggcttgaagctgcaagccgatgggcacaggctctccaggaggtggaggaaagctcccggccctaccttcaggaagtgcagcgctacgaaacgtatagatggatcgtcggatgtgtgctgtgcagcgtggtgctgttcgtcgtgctgtgcaacctgctgggtctcaatctgggcatttggggtctaagtgcccgcgacgatcctagccaccccgaagctaagggagaggcaggggccaggttcctgatggccggagtgggtctcagcttcctgtttgcagctccgctgatcctgctggtgtttgctacgtttctagtcgggggaaatgtccagaccctggtttgtcagtcgtgggagaatggggagctgtttgaattcgcagatacaccagggaacttacctccctccatgaatctgtcacagcttctcggacttcggaagaacatatctatccaccaagcttaccaacagtgtaaggaaggcgccgctctgtggaccgtgttgcaacttaatgattcctatgacctggaggagcacctggacatcaatcagtatactaataaactccgccaggagttacagagtttaaaggtggatacacagtccctggaccttctgtcaagcgccgccagacgggatctggaagctttgcagagctccggtctgcagcgaatacactaccccgatttcctggtccaaatccagcgacctgtagtgaaaacctccatggaacagttggcccaggaacttcagggcttggctcaggcccaggataactcggttctggggcaacgattgcaggaagaggcacagggtctccggaatttgcatcaggaaaaagtagtaccccagcagtcgttagtcgctaagcttaacttgagtgttcgtgccctcgaaagctctgcaccaaaccttcagctggagacatctgacgttttagctaacgtcacctatttgaagggcgaactgcccgcctgggccgcgcgtatccttcggaacgtcagcgagtgcttcctggcaagggaaatgggctatttcagccagtatgttgcatgggtccgtgaagaggtgacacagaggattgcaacctgccagccccttagcggtgcgctcgacaattcacgtgtgatactttgcgacatgatggcagacccatggaacgcgttttggttctgcctggcttggtgcacgtttttcctcatcccctctattatctttgctgtcaagacgtctaagtactttcggccaatccgaaagagactgtcctccacctcaagcgaggaaacacagttgttccacattcctagagtgactagcctcaaactttag

SEQ ID NO: 5441 - DNA, 216 bp, Artificial Sequence
  Description of Artificial Sequence: Synthetic coding sequence
atgacccaattgctgctgttcctggtggctctgctggtcctgggccacgttcccagcggcaggagtgaattcaaaagatgttggaaagggcaaggggcgtgtcaaacatattgtacacgccaggagacctatatgcacctctgccctgacgcgagtctctgctgtctgtcctacgctttgaaaccccctcccgtccccaagcatgagtacgagtag

SEQ ID NO: 5442 - DNA, 1377 bp, Artificial Sequence
  Description of Artificial Sequence: Synthetic coding sequence
atggaggccacaggaacagatgaagtagacaaactaaaaacaaagtttattagcgcctggaataacatgaagtattcatgggtgctgaaaaccaagacctacttttctcgaaacagccctgtccttcttttgggtaagtgctatcacttcaagtatgaggatgaagacaaaactcttccagcagagagtggctgtacaattgaagaccatgtgattgctggcaatgtggaggagtttagaaaagattttataagcaggatttggctgacatacagagaagagtttccccaaatagagggatccgctctcaccactgactgcggttgggggtgcaccctgcggaccggtcagatgctgctagcccagggacttatactgcacttcctcggtcgggcctggacctggccagacgctttgaatattgaaaattccgattcagaaagctggacaagtcacaccgttaagaagttcaccgccagcttcgaggcatcactgtccggtgagcgcgaattcaagacaccaacaatctccctgaaggagacaattggtaagtactccgatgaccacgaaatgagaaatgaggtgtaccacaggaaaatcatctcatggttcggtgactctcctctggccctgtttggactgcaccagcttattgaatacggaaaaaaaagtggcaagaaggccggagattggtatgggccagcagtcgtggctcatattctgaggaaggccgtcgaagaggcgcgacaccctgacctgcaggggattactatatatgtagctcaggactgtacagtctacaacagcgacgtgatcgataagcagtccgctagcatgacatctgacaatgcagatgacaaggcagttattatcctcgtgccagtccgcctgggcggcgagcgaaccaacactgattacctcgagtttgtgaaaggaatcctttctttggaatactgcgtcggaatcatcgggggcaaacctaagcaaagctattacttcgctgggtttcaggatgattccctgatttatatggacccgcactactgccaatcattcgtggacgtgtcaataaaagatttcccgctggaaaccttccactgccctagtccaaaaaagatgtcgttcaggaagatggacccgagttgcaccatcggattctattgtcggaatgttcaggattttaagcgcgcgtcggaagagattaccaagatgctgaaattttccagtaaggagaagtaccctctctttacctttgtgaacggtcattcacgagattacgattttacctctaccactactaatgaagaggatctgttctccgaggatgaaaagaaacaactaaagaggttcagtacagaagaatttgttttactgtag

SEQ ID NO: 5443 - DNA, 342 bp, Artificial Sequence
  Description of Artificial Sequence: Synthetic coding sequence
atgagacagaggctgctgccatcggtgacctccctgcttcttgtcgcattactcttcccaggatcctcccaggccagacacgtgaatcactcggcaacagaagcactcggtgaattaagagagagagcccctggacagggcactaacggcttccagctcctcagacacgcagtaaagcgtgacttgctgccgccacggaccccaccttatcaggaaccggcctccgaccttaaggtggtcgactgcaggagatcagaggggttttgccaggaatattgcaactatatggagacgcaggtcggctattgtagcaaaaaaaaggatgcctgttgtctgcactag

SEQ ID NO: 5444 - DNA, 258 bp, Artificial Sequence
  Description of Artificial Sequence: Synthetic coding sequence
atgaaaaaagttctgctgttaattacagcaattctggccgtcgccgtcgggttcccagtaagtcaggaccaggaacgtgaaaagcgttccatttcagatagcgacgaactcgcaagtggcttttttgttttcccctacccatacccattcaggccgctccctcctataccatttcctcggtttccctggtttcgccgcaattttcccattccaatcccggagagcgcccctactactcccctaccatccgagaagtag

SEQ ID NO: 5445 - DNA, 264 bp, Artificial Sequence
  Description of Artificial Sequence: Synthetic coding sequence
atggcggtgtcagtgttacggctgaccgtggtattaggcctcttagtgctctttctgacgtgctatgccgacgacaagccagataaacccgacgacaagcctgacgacagtggcaaagaccccaaaccagattttcctaagttcctgtctttattgggtacagagattattgagaatgctgtggaattcattctgaggagtatgagccggagtacaggattcatggagttcgatgataatgagggcaaacactcctccaaatag

SEQ ID NO: 5446 - DNA, 945 bp, Artificial Sequence
  Description of Artificial Sequence: Synthetic coding sequence
atgtcttccgaggctgaaacccaacagccgcccgccgctcccccagctgctcccgcgctgtctgccgcagacactaagccagggactactggtgcccagggcgctgtcgctcgggcccatatcggcggagcaggcggagataagaaagtgattgccactaaagttcttggaacagtgaaatggttcaacgtgcggaatgggtacgggttcattaataggaatgataccaaggaagacgtgtttgttcaccagacagctataaaaaaaaacaaccctcgcaagtatctgaggtccgtaggcgacggcgagacagttgagttcgacgtggtggagggagaaaagggagctgaagccgcgaatgtgacaggccccggaggcgtccccgtgcaggggtcaaagtacgcggcagaccggaaccactacaggaggtacccgcgtcgccgcggtcccccccgcaattatcagcaaaattatcagaattctgagtctggcgagaaaaacgagggtagtgagtctgctcccgaacgacccaataatgcaggcccccaagcaaaagtacccaccttactgcatgctgagtacggtcgacggccccagtactcaaatcctcctgttcagggtgaagtgatggagggggcggataaccagggggccggcgaacaagggcgtcctgtgaggcagtgtatcggggatattgaccacgacagtgccggagcattgttagccagacagccccgagaggacggcaacgaggaagacaaagagaaccagggagacgagactcagggacagcagccacctcaaagaaggtaccgtcggaactttaattacaggcgcagacgcccagagaacccaaaaccccaagatggtaaggaaaccaaggcagcggacccgccagccgagaacagtagcgccccggaagcagagcagggcggtgctgaatag

SEQ ID NO: 5447 - DNA, 636 bp, Artificial Sequence
  Description of Artificial Sequence: Synthetic coding sequence
atggtgtttctcaagttcttctgcatgagctttttctgtcatttatgccagggctacttcgacggcccactctatcccgaaatgtccaatggtaccttgcaccactattttgtacctgacggggactacgaagaaaacgatgaccccgaaaaatgccagctcttgtttcgtgtgagtgaccaccggaggtgcagtcaaggagaaggatcccaggtcgggagcctcctgtcccttaccttgcgagaagagtttaccgtcctgggtcggcaagttgaagacgcagggcgcgtgctggagggcatttccaaaagcatatcttacgacttggacggagaagaatcctatggcaagtatcttcggcgagaatctcaccagatcggagatgcctacagcaattcggataagtcactgacagagctcgagtctaaattcaaacaggggcaggagcaggattccagacaggaaagccgcctgaatgaggactttctcgggatgctcgtgcatacaaggtcacttctaaaagaaaccttagacatatccgtcggcctgcgagataagtacgagctcctcgctcttaccattcgcagtcatggaacaaggcttggtcgactcaaaaacgactatcttaaggtgtag

SEQ ID NO: 5448 - DNA, 1566 bp, Artificial Sequence
  Description of Artificial Sequence: Synthetic coding sequence
atgctgtgcgccctgcttttgctgccaagcctgctgggggctacaagagccagtcccactagtggcccacaggagtgcgccaaaggtagcaccgtctggtgtcaagacttacagaccgcagctagatgcggggcagtcggctactgccagggagcagtgtggaacaagccaactgcaaaatctttaccctgtgacgtctgccaggacatagctgctgccgcgggaaatggcctaaacccggacgcaactgaatccgacattctggcgcttgtgatgaagacatgtgaatggttgccgagccaggagtccagcgccggctgcaaatggatggttgatgctcactcatctgccatcttatcaatgctgagaggagccccagattctgcacccgcgcaggtctgcactgccctgagtctctgcgagccacttcagcggcacttagccacattgagacctttatctaaagaggataccttcgaggcagtggctcctttcatggccaatggaccacttacatttcacccaagacaggccccggaaggagcattgtgccaagattgcgtgcgccaagtgtcacgcttacaggaggctgttcgcagtaacctgacattggcagatctgaacatccaggaacagtgcgaaagcttaggccctgggttagcagtgctttgcaaaaattatctgttccaatttttcgtgcctgccgaccaagcgctgcggcttctgcctccccaggagttgtgcaggaagggcgggttctgtgaggagctgggagcacccgcgcgcttgacccaagtcgtggccatggacggagtgccttctcttgagctcggactcccccgcaaacagagcgaaatgcaaatgaaagctggtgtcacgtgtgaagtttgcatgaacgttgtgcaaaagctggatcattggctgatgtcgaactcaagcgagctcatgatcacacatgcgctggagcgggtctgctcagtgatgccagcatctatcacaaaagagtgcattatcctggtggacacgtacagtccctcactcgtgcagctggtggctaaaatcacccccgaaaaggtatgcaagtttattcggctgtgtggaaatcggcgcagggctcgcgctgtgcatgacgcctacgccatagttccatcccctgaatgggatgcagagaatcagggaagcttctgcaacgggtgtaaacggctcctgaccgtctcaagccacaacttggagagcaaatctacaaaacgggatattctggtggcgtttaagggtggctgctcaattctccccctgccatatatgatacaatgtaagcattttgtgactcagtacgagcccgtcttgattgaatccctaaaagacatgatggacccggtggctgtctgtaaaaaggtcggcgcttgtcacgggccccgcacaccacttctgggaacggaccaatgtgccctcggcccatctttttggtgtaggtcgcaagaagctgcgaagctatgcaacgccgtccagcattgtcaaaagcatgtatggaaggagatgcatctgcacgccggtgagcatgcctag

SEQ ID NO: 5449 - DNA, 2127 bp, Artificial Sequence
  Description of Artificial Sequence: Synthetic coding sequence
atggccgcggccgctgtggcagccgccgcagcagctgcagccgctgcatccctgcaggtccttgaaatggaatctatggaaaccgcagccgccggctctgccggcctggccgcagaagtcaggggatctggcactgtggatttcggacctggacctgggatcagcgcgatggaggcctctggcggggacccaggcccggaagcagaagactttgagtgctctagtcactgctcggagctgtcatggaggcagaatgagcagaggaggcaaggactgttttgcgacattaccttgtgcttcgggggcgccggaggccgcgagtttcgagctcaccggtctgtccttgccgccgcaaccgagtacttcacacctctcttgtctgggcagttcagcgaaagccggagcggccgagtagagatgagaaagtggagcagcgaacctgggccagagccagataccgtagaagccgtgatcgaatatatgtacaccggaaggatacgcgtgagcacgggttccgtacacgaggtgttggagttagctgataggtttctgctgatcagactaaaggagttttgcggcgaatttctcaagaaaaaactccatctttcaaattgtgtggcaatccactctttggctcatatgtacacactcagtcaattggcccttaaagcagccgacatgatccgccgtaacttccacaaagtgatacaggacgaagaattctatacgctccccttccatttaattcgtgactggcttagcgatctggaaattaccgtggattctgaggaggtgttgttcgagactgtgttgaaatgggtgcagcggaatgcagaagagcgggagagatactttgaggaactattcaagctactgagactgtcccagatgaagcctacctatcttactaggcacgtgaaaccagaacgtcttgtggcgaataatgaggtgtgcgtgaaactggttgccgacgcagtagagcgccacgctctgcgggccgaaaatattcagagtggaacctgccagcaccctacaagccatgtctcactgctgccacggtacggccagaacatggacgtcatcatggtgatcggcggggttagcgaagggggggattatctcagtgaatgcgtgggatacttcgtcgacgaggataggtgggtgaatctgcctcacatccataaccatctcgacggacatgcagtcgccgtcacagaaagctatgtttacgtggccggctccatggagccgggctttgcaaagactgtggaaaggtacaatcccaacctgaatacatgggaacacgtatgtagtctgatgacgagaaagcatagtttcgggcttaccgaggtgaaaggaaagctgtatagcattggcggccatgggaatttcagcccagggtttaaggacgtgacagtctataatccagagctcgacaagtggcacaatctggagtccgcaccaaagatcttgcgggatgtgaaagcactcgccattgaggataggtttgtgtatatcgcagcgagaactcctgtggatcgagataccgaggacggcttgaaggcagttattacatgctacgacaccgagacacgacagtggcaggacgtggagagcctgccgctgatagacaattactgctttttccagatgagtgtggtcaattccaacttctaccagactgcctcctgctgtccgaaatcctattgcctcgagaatgaggaggcagtacggaagatagcttcccaggtgtcagacgagattctggagagtcttccacctgaagtgttgagtatcgagggcgcagctatttgctactataaagacgatgtttttatcattggtgggtggaagaatagtgacgacattgataagcagtaccggaaagaagcctacaggtactgcgccgagcgaaagcgttggatgcttcttcctcccatgcctcagccaaggtgccgagccaccgcctgccacgttcggatcccttacagatacctacacggcacgcaacgatatcccatgccacagaatctaatgtggcagaaagatcggattcgtcagatgcaggagatccaccgacacgccctcaacatgcgccgtgttccaagttctcagattgagtgttag

SEQ ID NO: 5450 - DNA, 1578 bp, Artificial Sequence
  Description of Artificial Sequence: Synthetic coding sequence
atgtctgggaattgggttcacccaggacaaatcctgatttgggcaatctgggtcctggccgcgccgactaagggtcccagtgcagaaggccctcagaggaatacccgcctgggctggattcagggtaagcaggtcaccgttctgggaagcccagttccagtcaacgttttcctgggcgtgcctttcgccgcacctcccctcggcagtttgaggtttaccaatccccaacctgccagtccttgggataacctccgtgaggcgacttcgtaccccaacctttgtttgcaaaatagcgagtggcttctcctcgatcagcacatgcttaaagttcattacccaaagttcggggtctctgaagactgcctatacctgaatatttatgctcccgctcatgcagataccggatctaagctccccgtcctagtttggttcccagggggagccttcaagacagggtctgcctccatttttgatgggtccgcactggccgcgtacgaggacgtgttagtggttgttgttcagtatcgcctggggatttttggattctttacaacatgggaccaacacgcaccggggaactgggccttcaaggatcaagtggccgcactcagctgggtgcaaaaaaacatcgaattcttcggcggagacccatctagtgtcactattttcggcgagtccgctggcgctatctctgtgagttctcttatactgagtccgatggccaaaggactgtttcacaaggctataatggaaagtggtgtggcgattattccctacctggaagcccacgactacgagaaaagcgaggatctgcaggtggtggctcacttctgcggtaataacgctagcgactcagaggcactcctgcgctgtctgcggacaaaaccttcaaaggaactgctgacactttctcagaagactaaatctttcacaagagtggttgatggtgcattcttccccaatgagcctcttgacctgctgtctcagaaggcttttaaagcaataccgtccatcatcggagtgaataaccatgagtgcggcttcctgctgcccatgaaggaggcccccgagattctgtctggatccaacaaaagcctcgcgcttcatctaattcagaatatcctgcacataccgcctcagtacctgcacctcgtcgcaaacgaatacttccacgataaacatagcctcactgagatacgagatagcctcctcgacctgttaggagatgtattcttcgtcgttcctgctctgattacagcacggtatcaccgtgagggggccaccgaggaggaaaagctgctctcccgcaagatgatgaagtactgggctaccttcgccagaacaggaaacccaaatggaaacgacctgtccttatggcccgcttacaatctgaccgagcaatacttacagctggatctgaatatgtcgctaggccaaaggttgaaggagccaagggtggatttttggacctccaccatccccttaattctctctgcctccgatatgctgcatagtcctctctccagcctaacatttctgtcattacttcagccctttttcttcttttgtgctccctag

SEQ ID NO: 5451 - DNA, 900 bp, Artificial Sequence
  Description of Artificial Sequence: Synthetic coding sequence
atggtgcggtgtctgggacctgctcttctcctcctgctgctgctgggcagcgcctcttcggtagggggaaacaggtgtgtcgacgcagccgaagcgtgcacggccgacgcacgttgtcagaggctgcgatcggagtacgttgctcaatgcctggggagggccgcacaaggtggatgtccgagggctaggtgtagaagagctttacgacgcttcttcgcacgcggacctccggctctgacgcacgcactgctgttttgtccgtgcgccggtccagcctgtgccgaaaggcgccgtcagacgtttgtaccaagctgcgctttttctggacccggccccgcccctccctcctgtttggaaccattgaacttctgcgagagatcccgcgtctgccgatgcgctcgtgccgcagctggaccctggcgtggctggggacgtggcctctcccccgcacacaggcctcccgccgcccaggctagtccgcccgggctcagcggcttggtgcatccttccgcccagagaccacggcgcctgcctgccggtcccggtagacccctacctgcaagactgagagggccacgaggcgttccagcggggacggccgtcacacccaactatgtcgacaacgtcagcgcacgcgtggctccttggtgtgattgtggagcctccggcaacaggcgtgaagactgcgaagcctttcgcgggttgtttaccagaaacaggtgtctcgatggggccattcaagcgtttgcttctggctggcctcccgtgctgctggatcaacttaatccccagggggaccccgagcacagtctccttcaggtttcctctaccgggcgagcgttggagcggcggtcactgttgtctatactccccgtactggctcttcccgccctgctgtag

SEQ ID NO: 5452 - DNA, 270 bp, Artificial Sequence
  Description of Artificial Sequence: Synthetic coding sequence
atgcaggcctgtatggtccctgggctcgccctgtgtctcctcctcggaccgctcgcaggtgccaaacccgtacaggaggagggggatccatacgccgagctgccagccatgccttattggcctttctccacaagcgacttttggaattacgtgcagcacttccaagctctgggagcttacccccagatcgaggacatggcacgtactttcttcgcccactttcctctcgggagcacgcttggttttcacgtgccgtaccaagaagactag

SEQ ID NO: 5453 - DNA, 663 bp, Artificial Sequence
  Description of Artificial Sequence: Synthetic coding sequence
atggcctcggagcggttgccaaataggcccgcctgtctcctggtggccagcggagctgctgagggagtgtcagcccagagttttttgcattgtttcaccatggcctcaacagcctttaatcttcaagtggcaactccgggcggcaaggctatggaatttgtcgatgtcactgaatccaacgcaaggtgggtgcaggacttccgactgaaagcatatgcttctcctgcgaaattagaatcaattgatggggcgcgctatcatgcactgctgattccatcatgccctggggctctcactgatcttgcatcttcgggcagcctggcgcggatcctgcagcactttcacagcgagtccaagcctatatgtgctgtcggccatggagtagcagcgttatgttgtgctacaaacgaggataggtcatgggtgttcgactcctacagccttacaggcccaagtgtgtgtgaactagtgagagctccaggattcgctcgccttccgttggtggtggaggattttgttaaagacagtggagcgtgtttttccgcgagcgaacccgacgccgtccatgtggtactagatcgacacctcgtgacaggtcagaacgcttcatccacagtgcccgctgtgcagaaccttctttttttgtgtggttctagaaaatag

SEQ ID NO: 5454 - DNA, 1158 bp, Artificial Sequence
  Description of Artificial Sequence: Synthetic coding sequence
atgtgggggtttcgactactgcgctccccacccctgctcctgcttctgccccagttaggaattggcaatgcatcgtcatgtagccaggcgcggaccatgaatccaggagggtctggcggggctagatgctcgctgtccgcagaagtccgccggcgccagtgcttacagctgtctacagtacctggtgcggaccctcagagatcaaatgagctgttactgctggcagccgctggggaaggcctggagcggcaggatttgccgggcgaccctgccaaggaggagccacagccccctccgcagcaccacgtgctctactttccaggggacgtccaaaattatcacgaaattatgactcgccacccggagaattatcagtgggaaaattggtcgctcgaaaatgtggccaccatcctggcccaccggttccccaactcctacatatgggtgattaagtgcagcaggatgcacttgcacaaattcagctgctatgataatttcgtgaagtcgaatatgttcggcgcccctgaacataacaccgattttggcgccttcaagcacctgtacatgctccttgtgaatgcctttaatctctctcagaattccttgtctaagaaatcgctgaatgtttggaacaaagattccattgctagcaattgtcgatcaagccccagccacaccaccaacgggtgccagggcgaaaaggtgaggacatgtgaaaagtcagatgagtccgccatgtcattttaccccccttcattaaatgatgcctctttcaccctgatcggatttagcaaaggctgcgtcgttctcaatcagttattgttcgagctcaaggaggcaaagaaggacaaaaacatcgacgccttcatcaaatccatcagaactatgtactggctggacggtgggcattctgggggctcaaatacatgggtcacatacccggaggtcctaaaggaatttgctcaaacaggaattatagtgcatacacacgtgactccatatcaagtaagggacccaatgcggagttggattggcaaggagcacaagaaatttgtccagatcctgggggatctgggaatgcaggtgacatcgcagatacatttcacgaaggaggcaccatctatcgaaaatcatttccgggtgcacgaagttttttag

SEQ ID NO: 5455 - DNA, 936 bp, Artificial Sequence
  Description of Artificial Sequence: Synthetic coding sequence
atgaggggggcggccagagctgcctggggccgtgccggccaaccctggccccgtccgcctgcgcccgggcccccaccccctccccttcccctcctgctgctccttctcgccgggttgctcggtggggccggagctcaatattcctcagacagatgtagttggaaagggtccggtctaactcatgaggcgcatcgaaaggaagtagagcaggtttacctgcgctgcgcagcaggagcggtcgaatggatgtaccctaccggcgcactaatcgtaaatctgagacctaataccttctctcccgctaggcacctcacagtatgcattcggtcatttactgactcatctggcgccaacatctatctggaaaaaacaggggagctgcggctgctggttcccgacggcgatgggagacctgggagggttcagtgttttggcctagagcagggcggcctgttcgtagaggccacaccccagcaggacatcgggaggcggacaactggatttcaatatgagctggtgagaagacaccgcgcttcagacctgcacgaactgtcggccccatgcagaccttgtagtgacactgaggtgctgcttgctgtttgtacctccgacttcgctgtgagggggagcatacagcaggtgactcacgagcccgaaagacaggacagcgctattcacctgcgcgtgtctcggctgtaccggcagaaaagtagggttttcgaacctgtcccagaaggggatgggcactggcaggggcgggtcagaaccctgttggaatgtggtgtgaggccagggcatggagacttcctcttcaccggtcacatgcattttggcgaggcgcggctcggttgtgcccccaggtttaaagactttcagaggatgtatagagacgctcaggaacgcgggttaaatccttgtgaggtgggcacagactag

SEQ ID NO: 5456 - DNA, 1221 bp, Artificial Sequence
  Description of Artificial Sequence: Synthetic coding sequence
atgggaccatctacacctcttcttatactcttcttgctgagttggtcgggcccgctccaggggcagcagcatcatctggtagaatatatggagcggaggctggccgcactagaggagcgtttggcccaatgtcaagaccaatcctccaggcatgctgcagagctgagggactttaagaacaagatgctgcctttgttggaggtggctgagaaagagcgagaggctctgcgcacagaggcagatactatctccggcagagtggaccggctggagcgggaagtggattatctggagacacagaacccggcactgccttgcgtggagttcgacgagaaagtaactggaggtcctgggacgaagggaaaggggcgccgcaacgaaaagtacgacatggtcaccgattgcggctataccatctcccaggtccgttcaatgaaaatattaaagcgcttcggagggcccgccggactgtggacgaaagaccctctgggccaaactgagaaaatctacgtgctggatggaacccagaacgacaccgcctttgtattcccgcggctaagggattttacactcgcgatggctgcccgcaaggccagtcgtgttcgtgtcccttttccatgggtgggcacaggacagctggtttatggcggctttctgtactttgccaggagaccaccagggcggcctgggggcggcggagagatggagaacaccttacagctcattaagttccatttggccaaccgcaccgtcgtcgattcaagcgtttttcccgcggaaggtcttatccctccctacggactgactgctgatacttacattgacctagccgctgacgaggaaggattgtgggccgtttacgcgacaagagaagatgacagacatttgtgtcttgcgaaattggacccacagacactggatactgagcagcagtgggataccccttgtcctagagagaacgccgaggccgctttcgtgatctgcggcactctgtacgttgtttataacacacggcccgcaagccgagcacgtattcagtgcagttttgatgcaagcggcaccctcacccccgagcgggcagccctaccatacttcccgaggcgttatggggcacacgcaagtctgcgctataaccctcgagagcgccagctatatgcctgggatgacgggtaccaaatcgtctacaagctcgagatgaggaagaaagaggaggaagtgtag

SEQ ID NO: 5457 - DNA, 900 bp, Artificial Sequence
  Description of Artificial Sequence: Synthetic coding sequence
atgggcgggccccgggctctgctggccgccttatgggctttagaagccgctggcaccgccgccctgcggatcggagctttcaatattcagtctttcggggattcaaaggtgagcgacccggcgtgtggttcgataattgctaaaatcctggccggttacgatctcgcactggtacaagaggtgcgagatcccgacttgtctgccgtatcagccctgatggagcagattaattcggtgagtgagcatgaatactcattcgtcagctctcagccgttagggcgggatcaatacaaggagatgtacctcttcgtgtatcggaaggatgctgtgtctgtggtggatacctacctgtatccagacccagaggacgtcttctcacgagagcccttcgtagtcaaattctctgctccgggaaccggagaaagggcaccccccttgcctagcaggcgcgccttaactccaccccccctcccagcggcagcccagaacctggtcctgattccactccatgccgctcctcaccaggctgttgccgagatcgatgccctctacgatgtttacctcgatgtgattgataagtggggtaccgacgacatgctatttctaggagacttcaatgctgactgcagctacgtccgggctcaggactgggccgctatcaggttaagaagcagcgaggtgttcaagtggttgattcctgacagcgccgatactactgttggcaattcagattgcgcctacgaccggatcgtcgcctgcggcgcgagattaaggcggtctctgaagccacaaagcgctacagtacacgattttcaagaagagttcggcttggaccagacacaggccctggcaatttctgaccattttccagttgaggtgacattgaaattccacaggtag

SEQ ID NO: 5458 - DNA, 1617 bp, Artificial Sequence
  Description of Artificial Sequence: Synthetic coding sequence
atgggctgcctgtggggtctggccctcccgcttttctttttttgctgggaagtgggggtgtccggctcttctgctgggccttcaaccaggagagcggataccgcaatgactacagatgatacagaggttccagcaatgacactagctccagggcatgctgccctggagacacagacactgagcgcagaaacctcttcaagggcttcaactccagcagggcccatacctgaggcagagactcgaggcgccaagagaatttctcctgcccgtgagacccgcagttttactaagaccagccccaatttcatggttctgattgccaccagcgtagaaactagtgcggcttctgggagtcctgagggcgccggcatgactactgtgcaaaccatcacggggtctgaccccagagaggcgatctttgataccctgtgtacagacgacagcagtgaagaagccaagacccttactatggacattttgaccctcgctcataccagcactgaggcaaagggattgagtagtgaatcatctgccagctcagatagcccccaccccgtgataactccctcacgagcctccgaatcttccgcctcatctgacggtccacacccggttatcaccccgagccgcgcttctgagtcctccgcttctagcgacgggccccatcctgtcattacaccttcctggtcaccaggatctgatgtgacattgctggccgaagctctggtcactgttacaaatatcgaagtaatcaattgctccatcactgaaatagagactacgacatcttccatccccggggctagcgatacggatctcatccctactgagggtgtaaaagctagctcaacgagtgatccacccgcccttcccgactccaccgaggcaaaaccccacattaccgaggtgacggctagcgcggaaacgctgtcaacggcaggtacgactgaatcagccgctcctgacgctaccgtggggacccccctgcccacgaactccgccaccgagagggaagtgacagcccccggtgctaccacactgagcggtgcactggtgaccgtaagtagaaacccgcttgaagagactagcgcgctcagtgttgaaactccttcgtacgtgaaggtgtctggggccgccccagtgtctattgaggccggcagcgccgtggggaagacgacctccttcgctggctcctcggctagctcttattcgcctagcgaggccgcgctgaaaaatttcaccccgtcagagactcctacaatggacatcgcgacgaaaggccctttcccaacgtccagagatcccctcccaagtgttcctcccacaacaacaaactctagtagaggcacaaatagcacccttgccaaaatcaccacctctgcaaagaccacaatgaagccgcctaccgccacccccaccaccgcccggacacggccgacaacagatgtttccgccggcgagaatggtggattcctgttactccgtcttagtgtggccagccccgaggatctgaccgatcctcgggtggccgagcggttgatgcagcaactccatagagagcttcatgcgcatgccccacactttcaagtcagcctgcttagggtccgtaggggttag

SEQ ID NO: 5459 - DNA, 975 bp, Artificial Sequence
  Description of Artificial Sequence: Synthetic coding sequence
atgtcttcagaggcagaaactcagcagccccctgctgcacctcccgcagctccagcactgtccgccgcagacacaaaacctggaaccacgggcagtggagcgggatcaggcgggccagggggactgacctccgcggcgcctgctggcggggataaaaaggtgatcgcgacgaaagtcctcggcaccgttaagtggtttaacgttagaaacggatatggctttatcaataggaacgatactaaggaagacgtttttgttcaccagacagccatcaaaaagaacaatcctagaaagtatctgcgtagtgtaggagacggtgaaacagtggagtttgatgtcgtggagggagaaaaaggtgccgaggccgctaatgtaaccggtcctggaggcgttccggtgcagggcagtaaatatgcagccgatcggaatcattacagaaggtacccccgccggcggggaccgccacggaattaccagcagaattaccagaattctgaaagtggcgagaagaatgagggatctgaaagcgcgcccgaagggcaggcccagcagaggaggccatacagaagacgacggttcccaccatactacatgcgacgcccttatggtcgcagacctcagtacagtaaccctcccgtgcaaggcgaagttatggagggtgcagataaccagggcgccggagaacaggggaggccggtgcgccagaatatgtaccgagggtataggcctaggtttagacgcggcccgccacgacagcgtcagccccgggaagacggcaatgaagaagataaagagaaccaaggcgatgagacccagggccagcagcccccccaacgccgttataggagaaacttcaactaccgccggcgtaggcccgaaaacccgaaaccccaggatggcaaagagacaaaggcggccgaccccccagccgagaactcatccgcaccggaagccgaacagggtggggcagaatag

SEQ ID NO: 5460 - DNA, 210 bp, Artificial Sequence
  Description of Artificial Sequence: Synthetic coding sequence
atgcggatcttttattacttacactttctatgttatgtaacctttatcctcccagccacatgtactctggttaatgctgatcggtgtaccaaacgatacgggagatgcaaacgcgactgcttggaatctgaaaaacagattgacatctgcagcctgccccgaaagatatgctgtaccgagaagctgtacgaagaggacgacatgttttag

SEQ ID NO: 5461 - DNA, 342 bp, Artificial Sequence
  Description of Artificial Sequence: Synthetic coding sequence
atgaaactcctgaccacgatctgccgactcaaattggagaagatgtactctaagaccaacaccagcagtacaattttcgagaaggcccgtcatgggactgagaagatctctacagcaaggagtgagggccatcacatcaccttttcgagatggaagtcctgcaccgccatagggggccgttgcaagaaccagtgcgatgactcggagttccggatctcatactgtgcgagacctaccactcactgttgtgtaacagagtgcgacccgaccgatccaaacaattggattccgaaggactccgtgggaacacaggaatggtaccctaaagacagccgccattag

SEQ ID NO: 5462 - DNA, 3030 bp, Artificial Sequence
  Description of Artificial Sequence: Synthetic coding sequence
atggatctaattaggggagttctgcttcgattgttgctcctggcctcttctctaggcccgggagcggtgagcctgcgggccgctattagaaagcccgggaaggtaggacctcccctcgacataaaacttggtgcccttaattgtaccgcatttagcatccagtggaagatgccccggcatcctggcagcccaattctaggctatactgtcttctacagtgaagtaggggcagataagtccctgcaggaacagttgcactctgtccccctgtcaagagacattccgaccactgaggaagtgatcggggatcttaaacccggcacagagtacagagtgagtatcgcagcttactcgcaagcagggaaggggcgtctgtcatcaccacggcatgttaccaccttgtcacaggactcctgccttcccccagccgcccctcagcagccccacgtgatcgtggtgtctgacagcgaggtggcattatcctggaagcccggcgccagtgagggttccgcgcccattcagtactactccgtggagtttatccgcccggatttcgacaagaaatggacatccatacatgaaaggattcagatggacagcatggtgatcaaagggctggaccccgacacaaattaccaatttgcggttagggctatgaactctcatgggccgtctccacggtcctggccaagcgacatcatccgaaccctttgtcccgaagaggcaggctccggccgttacggtccccgctacatcaccgatatgggagccggagaggatgatgagggttttgaggacgatctggaccttgacattagcttcgaggaggtgaagcccctacccgcaactaaggggggtaacaaaaagttcctggtggagagcaaaaaaatgagcatcagcaaccccaagacaatctctagacttattccacccacctcagcctctttgcccgtgaccactgttgccccacagccaatccccatccagcggaaaggcaagaacggggtcgcaatcatgagcaggttattcgatatgccatgtgacgaaactctgtgtagcgcagacagcttttgcgtgaatgactatacctggggcggatcgcgttgtcagtgcacccttgggaaaggcggcgaaagttgctccgaggacattgttatccagtatccccaatttttcggacattcctacgttactttcgagcctctaaagaattcctaccaagcttttcagataacactagagtttcgtgccgaagctgaagatggcctgttactctattgcggggaaaacgaacatggccggggggattttatgtccctggccatcatacgtaggtctctgcagtttagattcaactgtggaaccggtgtagccattatagtttcagagacaaagatcaaattgggcgggtggcacacagtcatgctgtatcgggatggcctgaatggcctgcttcagctgaataacggaaccccagtaactggacagtcccaggggcagtacagcaagataacatttcgcacaccactatatctgggaggagctccctctgcctactggctcgtacgggccactgggaccaaccgaggctttcaaggatgtgtgcagtcattggcagtgaatggtagacgaatcgacatgaggccctggccattgggaaaggccctgagcggagcagacgtgggggagtgctcgtcgggtatctgcgacgaggcctcctgcatccacggcggtacctgcaccgcaattaaggcggattcctatatctgcctgtgtcctcttggatttaaaggcaggcattgcgaggatgctttcaccctgactattccgcagttccgagagagtctgaggtcctacgcagcgacgccatggcccctggaaccacagcattatttgagttttatggaatttgaaattaccttccgtcctgattctggcgatggcgtactcctgtattcgtatgatacaggcagcaaagactttttatctatcaacttggccggaggacatgtagaatttcggtttgattgtggaagcggcaccggggtgttgagaagtgaggacccactaacactgggcaattggcacgagctgagggtatcccgcactgccaaaaatggcattctgcaggtggacaaacagaagattgtcgaaggcatggctgagggcggtttcacacagattaagtgcaacactgacattttcatcggcggggtacccaattacgatgatgtgaagaaaaattccggggttctcaaaccattctccgggtctatccagaagatcatccttaacgacaggacaatacacgtcaagcatgactttacgagtggagtgaacgtcgagaatgccgcgcacccatgcgtgcgggcaccctgcgcacatggcggttcatgtcgacccaggaaagaagggtatgactgcgactgccctctcggcttcgagggtctgcactgccagaaggcaatcatagaggccattgaaatcccgcaattcatcggccgtagctatctcacttacgacaaccccgacatactcaagagagtcagtggctctcggagcaacgtcttcatgagattcaaaaccaccgcaaaggatggtctgcttctgtggagaggagattcacctatgaggcccaattctgacttcatctcactggggctccgagacggggcactggtttttagctataacctgggatctggcgttgcttctatcatggtgaacggatcgtttaacgacggtcggtggcacagggtcaaagccgtaagagacggtcagagtggaaaaattacagttgacgactacggcgctaggaccggaaagtctcctgggatgatgaggcagcttaacatcaacggcgcgctgtacgtggggggaatgaaagagatcgcactgcatacaaaccgccagtatatgcgggggttggttggctgcatttcccattttaccctctcaaccgattatcacatcagcctcgtagaagatgcagtggatggtaagaacatcaatacctgtggcgccaagtag

SEQ ID NO: 5463 - DNA, 1272 bp, Artificial Sequence
  Description of Artificial Sequence: Synthetic coding sequence
atgtctgtaagagggatcctgcggctcggcactcaagagtatcccagtcctctggatcctgaggtaggaccctactgtgacaccccaacgatgagaaccctgttcaacttactttggttggctctggcatgttcacccgtgcacacaaccttatccaaaagtgacgccaagaaggccgctagcaagactctgcttgaaaaaagtcagttcagcgataagcccgtgcaggatcggggcctggtggtaacagatctgaaagcagaaagcgtggttctggaacaccgaagctactgttccgctaaagcccgggaccgacattttgcaggagatgttttgggatacgtgaccccgtggaactcccatggttatgatgtcactaaagtattcggcagcaagttcacccagatcagccccgtgtggttgcagctgaaacggcgagggcgcgagatgtttgaggtcaccggcctgcacgatgttgatcagggctggatgagagctgtcaggaaacacgccaagggactgcatattgttcctcgccttctgttcgaggattggacttacgatgattttcgtaacgtgttggatagcgaagacgaaatcgaggaactttccaagactgtggtccaggtggctaaaaatcagcacttcgacgggttcgtagtagaggtgtggaatcagctgctctctcagaaacgagtcggcctgatccatatgctaactcacttagcggaagcgctgcatcaagcccgcctgcttgcactcctggtgatccctccagctatcaccccaggcacggaccaactgggcatgttcacccacaaggaatttgaacaacttgcccccgtgctggacgggttcagcctgatgacttacgattatagtacagcgcaccagcccggacccaatgccccattgagctgggtgagggcgtgcgtgcaagtgttggatcccaagtctaaatggagaagcaagatcctgcttggtctcaatttttatggcatggattatgctacttcaaaagatgcccgagagccagtggtgggcgcaaggtatatccagacccttaaggatcatagaccaaggatggtgtgggacagtcaggcatcagaacactttttcgaatacaagaagtccaggtccggtcgtcacgttgtattttatcccacactgaagagtctacaggtacgcctggaactggctcgggagttgggcgtcggggtaagcatttgggagctgggccaagggttggactacttctacgatttgctgtag

SEQ ID NO: 5464 - DNA, 1182 bp, Artificial Sequence
  Description of Artificial Sequence: Synthetic coding sequence
atgaggactctttttaatctgctgtggctggcactggcatgcagtcctgtccataccactttgtcaaaatccgacgccaagaaggctgcctcaaagaccttgctcgaaaaatcccaattctccgataagccagtccaggacaggggactggttgtaacagacctgaaggcagaatcagtggtgctcgaacataggagctattgctctgcaaaagctagagaccgacatttcgctggcgatgtgttgggttatgtgacaccctggaatagccacgggtacgacgtgacaaaggtttttggaagcaagttcacacagatctccccagtctggcttcagttaaagcggcgcggcagagagatgttcgaagtcacaggactccacgacgtggaccaaggctggatgcgagccgttcgtaaacacgcaaagggccttcacatcgtaccgcgcctgctattcgaagactggacttatgatgattttcggaacgtcctcgatagtgaagacgaaattgaggaattgagtaagaccgtagtgcaggtggcgaaaaaccaacactttgacgggttcgtggttgaggtgtggaatcagctgcttagccaaaagagagttggattgattcacatgctgactcacttagcggaagccctgcatcaggccagactgctggcgctacttgttattccgcctgccattaccccgggaaccgaccaactgggaatgtttacacataaggagttcgaacagcttgctcctgttctggatggctttagcctgatgacgtacgactactccacagcccaccagccaggcccaaatgccccactcagttgggtgagggcatgcgttcaggttctcgacccaaagtccaagtggcggtcaaaaatcctactcgggctaaatttctatggtatggactacgccaccagtaaagatgctcgagagccagttgtgggagcgcgatacattcagacacttaaagatcatcggcctagaatggtatgggacagccaggctagcgaacatttcttcgagtataagaagagccgaagtgggcgccacgtcgttttttacccaacactgaagagtctgcaggtcaggttagagttggctagggaactgggggtcggtgtcagcatatgggagctcggacagggcctggattatttctatgatctgctatag

SEQ ID NO: 5465 - DNA, 1959 bp, Artificial Sequence
  Description of Artificial Sequence: Synthetic coding sequence
atggcctcagttgcatgggccgtcctcaaagtcctgttactgctccctacccagacttggtccccggtaggggcaggcaaccctccagattgtgacgcccccctggcctcagctctccctcgaagcagtttctctagctcatccgaactgtcatcctcccacgggccagggttttcccgactcaacaggagagatggggcaggcggatggactccactcgtgtctaacaaatatcaatggctccagattgatttgggagagcgcatggaagtaactgccgttgccacacagggaggctacggctctagcgattgggttacctcttatctgcttatgttctctgacgggggcaggaactggaaacagtatcggcgtgaggaatccatatggggtttcccaggcaacactaacgcagacagcgtcgtgcattaccgtctgcagcctccttttgaagcccgcttcctgaggtttctgcctctcgcttggaatcccagaggtagaattggaatgcggatcgaagtgtatggttgcgcctacaagagcgaggtagtgtatttcgatggtcagtccgccctgctgtaccgactggacaagaagccattaaaacccatcagagacgtgatcagtctgaaatttaaggcaatgcagagcaatggaatcctgttacatcgcgaggggcagcatgggaaccacattacgcttgagcttatcaaaggcaaactggtctttttcctcaactctggcaacgctaagttgccttccactatagctccagtgactcttacattaggctctctgttagatgaccagcactggcacagtgttctgattgaacttctggacacgcaagtaaattttactgttgataagcatactcatcatttccaggccaaaggagattcctcatacctggatttgaactttgaaatcagtttcgggggcatccccacccccggacgcagtagggcgttcagacgcaagtctttccacgggtgtctagagaatctatactacaacggggtggacgtgacggaattagccaagaaacataagccacagattctcatgatggggaatgtcagcttctcctgtccgcaaccacagaccgttccagtgacatttttaagctcacggtcctatttggcactaccggggaatagtggggaagacaaggtgtcggtcacctttcaatttcgcacctggaaccgcgcgggccacctcttgttcggagagttaagacgcggcagcggttcgtttgtcctgttcctcaaagatggcaaactgaaactgagcttgtttcagcccggccaaagccccaggaacgtaactgctggcgccgggctcaacgacggccaatggcatagcgtgagctttagcgctaagtggtcgcacatgaatgtcgtggtcgatgacgatacagccgtgcagccgctggtggctgtcttaatcgattccggcgacacttattatttcggggcactctacgaacaatcttgcgaggctcacaagcatcggggtaaccctagcggcctgtattacatcgatgccgatgggagcgggcctctgggaccatttttggtgtattgcaacatgactgacgccgcttggacagtagtgcagcatgggggtcccgacgctgtgactctcagaggcgctccttctggccatcctcgctctgccgttagttttgcctacgctgctggagctggacagctgcgatcagcagtgaaccttgctgaacgctgtgaacagcggctggctttacgctgtgggacagccagaaggcccgacagccgggatggtacacctttgtcatggtgggtcggaagaactaacgaaacacataccagttggggaggtagtttacctgacgcacaaaagtgcacatgcgggcttgagggtaattgtatcgattcccagtattactgcaactgtgatgccggaagaaacgaatggtag

SEQ ID NO: 5466 - DNA, 1455 bp, Artificial Sequence
  Description of Artificial Sequence: Synthetic coding sequence
atgtggtatgtcagtacaaggggggtagccccaagggttaacttcgaaggggccctcttcagtggctacgcacccgatggtggactgttcatgcctgaggagctcccccagctcgaccggggcacgctgtgtcagtggagcactctgagctaccccgggctcgtgaaggagttatgtgctcttttcattggcagtgagctgcttcctaaggacgagctaaatgacttgattgacagagccttctcccgatttcgccacagagaggtcgtgcatcttagtcgcctgcgcaacggccttaatgtgctggagttatggcacggagttacttatgcctttaaggacctcagtctgtcctgcaccactcagttccttcagtattttctcgaaaagagagaaaagcatgtgaccgtggtcgtaggtacatcgggcgataccggtagcgctgccatcgagagcgttcagggcgcaaagaacatggatattatcgtccttcttcctaagggccactgcaccaaaatccaagaactgcaaatgaccacggtccttaagcagaatgtgcatgtgttcggggtggaaggcaatagcgatgagctcgatgagcctattaaaacggtctttgccgatgtggctttcgttaagaaacacaacctcatgtcgctcaatagtatcaactggagtcgggtgttggttcagatggcacaccacttctttgcatactttcagtgtaccccctcgttggacacccatcccctgccactggtggaggtggtggtgcccacaggagctgcagggaacctagctgccggatacatcgctcagaagataggattgcctattaggttagttgtggctgtgaatagaaatgatatcatccaccgcacagtgcaacagggtgatttttcgttgtccgaagctgtgaagtcaacacttgcttcagccatggacattcaggtcccctacaatatggagagagtcttttggcttctctcagggtctgacagtcaggtgactagggctcttatggaacagttcgagcgcacgcaatccgttaacttgcctaaagagttgcactctaaactatccgaggcggtcacctcggtgagcgtgagcgacgaagccatcacgcagactatggggcgatgctgggacgaaaatcaatatctgctgtgcccccacagcgctgtggctgtcaactaccactaccaacagatcgaccgacaacagccatctacaccacgctgctgcttagctcctgcttcagctgccaaatttcctgaggctgtactggctgccgggctcactcctgaaacacctgcggaaatcgttgccctggagcataaggaaactagatgcactctgatgcgcaggggcgataattggatgctcatgctgagagacacgattgaggacctgagtcgtcagtggcgcagtcacgctctcaacacatcccaatag

SEQ ID NO: 5467 - DNA, 264 bp, Artificial Sequence
  Description of Artificial Sequence: Synthetic coding sequence
atggttagtctaatgaagctgtggattccaatgctgatgacctttttctgtaccgtcctgctctcggtactgggcgaaatgcgtaagaaaagatatgaccgaaaggaactgttgctggaagagtgttgggggaagcctaatgtgaaggagtgtaccaacaaatgctcaaaggcttttaggtgtaaggataaaaactatacatgttgctggacatactgtgggaacatttgttggatcaatgtggaaacttctggagactactag

SEQ ID NO: 5468 - DNA, 453 bp, Artificial Sequence
  Description of Artificial Sequence: Synthetic coding sequence
atgcgcttcatggcaggccccgcaggatctcagagcctgggtcctttatgctttcactcctctcctcaggcactctatactgtgctgctcatagtcttagtcatgatgagtttggtttttggaaaatttgtgcccgtcaattgggaaccaccccagcctctccctttcccgaagtatctgagatgttaccggtgcctgcttgaaacaaaagaacttggctgtttattaggttccgatatatgccttacacccgccggctcaagctgcattaccttacacaaaaagaactcgagtggatctgatgtaatggtcagcgactgccgatccaaagaacagatgtctgactgcagcaacactcggacatcacctgtcagtggcttctggatattctctcagtactgtttcctggatttctgcaacgatcctcagaaccggggcctgtacacaccctag

SEQ ID NO: 5469 - DNA, 873 bp, Artificial Sequence
  Description of Artificial Sequence: Synthetic coding sequence
atgtcagtaaggcgcgggcggaggcccgccagaccaggaacccggctctcctggttactctgctgtagtgctctgctcagcccagctgctgggtacgtgattgtgtctagtgtttcctgggcggtcacgaacgaggtcgacgaggagctagactctgcaagcacggaagaggcaatgccagcactgttggaggacagcgggtcaatatggcagcagtcctttcccgcatccgcacataaggaggatgcacatctaaggccaagagctggagcggcgagggctcgcccgcctcccgcccccccgggcatgttttcttaccgtcgggaaggcggacagacagcgtccgcccctccgggtccgcggctgagagcagccacagcccggtcactcgcccacgccagcgtatggggatgcctcgctaccgtgagcacccataagaagatccaggggctcccttttgggaactgtcttcctgtttcggacggtccatttaataactctactggaatcccatttttttatatgacggccaaggacccagtcgtggccgacttgatgaagaatccaatggcctctttgatgttgcctgagtcagagggtgaattctgccgaaaaaacatcgtggacccagaggaccctcggtgtgtacagctgaccctgactggacagatgatcgccgtctcgccagaggaagtcgagttcgctaaacaagccatgttttcccgacacccaggaatgagaaagtggcccagacagtacgagtggttctttatgaagatgagaattgagcacatctggctccagaaatggtacggaggcgcgtctagcatctcacgagaggagtatttcaaggcggtgccccgcaaggcctag

SEQ ID NO: 5470 - DNA, 2742 bp, Artificial Sequence
  Description of Artificial Sequence: Synthetic coding sequence
atggggccggaagcactgtcatcgctcttgctcttgttgttagtggcctctggcgacgcggatatgaaaggacacttcgatcccgccaagtgtcgctacgccctcggaatgcaagatcggacaatcccggatagcgatatatcagcatcctcttcctggagtgatagcaccgctgcccggcactcccggttagaatcttcagacggcgacggggcgtggtgcccagccggttctgtgttccctaaagaggaggaatacctgcaggtggacttacaaagactgcatctggtggccttggtgggcacccagggacggcacgcagggggtcttgggaaggaattcagtcgttcttaccgtttgcgttattcaagggacggaagaagatggatgggatggaaagaccggtggggacaggaagtcataagtggcaacgaggaccctgaaggggtcgtgctcaaggacctaggccctcccatggttgcccggctggttaggttttacccacgggctgaccgggtgatgagcgtttgcctgagagtagaactgtacgggtgcttgtggcgggatggcttgctgagttataccgcacctgtggggcagactatgtatctgtctgaggctgtttatctgaatgattctacctacgacgggcacaccgtcgggggactgcagtacggggggctgggccaactggctgatggtgtcgtcgggctcgatgactttcgaaagagccaggaattgagagtgtggcccggctatgactacgtgggatggtccaaccacagcttttcctcaggttatgtcgagatggagtttgagtttgacaggttaagagcgttccaggcaatgcaggtgcattgcaataacatgcataccctgggcgctcgcctgccgggtggcgtggagtgtcgattcagacgagggccggccatggcctgggaaggggagcccatgcgccataacctcggaggtaatctgggagaccctagggcgcgtgccgtgagcgttccactgggaggtcgcgtcgcccgctttctgcagtgcagatttctcttcgccggcccttggctgctcttcagcgagatttcgtttataagcgatgtggtgaacaactcttcacccgcacttggcggcacattcccccccgccccctggtggccccccggcccacccccaaccaatttcagttcactggaactggagcctagagggcagcagccagtcgccaaggccgaggggtcacccaccgctatcctcataggttgcctagtcgccataatcctcctccttcttttgatcattgccctaatgctttggcggcttcattggagaagactgctttcgaaagccgagagaagggtgcttgaagaggaactgactgtgcatctctccgttcccggagacactatactcataaataatcgcccaggacctagagagcctccgccctaccaagaacctagaccccgcggcaacccccctcattccgccccttgcgtgcccaacggttcagctttactcctctctaatcctgcctatcgcctgctgctggctacctatgcgcggcccccacgtggcccgggtccgcccacccctgcgtgggctaagccaacaaacacccaggcctattccggcgattatatggaaccagaaaaacccggagcccctctcctgccgccccctccacagaattccgtccctcactacgccgaagccgacattgtgacactacagggagtcacaggcggcaatacttacgcagtaccagcccttcccccgggagcagtgggggatggcccccccagggtggattttcccaggtcaagattgcgcttcaaagagaagctgggagaggggcagtttggcgaagttcacctctgtgaagtcgatagtccgcaggacctggtgtctctagacttccctctcaatgtgcgcaaggggcatcctctgctggtggcggtgaaaatccttcgccccgatgccaccaagaacgcccggaacgacttcttgaaagaggtgaagatcatgtcccggctcaaggaccctaacataattcgactattaggagtatgcgtccaagacgatcccctgtgcatgatcactgactacatggaaaacggcgatctgaatcagttcctatcagcacaccagttggaagacaaggctgcggagggagctcctggtgatggccaggcagcacaaggcccaacaatttcttatcccatgctcctgcacgtggctgcccagatagcttcaggcatgaggtatctggccacactgaattttgtgcatcgggacttggctacacggaactgcctcgttggcgaaaacttcacgatcaaaatcgccgactttgggatgagtcggaatctgtatgccggagactactatcgcgtccaaggtagagctgtactccccattcggtggatggcttgggaatgcatactaatggggaagtttactaccgcttccgatgtgtgggccttcggggtcaccctctgggaggtacttatgctctgtagggctcagccgtttggacagctgactgatgagcaggtgattgaaaatgctggcgagttctttcgcgatcagggaagacaggtttacctgtcccgcccacctgcatgcccacagggcctgtacgagcttatgctccgctgctggtcccgcgagtccgagcagaggcctcctttcagtcagctgcacaggtttctggccgaggacgccctgaacacagtgtag

SEQ ID NO: 5471 - DNA, 243 bp, Artificial Sequence
  Description of Artificial Sequence: Synthetic coding sequence
atgaagttgagtgggatgttcctcctactttctcttgccctattttgcttccttacaggagtgttttcacaaggcgggcaggtagattgcggagaatttcaggaccccaaggtgtattgtactagggagtccaacccacactgcggaagcgacgggcagacctatggtaacaagtgcgccttctgcaaagccatagtaaaatccggcgggaagatcagcctgaagcatccggggaaatgctag

SEQ ID NO: 5472 - DNA, 270 bp, Artificial Sequence
  Description of Artificial Sequence: Synthetic coding sequence
atgaagccatggattcttctgctggtcatgtttatttccggtgtagtaatgctgctgcctgtgctagggtcgttctggaacaaggacccgttcctggatatgattagggagaccgaacagtgttgggtccaaccgccatataagtactgcgaaaaacgctgcacgaaaattatgacctgtgtcagacctaaccatacctgttgttggacttactgcggaaacatatgcctggataatgaggaacctctcaaatccatgttaaatccctag

SEQ ID NO: 5473 - DNA, 264 bp, Artificial Sequence
  Description of Artificial Sequence: Synthetic coding sequence
atgctgccatgtctggccctcctacttcttatggagttaagcgtttgtacggtcgctggtgacggaggggaagagcaaacactgagcaccgaagccgaaacatgggaaggcgccggtccaagcatccagttacagcttcaggaggtcaaaaccgggaaagcttctcagttttttggactcatgggcaaacgagtggggggccggcctttaatccaaccccggcggaagaaaggtcgagaggatgaagcccagggttcagagtag

SEQ ID NO: 5474 - DNA, 285 bp, Artificial Sequence
  Description of Artificial Sequence: Synthetic coding sequence
atgcagcattccctggtgtttttcttcgcagtaattttacacttaagccatttgctgcatctagacgcctcaatccacccattccgtctgccattttcgagcaagccattcctgcttatcccaatgtcaaataccacactgcctcataccgcttggccacttagctttttacatcaaacagtgtctacacttaaggccgtcgccgtcacacattccctgtggcacctgcagatccccgttgactgccaggcatgtaatcgaaaatcaaaaaagatttattgctag

SEQ ID NO: 5475 - DNA, 327 bp, Artificial Sequence
  Description of Artificial Sequence: Synthetic coding sequence
atgcggcaaagattacttccatcagtgacaagcctactgctcgtggctctgcttttccccggcagtagccaggccagacatgtaaatcactctgccaccgaagcgctcggcgagttgagggaacgagcacctggacagggtacaaacggctttcagctgctgcggcatgctgtaaagcgagatctcctgcccccaagaacccctccttaccagggtgacgtgcctcttggaatcaggaacacgatctgcagaatgcaacagggtatctgccgcctgttcttttgccattctggcaccggacaacagcatcgccaacgatgcgggtag

SEQ ID NO: 5476 - DNA, 807 bp, Artificial Sequence
  Description of Artificial Sequence: Synthetic coding sequence
atgttgctgcttgctgctgccttcctggtggccttcgttctcctgctctacatggtaagtcctctcatttcaccaaaacccctcgccttgccgggagcccatgttgtagtgactggggggagctctggtattggtaaatgcatcgctattgagtgttataaacagggtgcattcatcaccctagtcgcaaggaatgaggacaaactgttgcaggccaagaaagagatcgaaatgcactctatcaacgataagcaagttgtgctgtgtatttccgtggatgtttcacaggactataaccaggtcgagaacgtcattaagcaggcacaggagaaactcggtccagtcgacatgctggttaattgcgcgggaatggccgtgagcggcaagtttgaggacctggaggtatcaaccttcgaagtgaagccctataatgtgtacataaccgtcgcatatccccccgacacggacacccccggatttgcagaggaaaatcggacaaagccccttgaaacccgattaatctcagagactacatcagtgtgtaagccagagcaagttgccaagcagattgtgaaggatgctatccagggtaactttaatagttctctgggatcagacggctacatgctgagtgccctgacgtgtggtatggctccggtgacgtctattaccgaggggctgcagcaggtcgtgaccatggggctattcaggactattgcacttttttacttgggcagctttgatagcattgtacgacggtgtatgatgcagagagaaaagtcagaaaatgctgataaaaccgcttag

SEQ ID NO: 5477 - DNA, 1686 bp, Artificial Sequence
  Description of Artificial Sequence: Synthetic coding sequence
atgcgatggatactgtgttggtcactgactttgtgcctgatggcccagactgccctgggtgcgctgcatactaagaggccacaggtggttaccaaatatggcaccctccaggggaagcaaatgcacgttggtaaaacacctattcaggtcttcctgggcgtccccttttccagacctcctctgggcatccttagatttgccccccctgagcccccagaaccatggaaggggataagggacgcaaccacgtacccgccagggtgtctacaggaaagttgggggcagcttgctagcatgtacgtgagtacccgtgaaaggtacaaatggctacggttcagcgaggattgtttgtacctgaacgtgtatgccccagcccgcgctccaggtgaccctcagctgcccgtaatggtgtggtttccgggaggtgctttcatcgttggcgctgcctctagctatgagggcagcgacctggccgcccgcgaaaaggtagtcttagtgttccttcaacaccgactcgggatatttggcttcctttccaccgacgatagccacgccagaggtaactggggcctgcttgatcagatggcagccctgcggtgggtacaggaaaatatcgccgcattcggcggtgatcctggcaatgtgactctcttcggccagagtgcaggtgctatgtccatcagtgggctgatgatgtcgcccttagcctctgggctgtttcatcgggcaattagtcagtccgggacagctttattcagactatttatcacctcaaaccccctgaaggtggcaaaaaaggtggcccacctcgccggctgtaaccataatagcacccagattttggtcaattgtctgcgggctctaagcggcactaaagtgatgagagtgtccaataaaatgagattccttcagttgaatttccaacgggaccccgaagaaataatttggtctatgagcccggttgtggatggagtggttatcccagacgatccactggttctactcacccaggggaaggtctcgtctgtaccttacctgctaggcgtaaacaatttggagttcaactggctgctgccctatattatgaagttccccctcaaccgtcaggctatgcgcaaggaaactatcacaaagatgctttggtcgacgcgcacgctgctaaacattacaaaggaacaggttccactcgttgtggaagaatacctggacaacgtgaacgaacatgactggaaaatgcttcgcaaccgtatgatggatatcgttcaggatgccaccttcgtctatgcaacactccagaccgcccattaccaccgtgatgctgggctccccgtatatttgtatgagtttgagcaccacgcccgggggattatagtcaagcccaggacagacggggcagaccatggcgacgagatgtatttcttatttggaggccccttcgccactggcctgagcatgggcaaagaaaaggcgctctccctgcagatgatgaaatattgggccaattttgcacgcaccgggaacccaaacgatgggaacttgccgtgttggcccaggtataataaagatgaaaagtatctacagctcgattttactacacgtgtgggaatgaaactcaaagaaaaaaaaatggctttctggatgagtctctaccagagccagcgccccgagaagcagcgacaattctag

SEQ ID NO: 5478 - DNA, 444 bp, Artificial Sequence
  Description of Artificial Sequence: Synthetic coding sequence
atggctagtagcctgaagatatgggggacgctattggccctactgtgcattctgtgtacactgcttgtgcagagcaaggaggttagctggagggagtttatgaaacagcactacctgtcaccttcccgcgaatttagagaatacaaatgcgatgtgctgatgcgtgaaaacgaagcgttaaaagacaaatcaagtcacatgttcatctacatttcctggtacaaaatcgaacatatatgtactagtgataattggatggatcggttcaggaatgcctatgtgtgggtgcagaaccccctcaaggttcttaagtgccaccaggaaaattcaaaaaatagctacacagagagccggtcatttaattatattgagttccattgcagtatggacgggtacgtggacagcatcgaggacctgaaaatggttgagcccattgggaattag

SEQ ID NO: 5479 - DNA, 444 bp, Artificial Sequence
  Description of Artificial Sequence: Synthetic coding sequence
atgacatccagcctgaaaatctggggtattctgctggctctgctgtgtattctctgcaggctgtgcgtttactctaacaacatttattggagagagtttattaagcttcactacctgagccccagccgtgaattcaaagagtacaagtgtgacgtcctgatgcgtgaaaaggaggccttgaaggggaagtcatttcacatgttcatttacagtctgtggttcaagatccagcgcgcctgcatcaacgagaagggaagcgacaggtatcgcaacgcttatgtatgggccccaggggctctcaaggtgcttgagtgtcactgggagaagtataataatcgctataccgaatctcgttccttcagttatattgaattccactgtggcgtagatggatacgtagacaatatcgaagatttgagaattattgaaccgatcagcaattag

SEQ ID NO: 5480 - DNA, 1248 bp, Artificial Sequence
  Description of Artificial Sequence: Synthetic coding sequence
atgtctccctttctgtatcttgtattactggtattgggcctacatgccacaattcattgcgcctccccagaaggcaaagttacagcgtgtcactcctcccagcctaatgcaaccttatacaagatgtcctccataaatgccgatttcgcgttcaatctgtatcgccgattcacagtcgaaacccccgataagaatattttttttagtcccgtttccatatccgccgcccttgttatgctaagctttggggcctgctgctccacacagaccgagatagtagaaactcttggattcaatctaactgatactcctatggtggagatccaacatggcttccagcacctcatctgctccctgaatttccctaagaaggaactagagctacagattgggaatgcattgtttatcggtaagcacctaaagcctctcgccaagtttctgaacgatgttaagacactgtacgagactgaagtgttcagtaccgacttttccaacataagcgctgccaagcaggagataaacagtcacgtggaaatgcaaacaaagggaaaagttgttggtctgattcaagatctgaaacctaacaccattatggtgctggtcaactacatacacttcaaggctcagtgggctaatccttttgacccttctaagaccgaagattccagtagctttctgattgacaaaaccactaccgtgcaggtgccaatgatgcaccaaatggagcagtactaccatctcgtggatatggaactcaattgcaccgtgttgcaaatggactacagcaagaacgcgctggctttgttcgtgctaccaaaggagggccagatggaatctgtagaggcagctatgtcaagcaagaccctcaagaagtggaacaggctgttgcaaaagggatgggtggatctattcgtgcctaaattttccataagcgcaacatacgatctgggcgcgacactgctgaaaatggggatccagcacgcttactcagaaaatgccgacttctcaggcctgactgaagataacggtttgaagctgagtaatgcggcgcataaagccgtgttacacatcggtgaaaagggtactgaggcggccgccgtgccagaggtggaactcagtgatcagccagagaacacttttctccaccctattatccaaatagataggagcttcatgctgctgatcctggaacggtctactaggagcatcctgttcctgggaaaagtggtgaaccccacggaggcttag

SEQ ID NO: 5481 - DNA, 285 bp, Artificial Sequence
  Description of Artificial Sequence: Synthetic coding sequence
atgaggactcttgccatcttggccgctattctcctggtggcactccaggcgcaagctgaacccttacaggctagggccgatgaggtcgccgctgcccccgaacagatcgcagccgacatccctgaggtggtggtgtctctggcctgggacgagtctttagccccaaaacacccggggtcccggaaaaacatggattgctattgtcgcataccagcttgtattgccggggagagaagatatgggacgtgcatctaccaggggaggctgtgggcattctgttgctag

SEQ ID NO: 5482 - DNA, 1062 bp, Artificial Sequence
  Description of Artificial Sequence: Synthetic coding sequence
atgaggctcccgaggcgagccgcgttaggtctgctcccgctgcttctacttctacctccagcacccgaagccgctaagaagcccacaccgtgccatcgatgtaggggattggtcgacaagttcaatcagggcatggttgatacagcgaagaaaaactttgggggggggaacacagcctgggaagagaaaactttgtcaaaatacgaatcttcggagatccgtctgcttgaaattttggagggtctgtgcgagtcttcagatttcgagtgcaaccaaatgttggaggcccaggaagagcacctcgaggcctggtggctccaactgaaatcagagtaccctgatctctttgagtggttctgcgtcaagacactgaaggtgtgctgctctccaggcacttatggacccgactgcctagcttgccaaggcggttcacagcggccatgcagcggcaatgggcactgttccggagacggctccaggcagggggacggctcttgcagatgtcacatgggctaccaggggccactgtgcacggattgtatggatggatacttcagttcacttagaaacgagactcacagtatttgcacagcttgcgacgaaagctgcaagacgtgctctggattaacaaaccgagactgcggagaatgcgaagtagggtgggtgttggatgagggcgcctgtgtagatgttgatgaatgcgccgcagagccccccccatgttcagcagcccagttttgtaagaacgcaaacgggtcgtacacttgcgaggagtgcgacagttcttgtgtggggtgtacgggagaaggacctggtaactgtaaggagtgtatttccggctacgctcgtgaacacggccagtgcgctgatgtggacgaatgctccttggccgaaaaaacttgtgtccggaagaatgagaactgttacaacacccccgggtcctacgtctgtgtttgccccgatggattcgaagagaccgaagatgcttgcgtgccacccgccgaagctgaagctaccgagggcgagagtccaacacaactaccatctcgcgaagacttgtag

SEQ ID NO: 5483 - DNA, 651 bp, Artificial Sequence
  Description of Artificial Sequence: Synthetic coding sequence
atgaagcttaaccttgtccagattttctttatgctgctcatgctcctgttagggctgggcatgggcctcggtctaggattacacatggcaacggcagtactggaggagtctgaccagcctctgaatgaattctggagcagcgacagccaggacaaagctgaggccaccgaggagggggatggaacacagacaaccgaaacacttgtactgtctaataaagaagtggtacagcccggttggcctgaggatccaatactcggcgaggatgaggttggaggcaataagatgctaagggcttcagctctcttccaatccaataaggattatttacgactagatcagaccgaccgggagtgcaacgacatgatggcccacaagatgaaggagccttctcagtcttgcattgcccagtacgcatttatacacgaggacctaaacaccgtaaaagctgtttgtaattcacctgtgatagcttgtgaacttaaaggcggtaagtgccacaaatccagtagacccttcgatctcacgttatgtgaattaagccaacccgatcaggtgaccccaaattgtaattacttaacttctgtaatcaaaaaacacattataatcacttgcaacgacatgaagagacaattgcccacagggcagtag

SEQ ID NO: 5484 - DNA, 222 bp, Artificial Sequence
  Description of Artificial Sequence: Synthetic coding sequence
atgcgtatagcggtgctgctttttgcaatcttcttttttatgagccaggtcctgccagctagaggcaagtttaaagaaatttgtgagcgacccaatgggagctgtcgagacttttgcttggagacagaaatccatgttggtaggtgcctgaacagtcagccttgttgcttaccactcggccatcagcccagaatcgagtccactactcctaagaaggactag

SEQ ID NO: 5485 - DNA, 609 bp, Artificial Sequence
  Description of Artificial Sequence: Synthetic coding sequence
atggagcggggcgctggggccaagctgttgcctttgctactccttctccgggccactggctttacttgcgcacagacggacggccgcaatggttacaccgcagtcatcgaggtcacatccggcggaccctggggtgactgggcttggccagagatgtgccccgatgggttttttgccagcggcttctcgctcaaagtggagcccccacagggtattcccggagacgatacagctctaaatggaatcaggctgcattgcgcccgaggtaacgtgctggggaatacacacgtggtggagtcccaatcggggagctggggtgaatggtctgagcccctctggtgccgggggggggcatatcttgtcgccttcagtctgcgggtggaagcccccacaacactgggggacaatacagccgctaataacgtacgcttcaggtgctcggatggggaagagctccaaggtccaggcttgtcctggggcgactttggtgactggagcgatcactgccctaagggtgcctgtggcctccagaccaagatacaggggcctaggggtctcggggacgataccgcgctgaatgatgcgaggcttttctgttgccggtcctag

SEQ ID NO: 5486 - DNA, 759 bp, Artificial Sequence
  Description of Artificial Sequence: Synthetic coding sequence
atgcagctaactcgctgttgctttgtgtttctcgtacaaggttcgctctacctggtgatttgcggccaggatgacggtcctcccgggtcagaagacccagaaagagatgatcatgaaggtcagccccgccctagggttcctcgaaagcgcggccacattagccctaagtctaggccaatggctaatagcacactgctggggttgctggccccccccggtgaagcctggggcattctaggacagcctcccaacagacccaatcactcaccacctcccagtgctaaagtgaaaaaaatctttggatggggagatttctattcaaatatcaagaccgtcgccctgaacctgctagtgacaggtaagattgtcgatcatgggaatggcacattttctgtgcattttcagcataatgcgacgggacaaggaaacatctctatttccctagtccctcccagcaaggccgttgaattccatcaggagcagcagattttcatcgaggcgaaggcctcgaagatttttaactgtaggatggaatgggagaaggttgagcgggggagacggacttccctgtgcacccacgatccggcgaaaatctgttcccgcgatcatgctcagtcctcagcgacatggtcgtgctctcagcctttcaaggttgtttgtgtttatattgcattctattccacagactatcgcctcgtacagaaagtgtgccccgattacaactatcacagcgacactccatattaccccagcggttag

SEQ ID NO: 5487 - DNA, 555 bp, Artificial Sequence
  Description of Artificial Sequence: Synthetic coding sequence
atgaaaattcttgtcgcattcctcgtagtgctgacgatcttcggcatccagtcccacggctacgaggttttcaatataataagtccctcaaacaacggtggcaatgtgcaggagacggtgactatcgataacgaaaaaaacaccgcaattattaacattcatgcgggatcatgcagtagcaccaccatcttcgattataaacatggatacatcgccagtcgcgtactgagcagacgcgcctgcttcatcctgaagatggatcaccagaacatccctcctctgaataatctccaatggtatatctacgaaaagcaggcacttgacaacatgttctcatcaaagtatacatgggtgaagtataaccccttggagtcccttattaaggatgtcgattggttcctcctgggcagcccaatagagaaactctgtaagcatatcccgctgtataagggcgaggtggtggagaatactcataacgtcggcgctggaggctgtgcaaaggccggcctgctgggaatcctcggaatctcaatttgtgctgacatccacgtatag

SEQ ID NO: 5488 - DNA, 651 bp, Artificial Sequence
  Description of Artificial Sequence: Synthetic coding sequence
atgggggccgttatgggtacattcagcagcctccagaccaagcagagacggccttcaaaagataagattgaggatgaactcgagatgaccatggtttgccatagaccggagggtcttgaacaactggaggcccagactaactttactaaaagggaactgcaggttctctaccgcggctttaagaacgagtgcccatctggggtcgtgaacgaagacactttcaaacagatctacgcgcagttctttcctcacggagatgcttctacatacgcacattatctctttaacgcctttgacacaacgcagaccggttccgttaagttcgaggactttgtcaccgcgctgtctattctgttacgggggacagtgcatgaaaaacttaggtggacatttaacttgtacgatattaacaaagatgggtacatcaacaaagaggaaatgatggacattgtcaaagcaatatatgatatgatgggtaaatatacttatccggtcctaaaagaggacactccccggcaacacgtggacgtcttttttcagaaaatggacaaaaataaggacggtatagtgacgctcgacgagtttctggagtcttgtcaggaggacgataacataatgagaagccttcaactcttccaaaacgtcatgtag

SEQ ID NO: 5489 - DNA, 2736 bp, Artificial Sequence
  Description of Artificial Sequence: Synthetic coding sequence
atggcacagttgtttttacctttgctggccgccctggtgctcgcacaagccccggccgccctcgctgacgtccttgaaggtgactctagtgaggatcgcgcatttcgggttcggatcgccggggacgcccctctgcagggagttctgggaggagctcttactatcccgtgccatgtacactacctccgaccccctccgtcaagacgagctgtgctgggttcccctcgggtcaagtggacctttctctccagaggccgggaggctgaggtcttagtggctcgcggggttagggtaaaagtgaatgaggcgtatcggttcagagtggccctgccagcttatccagccagtctgacagacgtgtctttggctctgagcgaactgcgccctaacgattcaggcatttacagatgcgaggttcagcacggtatcgacgactccagtgatgcagtggaagtcaaagtcaaaggcgtggtgtttctgtatcgggaaggcagcgcaaggtacgctttttcattcagtggagcccaggaggcttgcgccagaataggggctcacatcgccaccccggagcagctttacgccgcctatctgggaggctacgaacagtgcgatgcagggtggctatccgaccagaccgtacgctacccaatacagacaccccgtgaagcctgctacggagacatggacggcttcccaggtgttcggaactatggagtggtagaccctgatgatctctacgatgtctactgttatgctgaagatctcaacggggaattattcctgggcgacccacccgagaaacttacactcgaggaggcccgcgcgtactgccaggaacggggagcggaaatcgctacgaccggtcaactctatgccgcttgggacggggggctggatcattgcagcccgggctggctggccgatgggtccgtcaggtaccctattgtgacccctagccagagatgcggcggcggactgccaggcgtcaaaaccctgttcctcttccctaaccaaacgggctttcccaataaacattctcggtttaatgtttactgttttagagactctgcacagccttccgccattcccgaggcctccaaccccgcaagtaacccagccagtgacggtctggaagccatcgtgacggtcactgagactttggaagagctgcaactgcctcaagaggctaccgagtccgagtctcgaggggctatctacagtattcccatcatggaggacggaggcggtggaagctccaccccagaggaccctgcggaggctcctaggactcttctcgaattcgaaacacagtctatggtgccacccaccggtttctcagaggaagaaggcaaggcgctagaggaagaggagaagtatgaggacgaggaggagaaagaggaagaagaagaagaggaggaggtggaggatgaggcgctctgggcctggccaagcgagctcagttcccccggacccgaggcatctctccctaccgagccggctgcccaggaggaaagcctgtcacaggcacccgcacgcgcagttttacagcctggagcctcccccctgcctgatggcgagtctgaagcatcccggccgccgcgcgttcacgggccgccaaccgaaaccctgcctactcctcgtgagaggaacctcgcctccccttctccgtctacgcttgtagaggcccgcgaggtcggcgaggcaaccgggggaccagagctctctggcgtaccccgcggcgagagcgaagagaccggaagtagcgagggggctccctctcttctgccagcgactcgggcacctgagggaacgcgagagctcgaggccccttctgaggataattcgggaagaactgcacctgcaggtacaagcgtgcaagcacagccggtactgccaacggattccgcctcccgtggcggggttgctgtggtcccagccagcggagactgtgtgcccagcccttgccataatggaggaacctgtcttgaagaagaagaaggcgtgcgctgcctctgcctgcccggatacggcggcgatttgtgcgacgtgggactgcgcttttgcaatccgggatgggacgcctttcagggagcctgttataagcacttctctacccgccgctcatgggaggaagccgagactcaatgtcggatgtacggcgcacacctggcgtcaattagcacccccgaggaacaagattttattaacaatcgttatcgggagtatcagtggattggtctgaatgataggacgattgagggtgactttttgtggagtgacggcgttccgctgctctatgagaattggaatcccgggcagcccgatagttattttttgagtggagaaaattgcgttgtaatggtgtggcatgaccaggggcagtggtctgacgtaccctgtaattatcatctttcatacacatgtaagatgggtctcgtttcttgtgggcctccaccggaactaccgctggcccaggtgttcgggagaccacgtcttcgctacgaagtggacacagtcctgaggtatcgctgtcgagagggactggcccagcggaatctgcccctgattaggtgccaagagaacggaagatgggaagctcctcagattagctgcgtgccgagacggccggcaagagccctgcacccggaggaggatccggaaggacgccaagggcgcctgttaggacgatggaaagcccttttaattcccccttcgtcacctatgcctggcccctag

SEQ ID NO: 5490 - DNA, 852 bp, Artificial Sequence
  Description of Artificial Sequence: Synthetic coding sequence
atggggttgggactgcgcggatggggtagacctctcctgacggtagccacggccctgatgctcccagttaaacctccagcgggctcgtggggcgcgcagataatcggaggacatgaagttacccctcacagtcgcccatacatggcctcagttagattcgggggtcagcatcactgcgggggttttctgttgagggccaggtgggttgtgtcagccgcccactgtttcagtcaccgcgatctccgtacagggctggttgtgctaggggcacacgtgcttagcacggccgagccgacccagcaagtttttggcattgatgcacttaccacccaccctgactatcacccaatgacccatgctaatgatatttgcctgctaagactaaacggcagcgctgtgctgggtccggcagttggtctgttgagaccaccagggaggcgagctcgaccacccactgccggcacccggtgccgtgtagccgggtggggcttcgttagtgacttcgaggaattgcccccagggctgatggaggctaaggtgcgcgtcctggatcctgatgtgtgcaattctagttggaaagggcatctcactttgactatgctgtgcacaaggtctggagactctcatcggcgaggcttctgcagcgcggattccggagggccacttgtatgccggaatcgggcccacgggctggtttcttttagcggcttgtggtgtggcgacccaaagactccagatgtttacacgcaggtcagtgcattcgttgcctggatttgggatgtggtgcgccgttcttccccccaacctggccctttgccaggtaccacgcgcccacccggagaggctgcttag

SEQ ID NO: 5491 - DNA, 1209 bp, Artificial Sequence
  Description of Artificial Sequence: Synthetic coding sequence
atgatggttgcccttaggggcgccagcgctctcctcgtgctatttctggcggcatttctgccgccgccacagtgtacacaggatcccgccatggtgcattatatttaccagagattccgggtccttgagcagggcctcgagaagtgcacccaggcaacacgcgcttatatccaggagttccaggaattctccaaaaacatcagtgtcatgctcgggcgttgccaaacctatacatctgagtacaagtcagcagtgggaaatctggcacttcgggtggagagggcgcagagggagatagactacatccagtacctgcgcgaagccgatgaatgcatcgagagcgaagataagacgctcgccgaaatgctgctacaggaagctgaagaggagaaaaagatcaggactttactgaatgcctcatgtgacaatatgcttatgggcatcaaatctctgaaaatcgtgaaaaagatgatggacacacatgggtcatggatgaaggacgccgtctacaattccccaaaagtatacctgctaattggctctcgtaataacaccgtctgggaattcgccaacatccgcgcattcatggaggataataccaagccagctccgcgcaagcagatattgacattgtcctggcagggtacaggtcaggtaatatacaagggatttctgttttttcataatcaggccacatctaatgagatcattaagtataacttgcagaagcgaacggtcgaggaccgcatgctcctgcccggcggggtgggcagagccctcgtgtatcaacattctccttctacatacatcgacctggctgtggacgagcacgggctttgggcaattcactctggcccagggactcactcccacctggtgctgacaaaaatcgagcctggtacgctcggagtggagcactcctgggacactccttgtcgttcccaggatgctgaggcttcctttctgctgtgcggggtactgtatgtggtctattcgaccgggggacagggcccacatcgtattacctgtatctatgacccactagggactatctccgaagaggatctccccaacctcttcttcccaaaacgtcccagatcccacagcatgattcattacaacccccgcgacaagcagctgtatgcctggaacgagggtaatcagataatttataaattgcagacaaaaaggaagttaccccttaaatag

SEQ ID NO: 5492 - DNA, 1221 bp, Artificial Sequence
  Description of Artificial Sequence: Synthetic coding sequence
atgcagctgttcctcctgctttgtttagtgctgttaagcccacagggagcctctctgcacaggcaccatccccgagaaatgaaaaaacgtgtggaggatctgcatgtgggtgctacagtggcccccagcagcagaagagactttacattcgatctctatagggccctagcctctgccgccccgtctcagtccatcttcttctctccggtttccatttccatgtccctggccatgctgtctctgggagcagggtctagcaccaagatgcagatactggagggcctgggcctgaatctccagaagagtagtgagaaagagctacacaggggtttccaacaactgcttcaggaactcaaccagcccagagatggttttcagctgtctttgggcaatgccctttttacagacttagttgtcgacctgcaggatacgttcgtttcggcgatgaagacgctgtacctcgctgatacctttccaactaatttccgcgactcagcaggagccatgaaacagattaacgactatgttgcaaaacaaactaagggaaaaatcgtggacctcttgaaaaacttagactcgaacgcggtggtgatcatggtaaactacatattcttcaaagccaagtgggagacaagcttcaaccataagggtactcaggagcaagacttctacgttacctccgagaccgtggtccgggtacctatgatgtctagggaagatcaataccactatctactggacagaaacctctcctgtcgggttgtgggggtgccctatcagggcaatgccacagcactattcattctaccttcggaaggcaagatgcagcaggtggaaaatggactgtcggagaagacgttgcgcaagtggctgaaaatgtttaagaaacgacaactcgagttgtatttgccaaagttttctattgagggctcttaccagcttgagaaggtcctgccctcactcgggatctcaaatgtctttaccagtcatgctgacctcagcgggatctcgaaccacagtaacattcaagtatccgagatggtgcataaggcagtcgttgaggtagatgaatctggaactcgcgcagccgcagcaacgggtactattttcacgtttcgctccgctaggttgaattcacagcgactcgtgtttaatcgacctttcctgatgttcatcgtggacaataacatactcttcctcggaaaagtaaacagaccatag

SEQ ID NO: 5493 - DNA, 1626 bp, Artificial Sequence
  Description of Artificial Sequence: Synthetic coding sequence
atgcggctttctccctttcatttacagctcgagttccatatgaaagagaaaagagaggacctgcagattagttggagcttcatctccgtgcccgagatggccgtgaatatccaacccaaagccctgggagaagatcaggtcgccgaaacatcagcgatgtcagatgtgctgaaggacattctaaagcacctggccggtagcgcatccccaagtgtggtcctgataactaaaccaacaaccgttaaagaggcccagaacctacagtgtgccgcgtctacggcgcaggagtcatgccctccaaaacctccgagggcgcacgagctgaaactgctcgtccgcaatattcacgtgctcctgctcagcgaaccgggagcttctgggcatatcaacgcagtatgtgtagtgcagctcaacgaccctgtgcagagatttagcagcacgctcactaagaataccccagacctcatgtgggaggaggaatttaccttcgagctcaacgctaaatctaaagaacttcacttacaaattagtgaggctggaaggtccagcgaaggcctcctagccaccgccacagttccactggacctattcaagaagcagccgagcgggccacaatcatttacactcacgagtgggagcgcctgtggtagctccgtgcttggctcagttaccgcagaattctcctacatggagcccggcgagctcaaatcatggccaatccctcccccggtaccagcggcaaaaattgaaaaagacaggacagtcatgccctgcgggacagtagtcacaacggtcaccgcggtgaagacaaagcctcgcgtggatgtggggagagccagcccactgtctagcgatagcccggttaagacacctatcaaggtcaaggttatagagaaagacattagcgtccaagctatcgcttgccgaagcgcaccggtgagtaagaccctgtcctctagtgacacggaattactggtattgaatggcagcgaccctgtggccgaggtggctattcgccagctgtctgaatcctccaaattgaagctaaaaagccctagaaagaaatctactatcataatttccggaatctctaagacctcactgtctcaagaccacgacgccgcccttatgcagggatacactgcttccgtggatagcacccaccaggaagacgcaccctcacatcctgaaagggcagctgcttctgcaccccccgaggaggcagaatcagcacaggcaagcctggcccccaagccgcaggaagacgagctggactcatgggatctcgaaaaggaaccacaggctgcagcctggtcaagccaagtactccttgatccagacggtgatgagctaagcgagtctagcatgtcggtgctggagcccggcactgccaaaaagcacaaaggaggaatacttcgtaagggagcgaagctcttctttaggagacgtcatcagcagaaggatcccggcatgagccagtcacacaacgatctggtgtttctagaacagccggaaggcagccggcggaagggtatcacacttactagaatcctgaacaaaaaactcctctcacgtcaccggaacaaaaacaccatgaatggcgcaccagtagaaccatgcacatag

SEQ ID NO: 5494 - DNA, 993 bp, Artificial Sequence
  Description of Artificial Sequence: Synthetic coding sequence
atggctttccttccaagctgggtgtgcgtcctggtgggatcctttagcgcgtccctggctggtacttctaacctgtctgaaaccgaaccccctctgtggaaagagtcccctggacaattgtctgactacagggtcgaaaactccatgtacattataaatccctgggtctacctcgaacgaatgggcatgtataaaattatactgaaccaaaccgcaagatattttgccaagtttgccccagataacgaacagaacattctgtggggtctgcccctccagtatggatggcagtatcgcacgggccgcctcgccgatccaacaagacgcaccaactgcggatatgaatctggcgaccacatgtgcatttctgtggatagttggtgggcagacctgaactactttttaagctcgttgcccttcctggcggccgtcgacagtggcgtgatggggatttctagtgaccaggtacggctacttcctcccccgaaaaacgagcgcaagttttgttacgacgtctccagttgcaggtcttcctttccggagacaatgaataagtggaatacattttatcagtacctgcaatccccattcagtaaatttgatgacttgctaaagtacttgtgggccgcacacaccagtacgctggctgataacatcaagagtttcgaggatcgatatgattactactccaaagccgaagcacactttgaaaggtcttgggtactggccgtagatcatttggcggccgtgctatttccgaccacattgatacggtcgtacaaattccagaaagggatgcccccccgcatcctgctgaatactgacgtggcaccattcattagtgactttacagcctttcaaaatgtcgtgctggtactgctcaatatgcttgacaatgtggataaatcaattggttatctgtgtactgagaagtccaacgtgtaccgagatcactcagagtccagcagtcggagctatggcaataatagttag

SEQ ID NO: 5495 - DNA, 813 bp, Artificial Sequence
  Description of Artificial Sequence: Synthetic coding sequence
atggactcactggaatggaactgggcactggtctacgagctgagcggcgaacaccacgatgaagagtggagtgttaagacctaccaagaagtggctcagaagtttgtggaaacgcacccagagtttattggaattaaaatcatttattctgatcatcgttccaaggacgtggcagttatagctgagtcgattcgcatggctatggggcttcgcattaagttcccaacagttgtggccggtttcgatctcgtgggccacgaggacactggacactccctgcatgactacaaggaagccctgatgatcccagccaaagatggcgtgaaactgccttacttcttccacgccggcgagacagactggcagggaaccagcatcgataggaacatcctcgatgcactcatgctgaacacaacaagaattggtcacggatttgccctgagtaagcatccggcagtacggacctatagctggaaaaaagatattcccatcgaggtgtgccccataagtaatcaagtcctcaagctagtgtcagatttacgtaatcacccggtggctacattaatggcaaccggacatcccatggtgatctctagcgatgaccccgcaatgttcggggcgaaaggcctaagttacgatttttatgaggtcttcatggggatcggcggcatgaaggctgacttgagaactttgaaacagctagcaatgaactcgattaaatattctacactgctggagtcagagaaaaacactttcatggagatttggaagaagaggtgggacaagttcatcgccgacgtcgcaacaaagtag

SEQ ID NO: 5496 - DNA, 939 bp, Artificial Sequence
  Description of Artificial Sequence: Synthetic coding sequence
atgggcgtgatggctatgttaatgctgcctttgctcttactgggaatcagtggactcctcttcatttaccaggaagtaagtaggctatggtctaaatcagcagttcaaaacaaagtagtggtgataaccgatgctatcagtggcctcggcaaggaatgcgccagagtctttcacaccgggggcgcccgcctagtgctgtgtggaaagaattgggagaggctggaaaacttgtatgacgccctgatttccgtggctgatccgtcgaagcagacattcacaccaaaactcgtgttgttagacttaagcgacatcagctgtgtgcccgacgtcgctaaggaggtgctggattgttatgggtgtgtagacattctcataaacaatgcttcagtgaaagtgaaagggcctgcccataagatctccctagaactggataagaagattatggatgccaactacttcgggccaataacactgaccaaggcactactgcctaatatgatctctaggaggaccggccagatcgttctggttaataacattcagggaaagttcggaatcccttttcggaccacatatgccgcttccaaacacgctgcattgggatttttcgactgtctgcgcgctgaggtggaggaatacgatgttgtcatctccacagtgagtccgacttttattagaagctatcatgtataccctgaacaggggaactgggaagctagcatctggaaattttttttcagaaaactaacatacggcgtccaccccgttgaggtggcagaggaagtgatgcgcactgtaagacgaaagaaacaggaggtctttatggccaacccaattcctaaagccgcggtctatgttcggactttttttcccgaatttttcttcgctgttgtggcctgtggggtgaaggagaaactgaacgtgcccgaggaagggtag

SEQ ID NO: 5497 - DNA, 738 bp, Artificial Sequence
  Description of Artificial Sequence: Synthetic coding sequence
atggcctccaccgcccttctggcactgtgctccactggagcgttcagtggactcgccgtcgaggcaggagctggcgtttgtcacgctacccctatatacgcaggacactcctggcaccaagctacttttagactaaatgtggcagggagcacgctatccaggtacttaagggatttattggtggccgcgaaccctgacctcctgcagcaggcccttccacgaaaagcgattacacatctgaaaaaaagaagttgttacgtgagtttagacttcgagggtgacctgagagatcccgcacgtcatcatcccgcttcttttagcgtgggtaatggatgctgtgtgtgcctctccagcgaaagatttcgctgccccgaaccaatcttccaacccggcctcctggggcaggctgagcaaggcctgcccgctctggcttttcgggcactgcagaagatgcccaaaacactccgaactcgcttggctgacactgtggtccttgccggagggagcaccctgtttcctggttttgccgaacgtctggacaaggaattagaggcacagtgcagacgtcatgggtatgcagctctgcgtccccacctggtggccaagcatggccgcgggatggctgtttggacagggggaagtatggtggcatccctacactcatttcagagacgctggatcacacgtgctatgtaccaggagtgcggatctcgtctgctttacgatgtgtttaactag

SEQ ID NO: 5498 - DNA, 909 bp, Artificial Sequence
  Description of Artificial Sequence: Synthetic coding sequence
atgagaagatgggcgtgggcagccgtagtagtgctactcggcccgcagctggttctccttggaggtgtgggtgcccgccgcgaggcccaacgcacgcagcaaccaggacagagggccgatcctccaaacgccacggcaagcgcctcctcccgcgagggcctgccggaagctcctaaaccctcacaggcgtccggccccgaattcagcgatgcgcacatgacatggctgaatttcgtgcgtcgtcctgacgacggggctttgcgcaaacggtgcggctctcgcgataagaagcctcgagacctttttggcccacccggcccccccggggccgaggtcaccgccgaaacactcttgcacgaatttcaagaactgcttaaggaggctaccgagcggagattctcaggcctgctggatccactgcttccacagggagccgggctgcgcctggtgggcgaagcattccattgtcgcctgcaggggccgcgccgggtagacaagaggacactcgtggagctgcacggcttccaagctcctgctgcacagggtgcctttctcagagggtccggtctctcattggcctccgggcggttcaccgctccagtttcaggcatttttcaattttccgcaagtcttcatgtagaccactccgagctgcagggaaaagctcgcctcagggcgcgcgacgtggtttgtgttttaatttgtatcgagtccttgtgccagcgccacacatgcctcgaggcagttagtggattggagagtaactcaagagtgtttacattacaggttcagggcctactgcagttgcaagccggacagtatgcctccgttttcgtcgataacgggtcaggagcagtacttactatccaggcaggatcctcgttcagcggactccttctgggtacttag

SEQ ID NO: 5499 - DNA, 1416 bp, Artificial Sequence
  Description of Artificial Sequence: Synthetic coding sequence
atggattctgctccccttttccctagaccacatctcttccagaatttgctgctttttctgtgggccctcctcaattgcggactgggagtgtcagcgcaggggccaggtgagtggaccccctgggtgtcatggacacgctgttcttcctcatgcggcaggggggtctccgtgagatcccggagatgtttacgactgcccggtgaagagccttgctggggtgattcacacgagtatagattgtgccagttaccggactgcccgcctggcgcggtgccattcagggacctgcaatgtgccctgtacaacggacgaccagtcttggggacccagaagacataccagtgggtgcccttccacggcgcacccaaccagtgcgacctgaattgcctggctgagggacatgccttttaccattcttttggccgggtgcttgatggcacagcttgtagtccaggagcacaaggggtctgtgtggccggccggtgtctttcggcagggtgcgatggtctgctcggctccggcgctttggaggatagatgtggaaggtgcgggggcgccaacgattcatgcctgttcgttcaacgggtgtttcgcgatgccggagcattcgctggctattggaacgttactctgatccccgaaggagcaaggcacatccgggtggaacaccgaagccgtaatcatctggctttgatgggtggggacggaaggtacgtactgaatggtcactgggtagttagccctcccggaacctatgaggccgcaggcactcacgtggtctacacacgcgacaccggccctcaggaaactctccaggctgctggccctacttcccacgacttgttgctgcaggtgctgttgcaagagcccaatcccggcatcgagttcgaattttggctaccccgtgagcggtacagtccgttccaggccagggtgcaggcattaggctggcctctgcgccagcctcagccccggggggtggagcctcagcctccagccgctcctgcagtgacgcccgcccaaacccccaccctggcaccagacccttgtcctccatgtccggatacacgggggcgagcccacagactcttgcactactgcgggagtgatttcgtctttcaggccagagtgctcggacaccatcaccaggcccaggaaactcgatatgaggttagaatccagcttgtgtacaaaaaccgaagtcctctgagggctcgcgaatacgtgtgggctccgggccactgtccatgtccgatgctggcccctcaccgggactacctaatggcagtgcagcgcttagtttcacccgatggaacccaggatcaactgctgttgccacacgccggctatgcccgcccatggagcccagccgaggactcacgaatccgactgacagcccggaggtgtcccggctag

SEQ ID NO: 5500 - DNA, 222 bp, Artificial Sequence
  Description of Artificial Sequence: Synthetic coding sequence
atggcacctcaaaccttgttactggtcctagtgctgtgtgttctacttctccaggctcaggggggctacagagataagatgaggatgcagcgaatcaaagtttgcgaaaaaagaccttccatcgatttgtgtatacaccactgctcttacttccaaaaatgcgagaccaacaagatttgttgtagtgccttctgcggaaacatctgcatgtccatcctatag

SEQ ID NO: 5501 - DNA, 2349 bp, Artificial Sequence
  Description of Artificial Sequence: Synthetic coding sequence
atggcacgggcgcgggccggcgcgttattggcattgtgggtgctgggcgcagcggctcatccccagtgtctggactttaggcctcctttcagaccaactcagccgctgcgcctctgcgctcagtactcagacttcggttgctgtgatgaggggcgcgatgcagagctgacaagacgattctgggctctcgcatcccgcgtcgacgctgctgagtgggccgcttgtgcaggttacgcgagagacctcctatgccaggagtgttccccctatgccgcccacctgtatgatgccgaggacccgtttacaccgctccgcacagttcctggcctctgtcaggattactgcctagatatgtggcataagtgtcgaggactattccggcacctgtctactgaccaggaactgtgggccctcgaagggaatctggcccgtttctgccggtacctatcactggacgacaccgactactgtttcccatacttgcttgtgaacaagaatcttaactccaatctgggacatgtagtggcagacgccaaaggatgcttgcagttgtgtttggaggaggtcgcgaatggcctgcgaaatcccgttgctatggtgcacgccagggacgggacccacagatttttcgtcgcagagcaggtgggattagtctgggcttatttacccgaccggagcagactgggcaaaccattcctcaacatctctcgggtcgtgctgacaagtccctgggagggagacgagagggggttccttgggattgccttccatccatcgtttcagcacaatcgtcggctgtacgtctactatagcgttgggattaggagttccgagtggattcgaatcagcgaatttcgtgtgagtgaggatgacgaaaatgcagtggatcactccagcgaacgaatcatactggaagtaaaagaacccgcctcaaatcacaatggcgggcagcttctttttggggatgacggatatctttacatatttaccggtgacggtggaatggctggcgaccccttcggaacctttgggaatgcccagaataagagtgcgcttctgggtaaggtcctccgaatcgacgttgaccggaaggaaaggggcctcccttatggaatcccacctgataacccttttgtgggtgatccagccgctcaacccgaggtctacgccttgggtgtccggaacatgtggaggtgtagctttgacaggggagatccatcttctggaacagggcgaggaaggcttttttgtggggacgttggacagaacaagttcgaggaggtggatgttgtggagagagggggcaactacgggtggagggccagagagggatttgagtgctacgacaggtccctgtgcgccaacaccagtttaaacgatctcttgccaatcttcgcctatccacacacggtaggaaagtccgtgactggggggtacgtctatcgcgggtgtgaataccccaaccttaatggcctgtacatcttcggagactttatgtctggaaggctgatgagcctccaagagaatccgggaaccgggcagtggcagtactctgaaatctgcatgggacatggtcagacctgtgaattccctgggctgattaacaactactatccttatatcataagttttggagaggatgaagccggcgaactatattttatgtctacgggtgagccttctgctacggctcccaggggcgtcgtgtacaagattatcgacgcaagccgccgggccccccctggcaagtgtcagatccagcctgcccaagtgaaaatccgcagccggctgattccctttgttcctaaggagaaattcataccaaagacccgctctacaccgcgccccacggcaagagccccgacaagagcacctcgaagaggacgtccgaccgccgcacctccagccccaacccctaggcctgcacggcccacacagcagcccggatcgcgccgtggaggcggcagaaggagaggtcgccttaatagtgcgtctcgggctttcagagatggagaggtgcgactggttcgtccagccggattatcttccggtagcggccgggttgaagtgttcgttggggggcgatgggggaccgtctgcgatgattcctggaacatatctggagccgcagtggtctgtcgccaactgggcttcgcttacgcggtgagagctgtcaagcgtgctgagtttggacagggaggctcattgcctattcttcttgacgatgtgcgatgtgccggctgggaacgcaacctcttggaatgtcagcataacggggtcggcactcacaattgcgaacacgacgaggacgcaggggtggtgtgcagtcatcagaaccccgatctgtag

SEQ ID NO: 5502 - DNA, 1317 bp, Artificial Sequence
  Description of Artificial Sequence: Synthetic coding sequence
atgcatcccctgccgggctactggagctgttactgcttattactactgtttagtctgggtgtgcaggggagtcttggggcccctagcgccgcccctgaacaggtgcacctgtcttacccaggcgagccgggatccatgacagttacttggacaacttgggtacctacacgcagcgaagttcagttcgggctgcagccatccggacccctgccactccgcgctcagggaacgttcgtcccatttgtcgatggaggaatcctgcgccggaagctgtatatacatcgggtcacattaaggaagctgctgccaggagttcaatacgtataccggtgcggaagcgcccaaggctggtcgcgccgattcagatttagagcactcaagaatggggcgcactggtccccgaggctggctgtctttggagatttgggtgctgacaatcccaaggctgtgcctagacttcgtcgcgacacgcagcaggggatgtatgacgcagtactccacgtcggcgactttgcctataacttggaccaggacaacgccagagtcggtgaccggttcatgagactcatagaaccggttgctgctagtttaccatatatgacatgccctggaaaccacgaggagaggtataatttcagcaactacaaggcgcggttttctatgcctggggataacgaggggctctggtactcctgggatctcgggccagctcatattatttccttctctactgaggtgtacttttttctgcattatggtaggcacctggttcagcggcagtttcgctggctggagtctgatttacaaaaagctaacaaaaatcgggccgcaagaccttggatcattacaatgggccataggccaatgtactgctctaacgccgaccttgacgactgcacacggcatgaatccaaggtgagaaaagggctgcaaggcaagctgtacggcctggaggatctgttctacaaatacggagtcgatctacagctttgggcacacgaacactcttacgaaagactgtggccaatttataattaccaagtgttcaatggcagccgggagatgccttacacgaatcctagggggcccgtccacattattactgggagcgccggatgtgaagaaagattgaccccctttgctgtctttccgaggccttggagcgctgttagggtaaaagagtacgggtacacccgcctgcatattctcaacggtacccatattcacatccagcaagttagcgatgaccaggatggtaaaatagtggacgacgtgtgggtagtacggccgctgtttggccgccgaatgtacctatag

SEQ ID NO: 5503 - DNA, 411 bp, Artificial Sequence
  Description of Artificial Sequence: Synthetic coding sequence
atggcaaggacaaagcagaccgcccgcaaatcaacaggtggcaaggcacccaggaagcaactggcaaccaaagcagcacgaaagtcggcaccggccaccggtggtgtcaaaaagccgcaccgctatagaccggggaccgtggcacttcgagaaattcgcaggtatcagaaaagtaccgaactgttgattcgcaagctgcccttccaaaggctcgtgcgcgagatagcacaagacttcaagactgacttacgtttccagtcgagcgcggtaatggcgctacaggaagcttccgaggcatatctggtggggcttttcgaggatacaaatctttgcgccatccacgcgaaacgtgtcactatcatgcctaaagatatccagcttgctaggaggatccggggagagcgcgcctag

SEQ ID NO: 5504 - DNA, 1209 bp, Artificial Sequence
  Description of Artificial Sequence: Synthetic coding sequence
atggccgctaggcctggacctctctggctcctgggactgacgttgtgcgctctgggaggcggagggcccgggctgcggccaccccccggctgtccccaaagaagactgggagcccgcgaaaggcgggacgtccaaagggagatcctggccgtcctgggcttgccagggcgacctagacctagggcaccccccgctgcttcccggttgcccgccagtgctcccttattcatgctcgatctctaccacgccatggcaggggatgatgacgaggacggagctcctgccgaacaacggctcgggcgggctgacttggttatgagctttgtgaacatggttgaaagggatcgagctctgggccaccaagagcctcattggaaagagtttagattcgatctgacacagatccctgcgggcgaggctgttacggcggccgaatttaggatttacaaggtgccaagcatacacctcctcaaccgcacactgcacgtttccatgttccaagtggtgcaggaacaaagcaatagagagagcgacctgtttttcctggacctccagacacttagggccggggacgaaggatggcttgtgcttgatgtgactgccgccagcgactgctggctgctaaagcgacacaaagatctcggactgcggctttacgtggagacggaggatggtcattctgttgaccccggtctcgctggactacttggacaaagggcgcccagaagtcaacagcctttcgtggtaaccttcttcagagcctcaccaagtcccattaggaccccacgcgcagttaggccgctacggcgaagacaaccaaaaaagagcaatgaactgccccaggcgaaccggcttcccggaattttcgatgatgtgagaggttcgcacggacggcaggtttgccggaggcacgagctgtatgtttcttttcaggatttgggttggcttgactgggtgattgccccccaaggctactctgcttattattgcgaaggggagtgctcatttcccttggatagctgcatgaatgcaactaatcacgcgatcctgcagagcctggttcatctgatgaagccgaacgcagttcctaaagcttgctgcgcacccacaaaacttagcgccacaagtgtgttatattatgatagctctaataacgtgatcctgaggaagcatcggaatatggtcgtgaaggcctgcgggtgtcattag

SEQ ID NO: 5505 - DNA, 957 bp, Artificial Sequence
  Description of Artificial Sequence: Synthetic coding sequence
atggccgctgcggccctgcccccgcgccctctgctgctgcttccactcgtgctccttctttccgggcgtcctacccgagctgactccaaggtcttcggagatctcgatcaagtccgaatgacctcagaggggagtgactgccgatgcaagtgcattatgcggcctctcagtaaggatgcatgttctcgtgtgcggagtggaagagcacgcgtggaagatttctatacggtcgaaacagtatcatcgggcactgactgccgctgttcatgcacagctccgcctagttccctgaatccttgcgagaatgaatggaagatggagaaactaaagaaacaggctcccgaacttctgaagagcattaaagcaaatctcagtagggagaacgaagtggttaaagactcagtccggcacctgagtgaacaactgcgtcattacgagaatcactcagcaatcatgcttgggataaagaaagagctgagtcggctagggctccagctgctgcagaaggacgccgccgctgcaccggcaacccccgctaccggaaccgggtcaaaggctcaagacacagcccgtggtaaggggaaggacatatctaagtacggctcagtgcagaaaagcttcgcagacagagggctgccaaaaccacccaaagagaagcttttgcaggtggagaagctgaggaaggagtcaggcaagggaagctttctgcaaccaacagctaagcctagagcgctggcacagcagcaggcggttatccgagggtttacttactataaagcaggtaagcaggaagtgaccgaggctgtggccgacaatactttgcaggggacctcttggttggagcagctacctcccaaagtagagggacgctcaaatagtgctgagccaaacagcgccgagcaggatgaggccgaaccaaggtcaagtgagcgggtagacctagcgagtgggacctag

SEQ ID NO: 5506 - DNA, 402 bp, Artificial Sequence
  Description of Artificial Sequence: Synthetic coding sequence
atggctttaggtgtgcccataagcgtgtaccttttgttcaatgcaatgactgccctgaccgaggaagccgccgtcaccgtcacgcctcccatcactgcacagcaggccgataacatcgaggggcctatagctctgaaatttagtcacctttgtctggaagaccacaactcctattgcattaacggggcctgcgctttccaccatgaactcgagaaggcaatttgcagatgttttactggatatacaggtgaacggtgcgagcatttgaccctcacctcctatgccgtggacagctacgaaaaatatattgccatcgggataggagttggtttgttactgtccgggtttctcgtgatcttctactgttacatccggaagcgctatgagaaggataaaatttag

SEQ ID NO: 5507 - DNA, 651 bp, Artificial Sequence
  Description of Artificial Sequence: Synthetic coding sequence
atgtctagtgaggccgagactcagcagccccctgcggccccacccgccgccccagcactgtcagccgccgataccaagcctggcactactggatccggcgccggctccggcggacccgggggactgacatctgccgcacccgccggcggcgataaaaaggttattgcaactaaggtgttgggaaccgtgaaatggtttaatgtccgaaacggatacgggtttatcaaccgcaacgacacgaaggaagatgtgtttgtgcaccagggggcggaagctgccaatgttaccggccccggcggtgtgcccgtacagggctcaaagtatgccgccgatagaaaccattatcggcgctatccaagacgtcggggcccaccacgaaattatcaacaaaactatcaaaacagcgaatcaggggagaagaatgaagggtctgaaagtgctccagaaggacaggcccagcaacgacgcccatacaggagacgtaggtttcccccttactacatgcggaggccctatgggagaagaccccagtattcaaatcccccagtgcaaggcgaagtgatggagggagccgacaatcagggcgcaggggagcagggaaggccagtgcgacagaatatgtaccggggataccggccaagattcagatag

SEQ ID NO: 5508 - DNA, 756 bp, Artificial Sequence
  Description of Artificial Sequence: Synthetic coding sequence
aacgattggtctgccgaccagttgtatttggaaacaacagggaaatcacggacattacagagcggactagctctcctatacggcttcctgccggatttcgactggaagaaaatatactttcggcatcagccatccgcactcttctgttcagggtcctgttactgtccagtacgtaaccagtatcttgaaaaggagcagagaaggcagtatttactgcgactgaaaaattcacagctcgagaaaacatatggggaaatggccaaaatcgtggacgtgcctactaaacagctgagagctgccaatccaatcgacagcatgctatgtcacttttgccacaacgtgtcctttccgtgcacgcgaaatggatgtgtggacatggagcatttcaaggtgatcaagacacaccagatcgaggacgaacgcgagcgacgggaaaaaaaactctactttgggtatagtctgcttggtgctcaccctattctaaaccaaactatcggtaggatgcaacgtgccactgaagggcggaaggaagaactgttcgcactatactccgcccatgatgtgaccctctcccctgtcctgtcagctctcggactttccgaggcacgctttccacgattcgcagctagagtaaacatcccatctggtttttttacgatggctagcatgtcccacagcactcctctatcagccaaaactaccacatccgtgctgccaagcccctgcgctcggctaaagacttggtccgctttgtag

SEQ ID NO: 5509 - DNA, 576 bp, Artificial Sequence
  Description of Artificial Sequence: Synthetic coding sequence
atggctgctccacgggggagagctgcaccatggactacagcgctcctactgcttctcgcatcgcaggtcctgtccccaggatcctgcgccgacgaagaagaggtaccagaagagtgggtcctccttcacgtggtgcaggggcagatcggggccggaaactacagttaccttagacttaatcatgagggcaagatcgtcctgcggatgcggagcctgaaaggtgacgcggacttgtatgtttcggcctcaagcctgcacccctcgtttgacgattacgaattacagtcagcgacctgtggacccgacgcagtgagcatccctgcccacttccgacgacccgttggaataggagtatatgggcacccgtctcacctggaatccgagttcgagatgaaggtttattatgacggtacagttgaacagcacccatttggggaagcagcttaccctgccgatggtgccgatgccggtcagaaacatgcaggggctcccgaggatgcctcccaggaagaggaaagtgttctgtggaccattctgataagcatccttaaactggttctggaaattctgttctag

SEQ ID NO: 5510 - DNA, 2301 bp, Artificial Sequence
  Description of Artificial Sequence: Synthetic coding sequence
atgggccgaagaaggctgttagtttggctgtgtgcagtcgccgcattactctcgggtgcccaggccaggggtaccccattgctcgcccggcctgctccccctggcgcctcacgatacagcctttataccacaggctggaggccccgcttaaggcccgggccgcacaaggctctgtgtgcgtacgttgtccaccgaaatgttacttgcattctgcaggaaggcgcagaatcctatgtgaaagctgagtatagacagtgccgctggggcccaaagtgccccggaacagtaacctaccgcaccgtgcttagacctaagtacaaggtggggtacaagactgtaaccgatctcgcttggaggtgttgccctggcttcactggaaagaggtgtcccgagcacctgaccgatcacggcgcagctagtccacagttagaacctgagccgcagatcccatctggccagctggatccaggcccaaggcctcctagctattcacgcgccgctcctagcccccacggtcgcaaggggcccggtcttttcggagagcggctggagcggctcgagggcgatgtccagaggttggcgcagacctacgggaccctgagcggactcgtcgcatcccacgaggatccgaacagaatgactggaggcccccgagctcctgctgttcctgtaggcttcggggtcattcctgaggggctagtgggaccaggagaccgagcgaggggcccgcttactccacccctggatgaaattctgtcaaaggttacggaggtgagcaataccctccagaccaaagtacagctgctggacaaggtacatggattagcattgggccacgaggctcatctgcagaggctgagggaagcccctccctccccattgaccagtctggcactcctagaggagtacgttgatcgaagattgcacaggctatggggaagtctgttagatggttttgagcagaaattacaaggcgtccagagtgagtgcgacctgagggttcaggaggtccggcgtcagtgtgaagagggacaggcggcctccaggagactgcatcagtctctcgacggcagagagctggcactgcgccaggaactttcccagctgggctctcaactccagggattgagcgtatctgggcgcggttcttgctgtgggcagcttgccctaatcaacgcaagaatggatggactggaaagggctctgcaggcagtcactgaaacccagcgaggcccaggggcacctgctggagacgaactcacgcgactgtctgcagccatgctggaggggggggtggacggacttctagagggccttgaaactttgaatggcacggagggaggagcaaggggctgctgccttcgcctggacatgggcggctggggagtcggtgggttcggcactatgctggaagagcgcgttcagtctttggaagagcgcctggccacgctcgccggggagctcagtcatgactccgcttctcctggccgcagcgcaaggccgctggtgcagaccgaattggcagtcttagaacaaagactggtgagcttggagacatcatgcactccctcaaccacctcagcaattttggacagtctagtcgctgaggtcaaagcgtggcaatcccgctctgaggcccttctgcgacaggtggcatcccacgcagcccttctacaacagctcaatggaaccgtggcagaggtgcagggacaacttgctgagggtaccggttcttcactgcagggggagattaccctgctcaaagtcaaccttaacagcgttagcaaaagtttaaccgggctgtctgattccgtgtcccagtatagtgacgctttcctggccgcgaatacctcactcgatgagcgcgagcgcaaagtagaagccgaggtgcaagccatccaagagcaggtgtcttcccagggttccagactccaggcaggtcacagacaggtgctcaacctgagaggcgagctcgaacagttaaaagccggggtggccaaggtagcaagcggactctctagatgccaggacaccgcacagaagctccagcataccgtgggccacttcgatcaacgcgttgcccaagtggagggtgcctgtcgtcggttagggctgctcgccgcgggactcgattcactgcctacagagcctctgagaccccgcgaggggctctggagccatgtggatcagcttaacaggacccttgcccagcatactcaagacatcgcaaggttgagggacgacttactggattgccaagcacagttggcagaacaggtgaggccaggccaggcgaactag

SEQ ID NO: 5511 - DNA, 1251 bp, Artificial Sequence
  Description of Artificial Sequence: Synthetic coding sequence
atgtacagacacggcatcagtagccagaggagctggcctctgtggaccaccatctttatcttcctcggagtcgctgccattctcggagtgacaatcggccttcttgtgcatttcctggctgtggaaaagacctattactatcaaggcgatttccacatatctggcgtgacatacaacgacaactgcgaaaacgctgcaagccaggccagtactaatctgtccaaagacatagaaaccaagatgctgaacgctttccagaactcctcaatatacaaggagtacgttaagtctgaggtcatcaagctgcttccaaatgccaatggatcaaacgtccagctccagctgaagtttaaatttcctcctgcagagggagtgtctatgcgcactaagattaaggcgaagttacaccagatgcttaaaaacaacatggcaagctggaatgccgtgccagcgagcatcaagcttatggagatctccaaggctgcctccgagatgcttactaataattgctgtggcaggcaggtggccaacagcatcatcacagggaacaagattgtcaatgggaagagtagtctcgaaggtgcctggccgtggcaggccagcatgcagtggaaggggaggcactactgcggtgcgagccttatctcctccagatggctcctgagtgccgctcactgttttgctaagaaaaataattccaaagactggactgtgaattttggaatagttgtcaataaaccgtacatgactagaaaagtgcagaatattatctttcacgaaaattacagcagtccaggcctgcacgatgatatcgccctcgttcagctggcagaagaggtttcattcaccgagtatatcagaaagatttgcctccccgaggccaagatgaaactctcagagaacgacaatgtcgtagttaccggttggggcaccttgtacatgaatggcagtttcccggttatcttgcaggaagattttttgaagataattgacaacaaaatctgcaacgccagttacgcctattcgggtttcgtgacggacacgatgctgtgcgccggctttatgagcggggaagctgacgcttgtcagaacgattctggcggccctttagcctatcccgactcacggaatatatggcacctcgtgggaattgtgtcgtggggtgacgggtgcggcaagaagaataaaccaggcgtgtacacacgcgtcacaagttaccgcaactggatcacttcaaaaacaggcttgtag

SEQ ID NO: 5512 - DNA, 639 bp, Artificial Sequence
  Description of Artificial Sequence: Synthetic coding sequence
atgctgagttccgttgttttttggggcctgatcgcgctcatagggacatcacgcggaagctatccttttagtcattccatgaagccgcacttacaccctaggctgtaccacggctgttacggagacatcatgacaatgaaaaccagtggggccacttgtgacgcaaactctgtcatgaactgcggaatccggggatccgagatgtttgccgagatggacttgcgggcaattaaaccttatcagacgcttattaaggaagtgggtcagcgtcactgcgtcgatccagccgttattgctgcaattatctcaagggagtctcacggcggatctgtccttcaggatggatgggatcatcgtggtctgaaattcggtctaatgcagctggataagcagacgtatcaccccgttggcgcatgggattccaaagaacacctctcccaggccactggtatccttacagagcggatcaaggcaattcagaaaaaatttcctacatggtctgtggcccagcacctgaaagggggtctgtccgcttttaagtccggaattgaagcaatcgccacgcctagtgatattgacaatgacttcgtgaacgacataattgcgcgcgcaaagttctataagagacagtccttttag

SEQ ID NO: 5513 - DNA, 378 bp, Artificial Sequence
  Description of Artificial Sequence: Synthetic coding sequence
atggcccggtctgctacccttgccgctgctgccctcgccctgtgtttgctgctagctccaccaggactggcctggtacaagccagcagccgggcatagttcttatagcgttggccgcgcggccggcctgctcagcgggctgagaagaagcccttacgctcggcgctctcaaccatatagaggcgccgaaccacccggcggagcgggagcaagccccgagctgcaactgcatccacggctgcgctctctggccgtatgtgttcaggatgtggcacccaacctgcagaggtgcgagcggctccctgacggccggggcacataccagtgcaaagccaatgtgttcctgagcctcagagccgctgattgcctggccgcatag

SEQ ID NO: 5514 - DNA, 867 bp, Artificial Sequence
  Description of Artificial Sequence: Synthetic coding sequence
atgaataatctatctttctccgagttgtgttgtctattctgctgccctccctgcccaggcaaaatcgccagtaagctggcatttctcccaccagaccccacctacacactgatgtgcgatgaatcaggtagcaggtggaccttacatctgagcgagagagccgactggcagtactcgtcccgagagaaagacgctatcgagtgctttatgacccggacttcgaagggaaatcgaatagcctgcatgtttgtgagatgttccccaaacgccaaatatactttgctgttttcccacggaaatgccgttgacctgggacagatgagctccttctacatcggcctggggtccagaatcaactgcaatatattcagttacgattatagcggttacggagctagcagcggcaagcccaccgaaaaaaacctctatgccgacatcgaagcggcctggctggctctccgaacccggtatggaatccggcccgaaaacgtgatcatctacggtcaatccattggcactgtaccgtcagtcgacctggcagcccgctacgaatccgcagctgtgatcctacattcacccctgaccagcgggatgcgggtagctttcccagatacaaaaaagacctactgctttgacgcttttcccaatatcgacaaaataagtaaaatcaccagtccagtgctgatcattcacggtacagaggacgaagtcattgacttctctcatggcctagctcttttcgagagatgccaacgaccagtggaaccactgtgggtcgagggagcgggtcacaatgacgtagaactgtatgggcaatatctggaaagactaaagcagttcgtcagccaggaactggtgaatctctag

SEQ ID NO: 5515 - DNA, 417 bp, Artificial Sequence
  Description of Artificial Sequence: Synthetic coding sequence
atggttgctccggcagccagggtgtttcttagggccgttagggctgccctgacatcgactgtgccggatctcctgtgtctgctggctagagggtcaccacggggactagcgtccggacgcttaccactcgcagtccactcagcgcagcacggccctggatcaggagcaccatggctgaggattgctagacgcgcgctgaggtttgtgttaagcaagcattggggggacgattgctacttgactaataggctttggcaggatctcaaaccaccgagtcacgtggaaaatggccaggagttgagactggcccccccagtccagtgggcactgcaagtgcagggcaaccagttgcagactgctgtgctctgtctacggatggcccccccagagcccgccgggtctcgacagagaatttag

SEQ ID NO: 5516 - DNA, 1332 bp, Artificial Sequence
  Description of Artificial Sequence: Synthetic coding sequence
atgggtggtccccgagcatgggccttgctatgtctgggccttcttctgcctggaggcggggccgcttggtccattggggcagcccccttctccggaagaaggaactggtgctcgtacgtcgtgacccgaactatcagctgccatgtgcaaaacggcacatacctgcagcgagtgctccagaactgtccgtggccaatgtcatgtccagggagctcataccgcactgttgtgcggcccacctacaaggtcatgtacaagatcgtgaccgcacgggagtggcggtgttgtcctggccattcgggcgtcagctgcgaggaagttgcggcatctagcgccagcctcgagcccatgtggagcggttcaacaatgcggagaatggcgttgaggcctaccgccttttcagggtgtctgaactgttccaaagtaagtgagcttaccgaaagacttaaagttctggaggccaaaatgacaatgctcacggtcatcgagcagcccgttcctccaacacccgccacccccgaagatccagcaccactctggggccctccccccgcccaaggtagtccgggtgacggcggcctgcaggaccaggtgggagcgtggggtctgccaggcccaactgggccaaagggtgatgccggttctagggggcctatggggatgcggggtccaccaggtccccagggcccgccaggctctcctggtcgcgctggcgcagtcggaacccctggagaacgcggcccccccggacctcctggaccacccggaccccccggcccacccgcccccgtcggcccccctcatgcgagaatttctcagcacggcgatccactgctgagtaatacattcacagagacaaacaaccattggccccagggccccaccggtcctcccggtccccccggtccaatggggcctcccggtccacccggtccgacaggtgtgcccggatctcctgggcacatcggacctccagggcccactgggcccaaagggatttccggccatccgggggagaaaggtgagcggggcctgcgtggcgagccaggcccccagggttcagcggggcagcgcggagagcccgggcctaagggcgatcctggggagaaatctcactggggtgagggactgcatcagttgagggaggcccttaagatccttgcagagagagtcctgatacttgaaacaatgatcggattgtatgagcctgagttgggtagcggagcaggacccgcaggtacagggaccccttccttactgcgtggaaaacggggcgggcacgcaactaattaccgaatcgttgccccgcggtcaagggacgaacgcggatag

SEQ ID NO: 5517 - DNA, 717 bp, Artificial Sequence
  Description of Artificial Sequence: Synthetic coding sequence
atggtgttactgttgctggtggccatacctctcctggtccacagttcgcgaggccctgcacattatgagatgttgggtcgctgccggatggtctgcgatccacatggccctaggggtcccggtcccgacggcgcaccggccagtgtgcctccattcccacccggcgccaagggcgaggtgggtagacggggaaaagccggtctgagaggcccacctggcccaccaggaccccgcggaccaccaggggaacctggacgcccgggacctccaggcccacctgggccaggcccgggtggcgtggctcctgctgccggctacgtgccgaggattgcgttctatgctggcctaagaaggcctcacgaaggatatgaggtattgcgctttgacgatgtggttactaacgttggcaacgcatacgaggccgcgtccggcaaattcacctgcccaatgcccggtgtttacttctttgcttatcatgttcttatgaggggtggcgacgggacttctatgtgggccgaccttatgaagaatggccaggtgagagccagtgccatcgcccaggacgccgatcagaattacgattatgcctcaaattccgtcatccttcacctcgacgttggcgatgaagtattcattaagctggacggtgggaaggtccatggtgggaatactaataagtactcgacgttcagtggctttattatttatcccgattag

SEQ ID NO: 5518 - DNA, 282 bp, Artificial Sequence
  Description of Artificial Sequence: Synthetic coding sequence
atgaaactgtttctggtgctgattattttgctcttcgaggtactgaccgatggcgcgcgactgaagaaatgctttaacaaggtaacgggatattgcaggaaaaaatgcaaagtgggcgagcgatatgagattgggtgtttgtccggaaagctctgctgcgcaaacgatgaagaagaaaagaagcatgtgtccttcaaaaagccccatcagcatagtggagaaaagctgtctgtgttacaggattacataatcctgcccacaatcactatctttaccgtttag

SEQ ID NO: 5519 - DNA, 609 bp, Artificial Sequence
  Description of Artificial Sequence: Synthetic coding sequence
atggtccggatctggactacgattatgattgtgctcatcctcctcttgcgtataggtccgaacaaaccaagtcttagtggcaggcaggcccctgctcaggcccaaacatctgatctggttccatctctgttcccgctggggttgtgggccccgggcttctgcacatggtccagccccgacgaggacaaggtatggaggcccgcatgggaacaaggccccaaaggagaaccggacccaaggggacttaggccgagaaagcctgtccccggaactgggaatcgcgattccggcactcgccgccggctgcaggacgccaccgaacaggatcccaggcctgggaatgatgtagcctccgccgagacagccggaccgcccagtccctcgggaattcgtgctcaggatcgagctccccgccaccggagagcaccgcctgcccggatgccagtcgctccggcaccctctgcagatggtgaacctctgcaagagcagggcggtggtctattccacaggaccagaagtgtgtacaacgggctggagcttaacacttggatgaaagttgaacggctgttcgttgagaagttccaccagtccttctccctggataactag

SEQ ID NO: 5520 - DNA, 342 bp, Artificial Sequence
  Description of Artificial Sequence: Synthetic coding sequence
atgttgccatgtttggcactattactgctgatggagctatcagtgtgcactgtggccggggatgggggggaagagcagacactgagcaccgaagccgagacctgggtaatcgtagccctggaggagggggccggcccatctattcagttgcagctgcaggaggttaagactgggaaagcatctcaatttttcggactgatgggtaaaagagtcggcggccggcccctgattcagccccgacgaaaaaaagcatatcagctcgagcacacttttcaagggctgctcgggaaacggagtcttttcaccgaaggcagggaggatgaggcccaagggagtgagtag

SEQ ID NO: 5521 - DNA, 1269 bp, Artificial Sequence
  Description of Artificial Sequence: Synthetic coding sequence
atgggccccgcctggctgtggcttcttggaaccggaattttggcttccgtccattgccaacccttactcgcccacggcgataaatccttgcaaggcccacagcccccgcgccaccaactgagcgaacccgcacctgcctatcatagaataacgccaacaatcacaaatttcgctcttcggctgtataaagaacttgccgccgacgccccagggaacatcttcttctctcccgtgagcatatctacaacactggccctgttaagcctgggcgcacaagcgaacacttccgccctcatccttgagggactcggatttaatctgaccgagactccggaagcagatattcatcaaggattcaggagcctgcttcatactctcgctctcccttcgcctaagctagagcttaaagttggtaattccctgttcctcgataaaaggctgaagccacgtcagcactacctggacagcatcaaagagctctatggtgcttttgctttctccgcaaattttacggattcagtaacgaccggcagacagattaacgactatcttcgcaggcagacgtatggacaggtggtcgactgtcttcccgagtttagccaagacacgtttatggtgctcgctaattacattttcttcaaagctaagtggaaacatccttttagtaggtaccagacgcagaagcaggagtcattctttgtagatgagcgaacctcccttcaggtccctatgatgcatcagaaggagatgcacagattcctctacgaccaggacctggcctgcacggtgctgcaaatagaataccggggcaatgccctggctctccttgttctgccagatcctggaaaaatgaagcaggtagaggcagctctgcaacctcaaaccctaaggaagtggggccaactgctcctcccgtctctgctcgatctacacctgccgaggttctccatctcaggtacctataatctggaagacattctccctcagatcgggctcactaacatcctgaaccttgaagccgacttttcgggggtgacaggacaactgaacaaaacaatttcaaaggtgagccataaggccatggtcgacatgtctgagaagggcacagaggcgggggcggcctcagggcttttgtctcaaccccccagcttgaatactatgtctgaccctcatgctcacttcaaccgcccattcctgctgttactgtgggaggtcaccacacagagtttgctatttctgggcaaggtcgtgaatccagtggctggatag

SEQ ID NO: 5522 - DNA, 237 bp, Artificial Sequence
  Description of Artificial Sequence: Synthetic coding sequence
atggccctgatcagaaaaacattctatttcctgtttgcaatgtttttcatcttggtgcagttgccatccggatgccaggctggcctggatttcagccaaccgttcccatctggcgagttcgcagtgtgtgaatcatgtaagttgggacgcggaaagtgcagaaaggagtgtttagagaacgaaaaacctgatggtaactgtagactgaactttctgtgttgtagacaacgtatctag

SEQ ID NO: 5523 - DNA, 2139 bp, Artificial Sequence
  Description of Artificial Sequence: Synthetic coding sequence
atggccgcggccggacttgtcgccgttgccgccgccgccgagtacagtggtacagtagcttccggtggcaatctaccgggtgtgcattgcgggcccagttccggggctgggcctggtttcggccccggatcctggtcacgatcccttgatagagccctggaggaggcggcagtcacaggcgtgttatccctgtcaggaaggaaactccgggaattcccccgcggtgccgctaaccacgatttaaccgatacaacaagggcagacctgtcaagaaataggctctctgagatacccattgaagcgtgtcattttgtgtccctggaaaaccttaatctgtaccagaattgtattcgctatatccccgaggcgattctaaacctgcaagcacttaccttcttaaacataagccgaaaccaattgtctacacttccggtgcatttgtgtaatctcccactgaaggtgttgatcgcatccaacaacaaattagtgagcctccccgaggagatcggccacctcagacacctcatggagttggacgtgtcctgcaatgagatacagaccataccgtcccagatagggaatttagaggccctgagagatctgaacgtccgtagaaaccatctagtgcatttaccagaagaactcgcagaattaccgctcatcaggctggatttttcctgtaacaagatcacgactatccccgtctgttaccgaaacttacggcacctccaaaccattactctcgacaacaatcccttacagtccccccccgctcaaatctgtatcaaaggtaaagttcacattttcaaatatctgaacattcaggcttgcaagatagcccctgacctgcccgattacgaccgccgacccctggggttcgggagttgtcacgaggagctgtacagttcaaggccctatggagccctggattccggcttcaattctgttgattcgggcgacaagagatggtcaggaaacgagccgaccgatgagttttcggacctgcccttgcgcgtcgcagagataacgaaggagcagcgactccgcagggaaagccagtaccaggagaatcgaggctctctggtggtcacgaacgggggcgttgagcacgatttagatcagatcgattatatcgactcatgtactgcggaagaggaagaggctgaagtgaggcagcccaagggtcctgatccagatagcctatcttcacagtttatggcctacattgagcagcgtcggatatctcacgagggcagcccagttaaacctgtagccattcgcgagttccaaaagactgaagacatgcggcgatacctccaccaaaatagagtacctgccgagccttccagcctgctgtctttgtccgcctcacataatcagctctcacacaccgatttagagctccatcaaagaagagaacagttggtcgagagaacacgccgcgaggcccagctcgcagccttacagtacgaggaggagaaaattcgcacgaaacagatacagagggacgccgtgcttgacttcgtgaaacagaaggcttctcagtctccccagaagcagcatcccctgttggacggagtggacggcgagtgtccattcccttcacgcagaagccaacatactgatgacagcgccctctgtatgtccctgtctgggctgaatcaggtgggctgcgcggctactttaccccactcaagtgccttcactcccctcaaatcagatgaccgcccaaacgcccttctgtcttctcccgcaacggagaccgttcatcactctcccgcctactcatttccggccgccatacagcgaaatcagccacaaaggcctgaatcgttcctctttcgggccggggtcagagctgaaactaacaaaggacatgcaagccccctgcctcccagcgctgctccaaccacagacagcaccgattcaatcaccggacagaacagtagacaaagagaggaggagctcgagctaattgaccagcttcgcaagcacattgaatatcggttaaaagtatcgttaccatgcgacctgggagccgccttaaccgacggcgtcgtgctttgccatttggccaatcacgtccggccccgatcagtgcccagtattcacgtcccttccccggcagtcgttagctag

SEQ ID NO: 5524 - DNA, 213 bp, Artificial Sequence
  Description of Artificial Sequence: Synthetic coding sequence
atgcgcgtgctgttcttcgtctttggcgtactctctctgatgttcaccgtgccacctgctcgtagtttcatcagcaacgatgaatgtcctagcgagtattatcattgtagactcaagtgcaatgccgatgaacatgctattcgttactgcgccgatttctccatctgctgtaagctaaagattatcgaaatcgatggccagaagaagtggtag

SEQ ID NO: 5525 - DNA, 789 bp, Artificial Sequence
  Description of Artificial Sequence: Synthetic coding sequence
atggccgcagcatccgcaggagctacccgactgctgctgctgttgctgatggccgtcgcagcgccctcccgagcaagagggtctgggtgtcgtgctggaacaggagctcgcggcgctggcgctgaaggcagggaaggcgaggcgtgtgggaccgtaggcctgctgctggagcactctttcgagattgatgatagtgccaacttccgaaaacggggtagcctactttggaatcagcaggatggtactctctcgctttcacagcgacagctgtcggaggaggagaggggccgcctcagagacgtggcggctttaaatggtctgtatcgggtgcgtatccccagacgtccaggtgccctggatggcctcgaggcagggggctacgtttccagctttgtcccagcctgctccctcgtggaaagccatcttagtgatcagctgaccctccacgtggatgtcgccggtaatgtcgtgggggtgtcggttgtgacccaccccggtggatgtagggggcacgaagtggaggatgtagatctcgagctcttcaacacatccgttcagctgcaaccccctacgaccgcccctggtccagagaccgcagctttcattgaaaggctcgagatggaacaggcccagaaggcgaagaatccgcaggaacagaagtcattttttgcaaaatactggatgtacataattcctgttgtcctctttctgatgatgtctggggcgccagacactggaggacaaggcggaggaggggggggggggggaggcggcggatccgggcgctag

SEQ ID NO: 5526 - DNA, 150 bp, Artificial Sequence
  Description of Artificial Sequence: Synthetic coding sequence
atggattcatcgcgcgagcccactctcggcaggctcgatgcagcgggcttctggcaggtgtggcagcgcttcgatgccgacggacacggccatgagtctaagtttgcccagggagaaaccgctgtgtatgactacccccgttgcctttag

SEQ ID NO: 5527 - DNA, 213 bp, Artificial Sequence
  Description of Artificial Sequence: Synthetic coding sequence
atgccaggggctatgaaaattttcgtgtttattcttgctgcactcatcctcctcgcccagatctttcaggctcggactgcgatccaccgggcactaatttcaaagaggatggagggccactgtgaagctgaatgcttaacattcgaagttaagatcggaggttgtcgcgccgaactggcccctttctgttgcaagaacagaaaaaaacactag

SEQ ID NO: 5528 - DNA, 711 bp, Artificial Sequence
  Description of Artificial Sequence: Synthetic coding sequence
atgatgccagccgaaagaaggctgccacttagttttgtccttgacgtactcgaaggccgcgctcagcatcccggagtattatacgtccagaaacagtgctctaacctgcccagtgaattgccccagctgctaccggacttggaatcgcacgtgccatgggcttccgaggcactgggtaaaatgcctgacgcagtgaatttctggttaggagaagcagccgctgtgaccagcctgcataaggaccattacgagaatttatactgcgttgtgagtggagagaagcatttcctctttcatcccccatccgatagacccttcatcccctacggtctcagagtaccggggtgtctacagtttcctcacacacttctcccatgggcccctgagctgtacacccccgccacatatcagttgacggaggaggggacttttaaagttgtagacgaagaggcaatggagaaagtcccatggattccgttagacccactggctcctgacctggccaggtacccatcttactcccaggcccaggcattgaggtgtacagtgagagccggagagatgctttatctgcccgctctctggttccatcacgtacagcagtcacaggggtgtatcgccgtcaacttctggtatgacatggagtacgacttgaaatactcatactttcagctgctggatagcctgaccaaggccagtggcctcgattag

SEQ ID NO: 5529 - DNA, 1098 bp, Artificial Sequence
  Description of Artificial Sequence: Synthetic coding sequence
atggcaccaaagctcattacagtgctgtgcctggggttttgtctgaatcagaagatttgtccccacgccggtgcccaagataaattctccctaagcgcgtggccatcacccgtcgtacctttaggcggccgagtgacactgagttgccacagtcatctaaggttcgtgatttggacgatcttccagaccactggtacacggtcccatgaactgcataccggactatcaaataatatcaccatatctccagtgactccagaacacgcagggacctatcggtgcgtgggtatctataaacatgcttcaaagtggagtgcagagtccaattccctgaaaataatcgtaacaggcctgttcaccaagccttcaatctccgcccacccatcatcactcgtgcatgcgggcgcccgtgtgagcctgcggtgccacagcgaactggctttcgatgaattcatcctctataaagaggggcacatccagcactctcagcagttagaccagggcatggaggccggtatccactatgtggaggccgtcttttctatggggccggttacaccagcacacgctggcgcctacaggtgttgcgggtgtttcagccacagccgctacgagtggtccgcccccagcgatccactggacattgtgatcaccggaaagtacaagaaaccgtccctcagtacccaggtggaccccatgatgcgcttgggagagaagttgaccctgttctgctcaagcgaaatatcctttgaccagtatcacctgttccgccacggcgttgcccacggccagtggctgagcggcgggcagcggcaccgggaagcattccaggccaatttttctgtaggcagagccacgccagtgcccggcgggacgtatcggtgttacgggtctttcaacgattcaccctataaaccccctgtcaccaggtgtaattttactccacaggaaacattaagggtgcttctttgccactctcaaaatccacctctaaacctcacccccccttggcagacccagtcacctcggaaggcgaacggtcggatgaagcgcagcctccagcaaaagcggcatagacggtcttatatgccctcgtag

SEQ ID NO: 5530 - DNA, 198 bp, Artificial Sequence
  Description of Artificial Sequence: Synthetic coding sequence
atgagaactttcctgttcttgtttgctgtactgttctttctcacaccagcaaaaaatgccttctttgacgagaaatgtaataagctcaagggcacctgcaagaacaattgcgggaagaacgaagaactgatcgcactgtgccagaagtccctgaaatgctgccggacaatccagccgtgtggatcaatcatagactag

SEQ ID NO: 5531 - DNA, 198 bp, Artificial Sequence
  Description of Artificial Sequence: Synthetic coding sequence
atgcggacctttctctttttattcgcggtcctatttttcctcactccagctaagaatgccttctttgatgagaaatgcaataaactaaagggcacatgtaagaacaattgtggcaagaacgaagagctaatcgcattatgtcaaaaatcactgaagtgctgccgtactatccagccttgcggcagcatcatagactag

SEQ ID NO: 5532 - DNA, 237 bp, Artificial Sequence
  Description of Artificial Sequence: Synthetic coding sequence
atggccctgattcggaaaaccttctactttttgttcgctatgttctttatactcgtccagctgccctcgggctgtcaggccgggctcgacttctcccaaccatttccatccggtgaatttgctgtgtgcgagtcctgtaaacttgggaggggcaaatgtagaaaagagtgtctcgaaaacgagaagcctgacgggaactgccggctgaatttcctgtgctgccgccagcgcatctag

SEQ ID NO: 5533 - DNA, 2868 bp, Artificial Sequence
  Description of Artificial Sequence: Synthetic coding sequence
atgtgggccgggttgctcctgcgcgctgcttgcgtcgctcttctgctgccaggggctcccgcacgcggatatactggtcgcaaaccacctggccactttgcggccgagagaaggagactgggcccacatgtttgcctatccgggttcggcagcgggtgctgtcctggctgggcaccctcaatgggcggagggcactgcactctcccactatgtagtttcggttgcggcagtggcatttgtatcgctccgaacgtctgcagctgccaggacggggagcaaggggccacctgtcctgaaacccacggcccttgtggagaatatggatgtgacctcacttgtaaccatggcggctgtcaggaggtggctagagtgtgccccgtaggtttctctatgacagaaactgccgtcggtataagatgcactgatatcgatgaatgtgtcacatcctcatgcgagggccactgtgttaacactgaaggaggctttgtctgcgagtgtggacctggcatgcagttgtccgccgaccgccacagttgtcaagacacagatgaatgtctagggaccccttgtcagcagagatgtaagaattcgattggttcatacaagtgttcttgtcggaccggctttcacctgcatggcaacaggcactcttgtgttgacgtgaacgagtgccgccgacctctggaacgtcgggtctgtcatcatagttgccacaacactgtaggcagttttctctgtacctgtcggccggggtttcgcctcagggcggatcgcgtgtcctgtgaggcctttcccaaggctgtactcgcgccatccgctattcttcaaccccggcagcatccaagcaaaatgttgctgctgctgcccgaggccggtcgaccagctctaagcccaggtcacagccccccaagtggagcccctggccccccggctggcgtgcggacaacaaggctgccaagccctacccctcgtctgcctacatcctctccctcagcaccagtgtggctcctttccacacttctggcaacccccgtccctactgcatcgttgctgggaaatctgagaccgccaagcctacttcagggggaggttatgggtaccccgtcgagcccccgcgggccggagtcaccccggctggcagccggtccatctccatgttggcacttaggagccatgcacgagtctcgatctcgctggaccgagccaggctgttcccagtgttggtgcgaggatggtaaggtgacttgtgaaaaagtcaggtgtgaggcagcttgcagtcatccaataccctctcgagatggcgggtgttgcccttcatgcacagggtgttttcattcaggcgtcgtgcgtgctgaaggagatgtttttagtcctccaaatgagaactgcactgtttgcgtgtgtctagccggaaacgtgtcttgcatttcccccgaatgtccctccggcccctgccagaccccaccacagacagactgttgcacgtgcgtccctgtgcgctgctatttccacggcagatggtatgccgacggagctgtgttctccggtggcggagacgagtgcacaacctgtgtgtgccagaatggtgaggtagagtgcagtttcatgccttgtcccgagctggcctgtcctcgggaagaatggcggttaggacctgggcagtgttgctttacatgccaggaaccaactcctagcacaggttgcagcctagatgataatggtgtggagttcccaataggacagatctggtcgccaggtgacccttgcgagttatgtatctgtcaggcggatgggtccgtgtcctgcaagcgtactgattgcgtcgactcctgtccccacccgatacgtatcccaggacagtgctgccccgattgttcagccggctgcacttatacaggcaggattttctacaataatgagactttcccgtccgtactggatccttgcctgtcctgcatatgcctgttaggttctgtggcttgctcccctgttgattgccccattacttgcacctatccgtttcatcctgacggagaatgctgtcctgtgtgcagggactgtaactacgaggggaggaaagtagccaacgggcaggtctttaccctcgatgatgaaccctgtactaggtgtacttgccagctgggcgaggtgtcctgcgaaaaggtcccttgtcaaagagcctgtgccgatccggctttgctccctggcgactgctgttctagctgtccggacagtcttagccctctcgaagaaaagcagggattaagtcctcatggaaatgtggccttctccaaagctggcaggtctttgcatggagacaccgaggcccctgtgaattgctcatcctgtcctggcccacctaccgcaagcccaagccggccagtcctgcatctcctacaacttctgctcaggacaaatctgatgaaaacccagacattgccaacgtcccctgctggcgcccacggaccacatagcttagccctgggccttaccgcgacatttcctggggaacccggagctagccctaggctgtcccctggaccgagtacaccacctggtgccccaaccctgcctctggcttccccaggggctccccaaccgccgcccgttacaccagagaggagttttagcgcctctggtgctcagatcgtgtcaagatggcccccgttacctgggaccctgctgacagaggccagtgccctgtccatgatggatccctccccaagtaagactcccatcactctcctgggaccacgcgtgctctctcccaccactagtcgtctttcaaccgccctggccgccacaacacaccctggtccccaacagccccctgtcggggcttctcgtggtgaagagtccactatgtag

SEQ ID NO: 5534 - DNA, 270 bp, Artificial Sequence
  Description of Artificial Sequence: Synthetic coding sequence
atggtctcttgcgagcgcagggcttccaaaagtgtagggcagattttgctgtgggattttggctacacctgtcgtctaagtcacaggcggcgaaatagcacagaaatcctgtcacgcaacctgcctgccttatacacaggcatcaaggtctgcgagaaacggccttctatcgatttatgcattcaccattgctcttacttccagaaatgcgaaacaaataaaatctgttgctcagcattttgtggtaacatttgcatgtcaatcctttag

SEQ ID NO: 5535 - DNA, 600 bp, Artificial Sequence
  Description of Artificial Sequence: Synthetic coding sequence
atggagacttttcccctactgcttctgtccctcgggcttgttttagctgaagcgagcgaatcgactatgaaaatcattaaagaagagttcaccgacgaggagatgcagtacgacatggccaagagcggacaggagaagcagactatagagattctgatgaatccaattctgttggtcaagaatacatctctgagtatgagcaaggatgatatgtccagcacccttttaacctttcgctcactgcactacaacgaccccaaaggcaacagctccggcaatgataaagagtgctgtaacgacatgacagtgtggagaaaggtaagtgaggccaacggcagttgtaaatggagcaacaacttcatacggtcatcaaccgaggtgatgcgccgtgtccacagggccccgagctgtaaatttgtgcaaaatcctggtataagctgttgtgaaagcctggaactggaaaatactgtatgtcagttcaccaccggaaaacagtttccacgatgtcagtatcacagcgtcacttctctggagaagatactgacagtcctcacaggccattcgttgatgtcctggctggtgtgcgggtcgaaactttag

SEQ ID NO: 5536 - DNA, 729 bp, Artificial Sequence
  Description of Artificial Sequence: Synthetic coding sequence
atggccgccgcaacacgaggttgtagaccctggggttcacttctgggccttctgggtctggtgtccgcagcagctgctgcatgggatttggcgagtcttaggtgtaccctcggcgctttttgcgagtgtgactttcgccccgacctgcccggcctggaatgtgacctggcacaacacttggcagggcagcacctggctaaggccctggtggtgaaggcattgaaggccttcgttagagaccccgcacccaccaaacccctcgttttatcactgcacggttggacaggcaccggcaagagctatgtgtccagcctgctggcacactacctgttccagggcggactgcggtcccctcgcgtccaccatttttctcccgtgctgcacttcccccacccttctcatattgaaaggtacaaaaaggatctgaaatcctgggtgcagggcaaccttacagcctgcgggaggagcctcttcctctttgacgaaatggacaagatgccacctggactgatggaagtgctgaggccgttcctggggagcagctgggttgtctacggcacaaactaccgaaaggccatatttatttttatcagatggttgttgaagttaggacatcacggtagggcccctccccgcaggtccggagctctgccacccgcccccgctgcgccacggcctgctctgcgggcacaacgagccggacccgccggacccggggccaaggggtag

SEQ ID NO: 5537 - DNA, 627 bp, Artificial Sequence
  Description of Artificial Sequence: Synthetic coding sequence
atgctggggctgctcgtggccctactagcactcggcctagctgtgtttgcactcctcgatgtttggtatctcgtacgcctcccctgcgccgtcttacgagcaagactgctccagccccgggtgagagatctgcttgcggaacagagattccccggacgagtacttcctagcgatctcgatcttctgctgcatatgaacaatgccagataccttcgggaagctgatttcgcgagggtggctcatcttactcgttgcggcgtgttgggcgccctccgcgagctcagggctcacactgtgttggccgccagctgcgctcggcataggcggagcctcaggctgttagagcccttcgaagtccgcacccgtctgctgggctgggacgacagggcattctatttagaagctaggttcgtttcccttagggacggcttcgtctgcgcactactgaggtttaggcagcacctcctcggcacctctccggagagggtggtgcaacatctctgtcaaagaagggtggaacctcctgagctccctgccgatctccaacactggatctcctacaatgaggcttccagccagctcctcaggatggagagtgggctgtctgatgtaactaaggaccagtag

SEQ ID NO: 5538 - DNA, 423 bp, Artificial Sequence
  Description of Artificial Sequence: Synthetic coding sequence
atgttggttaaactaaatagtcaagcacgactcagctctatggtgaaaaaagttcgtctgccaagccggtgcgagccccctggaaccacatgtactgtgtctggctgggggaccaccactagcccagacgtcacattcccttccgatctcatgtgtgtcgatgtgaagttgatttcgccacaggattgtactaaggtgtacaaggacttactggaaaattccatgctttgtgccggaattcctgattcaaaaaagaatgcatgtaacggagatagcggcgggcccctggtgtgtcgcggcacactgcagggcctggtgtcttgggggacgtttccatgcgggcaacccaacgatcccggggtctacacacaggtgtgcaagttcaccaagtggatcaacgacacaatgaagaagcacagatag

SEQ ID NO: 5539 - DNA, 354 bp, Artificial Sequence
  Description of Artificial Sequence: Synthetic coding sequence
atgttgagcaaagcacacgggtgcaaaacggcccttagccttggccgctgcccaaaaattagggaggagtgcgaatttcaagagcgcgatgtgtgcactaaggataggcagtgccaagacaacaagaagtgctgtgtattctcatgcggtaagaagtgcctggacctcaagcaggacgtctgtgaaatgccaaaggaaaccgggccctgcttggcctattttctccattggtggtacgacaaaaaagacaacacatgttctatgttcgtgtatgggggatgccaaggcaataacaataattttcagagtaaggctaactgcttaaacacctgtaaaaataaacgctttccctag

SEQ ID NO: 5540 - DNA, 2328 bp, Artificial Sequence
  Description of Artificial Sequence: Synthetic coding sequence
atgcacccaggccctgaagaagctggatcagggcgatatggcccacggtatatcaccgacatgggggccggcgaagacgacgaaggattcgaggacgatctcgaccttgatatctctttcgaagaagtgaaaccattgccggccacaaagggcggaaataaaaagtttctggtggagtcaaagaaaatgagcattagcaacccaaaaaccatcagtagactcatccccccaactagtgcctctctgcctgtcacaaccgtggccccacagcccatccctattcagcgcaaagggaaaaacggtgtggctataatgagtagactgtttgatatgccctgcgacgagaccctgtgcagcgccgacagtttctgcgtgaatgattatacatggggaggcagtcggtgtcaatgtaccctaggcaaggggggggagtcatgctctgaagatatcgtcattcagtacccccaattctttggtcacagctacgtcacattcgagcctttgaagaatagctatcaggcttttcagataacgctcgaatttcgggccgaggctgaagacgggctgctgctgtactgcggagagaacgaacatggacggggggactttatgtctctggccattatccgcagaagcttgcagtttaggtttaattgcggaaccggggttgcaatcattgtttctgaaaccaaaatcaagctgggcggatggcatacagtcatgctgtaccgagacgggctgaatggactgctgcagcttaacaacgggactccagtgacaggacaatctcaggggcaatattcgaagattaccttcagaacccccctctatctgggaggagctccctcggcgtattggttagtcagggctaccggaaccaaccggggatttcagggctgcgtgcagagtttggctgtgaacggccggaggatcgatatgaggccctggccactcgggaaagctctgtccggagcagacgtgggagagtgcagctctggaatctgcgatgaagcctcatgcatacacgggggtacttgtaccgctattaaagccgacagctacatttgtttatgtccactgggattcaaagggagacactgtgaggatgcgttcactctcaccatcccccaattcagagagagcttacggagttacgccgccaccccgtggcctctggagccacagcattatctctcatttatggagtttgaaattactttcaggcccgattctggcgatggtgtgcttctgtatagctatgacaccggaagcaaggacttccttagcataaatctcgcaggtgggcatgtggaatttcgttttgattgcggaagcggcaccggggttcttcggtcagaggacccacttaccttgggcaattggcacgagctgcgggtgagtcggactgcgaagaacggcattctccaagtggacaaacaaaaaatagtcgaagggatggcagaagggggtttcacccaaatcaagtgtaacaccgacatctttataggcggggtgcctaactacgacgacgtcaagaagaactccggggtgttgaaacctttctccggctccattcagaagattatcttgaatgatagaaccatacatgtgaagcacgattttacttcaggcgtaaacgttgagaacgcagctcacccatgtgttcgcgccccctgtgcccatggcggctcatgccgcccaagaaaggaaggctacgactgtgattgcccgctaggattcgagggtctccactgccagaaggctatcattgaggccatcgaaattccacagtttatcggcagatcttacttaacttacgacaatcctgacatcctgaagagagtctctggcagcaggtccaacgtgttcatgcgtttcaagacgaccgcaaaggatggccttttgctgtggagaggtgattcacctatgcgccctaatagtgattttatttcactcgggctgcgtgacggggctcttgtcttttcttacaacctcggcagcggcgtggcttctatcatggtgaatggcagttttaatgatggtcggtggcatcgcgttaaagctgtgcgggatggccagagcggcaagataacggtcgacgattacggcgcccggacggggaaatcaccaggtatgatgagacagcttaacattaatggcgcgctgtacgtgggggggatgaaagaaattgcactgcacacaaacaggcagtatatgcgtgggctcgtgggctgtatatctcacttcaccctgtcaactgattatcacattagcttagtggaggacgccgtggatggcaaaaatattaacacctgcggcgccaagtag

SEQ ID NO: 5541 - DNA, 1257 bp, Artificial Sequence
  Description of Artificial Sequence: Synthetic coding sequence
atgaggactctgttcaatttgctgtggctagccctggcctgttctcccgtgcataccacactctctaaatccgacgccaagaaagccgcctcaaagacactgctcgaaaaggtcaaattttgcagttgttgccccggctggtccgcaatggctagaagctggctgactgcaacatctgccacccagtcgcagttttctgataaacctgttcaggatcgtggacttgtggtaactgacctgaaagccgagtctgtagtgctggagcatcggagttactgcagcgccaaagccagagacagacactttgccggagatgtgctgggatacgtgacaccttggaattcacatggatatgatgttacaaaggttttcggatcgaagttcacacagatttcccccgtctggctacagctcaaacgaaggggccgtgagatgtttgaggtgacgggactacatgatgtggaccagggttggatgcgagcagtgaggaaacacgctaaaggactgcatattgtgccaaggctcttgtttgaggactggacttacgacgactttagaaatgtccttgatagcgaggatgagattgaggagctgagcaagaccgtagtacaggtcgccaagaaccagcatttcgacgggttcgtcgtcgaagtctggaatcaactgctgtcccaaaaacgtgtcgggctcatccacatgctaactcacctagccgaggcactccatcaagcgcggctgttggcgctcctggtgataccaccggccatcacgcctgggacagatcaactcggcatgttcacgcataaagaatttgaacagcttgcccccgtacttgacgggttctccctgatgacttacgactattcaacggcccaccaacccgggccaaacgctccactcagttgggtaagagcttgtgtacaggtgctggatcctaaaagtaagtggcgttccaagattctgctggggctaaatttttacgggatggactatgcgacgagcaaggacgcccgcgaaccggtggttggggccaggtatattcagactttgaaggaccataggccccgaatggtgtgggattcccaagcaagtgagcatttcttcgagtacaagaagtcaaggagcggacgccacgtcgtcttctatccaacactcaagtctctgcaggtgaggctggagctggcccgcgaacttggggtaggcgtgtcgatctgggagctcgggcaaggcttggattacttttatgacttgttatag

SEQ ID NO: 5542 - DNA, 813 bp, Artificial Sequence
  Description of Artificial Sequence: Synthetic coding sequence
atgatgctccgcctcctatcgtccctcctcctggtggcggtcgcctctggatacggcccgccgtcgtcaaggccatcttcgcgtgtggttaatggcgaagacgccgtaccctacagttggccctggcaggtgagcctccagtatgaaaagtctgggagcttttaccatacgtgcggaggctctctaatagctcctgattgggtggtcacagcagggcattgtataagcagctcccgtacctatcaagtcgtgcttggggagtatgatcgcgcagtgaaagagggccccgagcaggtgataccaattaattctggtgatctctttgtgcatcctctttggaatcgaagctgtgttgcctgtgggaacgatatagccctaatcaagctttcgaggagcgcgcaactgggggacgcggtgcagctcgccagccttccccccgccggcgacatccttcctaatgagaccccctgttatatcactggatgggggaggctatacactaacgggcctcttccagacaaactgcaagaggctctcctgccagtagttgattatgaacattgctcacgctggaactggtgggggtcatctgtgaaaaagaccatggtgtgtgccggcggggacatacgatccgggtgtaatggcgacagcggcgggcctctcaactgtcctacagaagatggtggatggcaagtgcacggtgttacgtcctttgtgtctgcattcgggtgtaacactcgccgcaaaccaacagtgtttactcgggttagtgctttcatcgattggattgaggagacgatagcctcacattag

SEQ ID NO: 5543 - DNA, 585 bp, Artificial Sequence
  Description of Artificial Sequence: Synthetic coding sequence
atgaccatgagacacaattggaccccggacttaagtccgttgtgggtcctgctcctttgtgctcatgtcgtgaccctgcttgttagagccacacccgtctctcagaccaccacggccgctaccgcaagcgtaagaagcacgaaggacccctgtccaagccaaccgccggtgtttcctgcggcaaaacagtgtcccgccttagaggtgacatggcccgaggtcgaggtgccccttaacggtaccctttccctatcttgtgtggcctgctctcgttttcctaatttctctattctgtattggcttggcaatggatctttcatcgagcatctacctggacgcctgtgggaaggaagcacgtctagggaaaggggatcaacaggtacacagctgtgtaaagcactggtgctggaacagttgacacccgcattacattccactaacttttcgtgtgtgttggttgacccggagcaagtcgtgcaacgccatgtggttctcgcacaactttgggccggtttaagggcgacccttccaccaactcaggaggctctgccatcctcacatagcagccctcagcagcagggctag

SEQ ID NO: 5544 - DNA, 1308 bp, Artificial Sequence
  Description of Artificial Sequence: Synthetic coding sequence
atgcagggacaagggagaagaaggggaacttgcaaggacatattttgctccaagatggctagctacttgtatggtgtactctttgccgttggactctgtgcccctatatactgtgtctccccagcgaatgctccttcagcttaccctcgccctagctctactaaatctacccctgcctcccaagtctattccctaaataccgactttgcatttcgcctgtatcgcaggttggtgctggaaaccccatctcagaatatcttcttctccccagtttcggtgtccacttctctggcgatgctctccttgggcgctcattccgtgacgaaaactcagattctccagggattgggctttaacctgactcatactcctgagtcagctattcatcagggatttcaacaccttgtgcattcactcaccgtcccgagcaaggacctgaccctcaagatgggcagtgctctgttcgtgaaaaaggagttgcagctgcaagcaaattttctcggaaatgttaaacgtctgtacgaggcagaggtgttctccacagatttcagcaacccctctatagcacaggccagaattaactctcacgtaaaaaagaagacccaggggaaagtcgtggacatcatacagggcttggacctgctcactgcaatggtgctggttaatcacattttctttaaggctaaatgggagaaaccatttcacccagaatacaccagaaagaattttccattcttggttggcgagcaagtgacagtgcacgtccctatgatgcatcaaaaagagcagtttgctttcggggtggacactgagctcaactgctttgtactgcaaatggattataaaggcgatgctgtagcctttttcgtcctgcctagtaaaggtaagatgcgccaattggaacaggctctcagtgcgcggaccttgaggaagtggagccatagtctgcagaaacgctggatcgaagtctttatccctaggttttccataagtgccagctacaacctggagacaatactccccaaaatggggatacaaaacgtgtttgataaaaacgcagacttttctggcattgctaaaagagattcactgcaggtgtccaaggcaactcacaaggcagtgttggatgtcagcgaggaggggaccgaggccacagccgctactactactaagttcatagtaaggagcaaagatgggccgtcatattttaccgtcagtttcaatcgcaccttcttaatgatgattactaacaaggctactgacggcatcttgttcctgggcaaggtagagaaccccactaaatcatag

SEQ ID NO: 5545 - DNA, 393 bp, Artificial Sequence
  Description of Artificial Sequence: Synthetic coding sequence
atggcttctgaccttatccggaccatcctcgctgttgcgttgatttctaagctcggcaccgctgtcgacgctgagctcatgccctcaggggcaatcctgcagaacaagcgcgagaatttgccacgcgtttgccacgcactcgcattcctaggcatggctagatgccaggacctgtttctcgtgaggctgcaaggatggaagctgggaacccgatttcaggacggcccaaggtctactccccaggaggagggcgggagcccacagcggaagagagggatgccggttcaaatacacttccttttgaagagcttcttaagttcaccgatcacgttcgcattcataagcctagccaggactgtatctctggccactgctatctgcaagatcgtgtag

SEQ ID NO: 5546 - DNA, 837 bp, Artificial Sequence
  Description of Artificial Sequence: Synthetic coding sequence
atgcagtggctgcgggttcgggaatcaccaggggaggctaccgggcaccgcgttacaatggggactgccgccttgggcccagtttgggcggcacttctgctgtttctcctaatgtgcgagattcccatggtggagctgaccttcgatcgtgcagtggcgagcgggtgccagcgctgctgcgacagcgaagacccactggaccccgcccatgtgtcgtcagccagcagcagtggcaggccccacgctcttccagaaatccggccctacatcaacatcaccatactcaaaggtgataagggggaccctggcccaatggggttgccagggtacatgggtagagagggccctcagggggaacccgggccgcagggtagtaaaggcgataagggggagatgggaagcccaggtgccccttgccagaagaggtttttcgctttctctgtaggccgcaagacagcgttgcacagtggagaagattttcagactttactattcgaacgcgtgtttgtgaacttagatggatgctttgatatggcgactgggcaattcgcggcgccactgcggggaatttattttttttctttaaatgtgcactcctggaactacaaggaaacgtacgtgcatattatgcacaatcagaaggaagccgtgatcctgtacgcccagcccagtgaacggtcaattatgcagtcccaatctgtaatgctggacctggcctatggcgatcgcgtgtgggtgaggttgtttaagcgccaaagggagaacgccatatactctaacgacttcgacacctacattacattctctgggcatctaataaaagctgaagatgattag

SEQ ID NO: 5547 - DNA, 1635 bp, Artificial Sequence
  Description of Artificial Sequence: Synthetic coding sequence
atgtgtactgtggtcgacccgcggattgtgcgtcgctacctgttacgtaggcagcttggccagggtgcctatggtattgtgtggaaggctgtcgacagaaggactggggaagtggtggcaataaagaagatctttgatgcgttccgcgacaagacagacgctcagaggactttccgcgagatcacactgttgcaggaattcggagaccatcccaacataatctcgcttcttgatgtcatccgcgccgagaacgaccgtgacatctatctggtcttcgaattcatggacaccgatctgaacgcagtgattagaaagggaggtctgctacaagacgtgcatgtgcggagcattttctaccaactgctgagggccaccaggtttcttcactcagggcatgtcgtgcacagggaccaaaagccctccaatgtgctgctggacgctaactgcacagtcaagttgtgtgacttcggactggctcggtctcttggcgatctccccgaggggcccgaagaccaggccgtgacggaatacgtcgctacaagatggtacagggccccagaggttctgctgagttcccataggtacactctgggcgtggacatgtggagcctgggatgtattttgggcgaaatgctgagaggaaggccgctgtttcccggaacatccacgctgcatcagctggagttaattctggaaacaatccccccacctagtgaggaggacctgttagcactggggtccggatgccgcgcctcagtccttcaccagctaggctcacgacctcgccaaacccttgacgccctgctgccacctgatacaagtcctgaagccctggacctcctgcgtagactgctggtgtttgccccagataagcgtttgagcgccacacaagctcttcagcatccttatgtacagagattccactgtccatcagatgaatgggccagggaagctgacgtgagacctcgggcccacgagggcgtccaactgtctgtccctgagtatcgctcccgggtctaccagatgattctggagtgcggcgggtcgtccggaacctcccgggagaaaggaccagaaggggtgagcccttctcaagcacacctccacaagccccgcgcggaccctcagctgccgtccagaactccagtgcagggcccccggcctcggccgcagtcatcacccggtcacgaccccgccgagcatgagagccctagagcagcaaagaatgtgccaaggcagaatagcgctccattgttacagaccgccctcctgggtaatggggagcgcccaccgggggcaaaggaggctccgcctctgactctctccctcgtgaaacccagcggcaggggagccgctcccagtttaacctcacaggctgctgcacaggtcgcgaaccaggcccttattcgcggcgactggaaccgtgggggcggagtgcgggtcgcctcagtccagcaggttcctcctcggctgcccccagaagctcgcccgggccgcaggatgttttctacatcagccctccagggagcccaaggcggtgcaagagcattgcttggaggctacagccaagcctacgggacagtctgtcactccgccttgggccacctacctttgctcgaagggcaccacgtctag

SEQ ID NO: 5548 - DNA, 399 bp, Artificial Sequence
  Description of Artificial Sequence: Synthetic coding sequence
atgaaaagttctggccttttccccttcctggtactcctagccctgggaactctagccccatgggcagtggaagggagtggaaaatcattcaaagcaggggtgtgcccacctaaaaagtccgcccaatgtctcaggtacaaaaagccagaatgccagtctgactggcagtgtccggggaagaagaggtgttgcccagatacttgtgggattaagtgcctcgatccggtggacactcccaatccaacaagacggaagcccggcaagtgccctgtcacctacggccagtgcctgatgctcaacccccccaatttctgcgagatggacggacagtgtaaacgtgatctgaaatgctgtatggggatgtgtgggaaatcatgtgtgtcccctgtgaaagcttag

SEQ ID NO: 5549 - DNA, 1401 bp, Artificial Sequence
  Description of Artificial Sequence: Synthetic coding sequence
atgaaaccaccactgcttgtattcatcgtctgtttgttgtggcttaaggactcacactgcgctccaacctggaaagacaagactgcaatttcggagaacttgaaaagtttctctgaagtgggtgagatcgacgcggacgaggaggtcaagaaagccctgaccggtatcaagcagatgaaaataatgatggagagaaaagagaaagaacacaccaatctgatgtccactctgaagaagtgtagggaagaaaagcaggaggcgcttaagttactgaacgaggttcaggagcatctggaagaagaagagcgcctgtgcagagagtctctggccgacagctggggggaatgtaggagttgcctcgagaataattgcatgagaatctacaccacctgccagccttcgtggtctagcgtgaaaaataagattgagaggttcttcaggaaaatttatcagtttctttttccatttcatgaagataacgaaaaggatctgcccatcagcgagaagctgatcgaggaggacgcgcaacttacccaaatggaggacgttttctcccaattgaccgtggacgtcaactcgctgttcaatcgatcctttaatgtgttcagacagatgcaacaggagttcgaccagaccttccagtcacatttcatcagcgacacagatctgacagagccttactttttcccagcattcagcaaagaaccaatgactaaagctgatcttgaacaatgttgggatatccccaattttttccagctcttttgcaatttcagcgtcagcatctacgagtcagtctcagagacgataactaaaatgttgaaggccatcgaagaccttcccaagcaagacaaggcacccgatcacgggggccttattagcaaaatgcttccaggacaggataggggtttatgtggggagctcgatcagaacctaagtcgctgcttcaagttccacgagaagtgtcagaaatgccaagctcacctcagcgaggactgccccgatgtgcccgcactgcatactgagctggacgaggcaatccgtctagtcaacgtctcaaaccaacagtatgggcagattctacagatgacccgcaaacacttggaagatacagcctacctcgtcgagaaaatgagagggcaattcggatgggtgagcgaactggctaaccaggcccccgaaacagagattatttttaacagcattcaggtcgtccctagaattcatgaaggcaacatctctaagcaggatgagaccatgatgacggacctttctatattgcctagcagcaactttacattgaagattcctctggaggagtcagccgaaagttcgaattttatcggttacgttgtggctaaggctctccagcactttaaggaacatttcaagacgtggtag

SEQ ID NO: 5550 - DNA, 522 bp, Artificial Sequence
  Description of Artificial Sequence: Synthetic coding sequence
atgcattggaagatgctccttctgcttctcctgtactacaatgctgaagctagcatgtgccataggtggagccgtgcagtgctgtttccagccgcccacagacccaaaaggtccagctcccttcctctaaaccccgtactgcagacttccttggaagaagtcgagctactttacgagttcctgctggcggagctggaaattagccctgacctacagatttcaatcaaggacgaagagcttgctagccttcgtaaggcctccgatttcagaactgtctgcaataacgtgattccaaaaagcatcccagacatccgtcgactgagcgcttccctgtcctcgcacccaggcattctgaaaaaggaagactttgaaagaaccgttctgactctcgcctataccgcttacagaacagcactgtcgcatggccatcagaaggacatctgggcccagtcgctcgtctccctgttccaagccctgcgccacgatctaatgaggagctcacagccaggggtccccccatag

SEQ ID NO: 5551 - DNA, 1473 bp, Artificial Sequence
  Description of Artificial Sequence: Synthetic coding sequence
atggaagactccgattcagctgctaagcagctggggctggctgaggccgcggcagtagccgctgctgccgctgtcgcggccgctgccgccgccgcggcgggcggagaagcagaggagcctgtgctgtcaagagatgaggactctgaagaggatgctgactctgaggccgagagggaaacgcccagggtgaccgctgtcgcggtgatggccgccgaaccgggccacatggacatgggagcagaggcgttgccaggacctgacgaagcagcggctgccgccgcttttgctgaggtgacgacggtgacggttgccaacgtcggagcagctgctgacaacgttttcaccacaagtgtcgctaacgcagcatccattagcgggcacgtgctctccggcaggactgccctacagatcggggacagcctgaacacagaaaaggctactctgattgttgtgcatactgacggaagtatcgtggagacaacagggctaaaagggcccgcagcccctctcacccccggcccacagagcccaccaactcctctggcgcccggccaagaaaagggcggtactaagtataactgggatcccagcgtctacgattcagaactacctgtccgctgtaggaatatcagcggcaccctatataagaaccgactgggatctgggtgggatctcaaaccctcgagatgcctccttcacctgtgctgcctattgcgccgacacgatctcattactgtaacacctagtggccagatcacgacatctggggccctgacctttgacagggcctcaaccgtagaggccactgcggttatttcagagagccccgcccagggagatgtcttcgccggggcgaccgtacaggaagccagcgtccagccaccctgccgtgcatcacatcctgaaccacattatcccggctaccaagattcttgtcaaattgcgccattccccgaggctgcgctacctacatcccatccgaaaattgtcctcacaagtctgccagcattggctgtgcctccacctacgcctactaaggccgccccccctgctttagtcaatggactggaactgagcgaacccaggtcgtggctgtatctcgaagagatggtgaattccctgctgaataccgcgcagcaattgaagacattgtttgaacaggcaaagcacgcctcgacataccgggaggccgctacaaatcaggccaaaatccacgcagatgcagagagaaaggaagtgatccatcctccccgtctgccgaaggtgttgggtctgcagcagtcttgcgttaactgtggtagagaggcaatgtcggagtgcacgggatgccacaaagtcaactactgttccaccttctgccaaaggaaagactggaaagaccatcagcatatctgcggacagtcagccgccgtgacggttcaggcagatgaggtccacgtggccgaaagcgtgatggagaaggtgaccgtgtag

SEQ ID NO: 5552 - DNA, 1476 bp, Artificial Sequence
  Description of Artificial Sequence: Synthetic coding sequence
atgccctcaactgtgctaccttcgacagtgctgcctagcctactgccgaccgctggcgccggatggtctatgcgctggattttatgttggagtctgacactgtgcctcatggcccagactgcactcggtgcgctccataccaagaggccacaggtggtgaccaagtatggcaccctccaagggaagcagatgcatgtgggaaaaacgccaattcaggtttttcttggagtaccattctccaggccgccccttggtatccttagatttgccccgccagagcctcccgaaccatggaagggaataagagacgcaactacgtaccccccaggatgtttacaggagagttggggccaactggcgtcgatgtatgtgagtactcgcgaaagatacaagtggcttcggttcagtgaggattgcctctaccttaatgtgtatgctcccgctcgcgctcctggcgatccccaactgccagtgatggtgtggttccccgggggagcatttattgtgggagctgcgtccagctatgaggggtctgatctcgctgcgcgcgaaaaagtggtgctagttttcctccagcaccgattaggaatctttggtttcttgtcaacagacgatagtcatgctcgtgggaactggggattgctagaccaaatggcggccctccgatgggtgcaggagaatatcgccgccttcgggggggaccccgggaatgtgaccctgttcgggcaaagtgcgggggccatgtccatcagcggccttatgatgagtccgctggctagcggcctgttccacagagcgatatcccagtctggcaccgcgttgttccggcttttcataactagcaacccactgaaggttgctaagaaggtcgcacatctcgccggatgtaaccataactctacccaaattttggtgaactgcctgagggccctgtctggcacgaaagtgatgcgcgtgtccaataagatgaggttcctgcaactgaattttcagagagatcccgaagagataatatggtcaatgagtccagttgtcgacggcgtagtgattcccgacgacccactggtgctcctaacccagggaaaggtatccagcgtgccctacttgcttggggtaaataacttggagttcaactggctgcttccttacatcatgaaattccctctcaaccggcaagccatgcgcaaagagaccatcaccaaaatgttgtggtccaccagaaccctactgaacataaccaaagagcaggtaccccttgtggtggaggaatacctggacaatgtgaacgagcatgactggaagatgctgcgcaatcgaatgatggatatcgtccaggacgctactttcgtttatgcaactttgcagacagctcattatcatcgcgaaacccctatgatgggaatctgccctgcaggtcacgctaccacacgcatgaaatccacttgttcatggatcctgccacaggagtgggcttag

SEQ ID NO: 5553 - DNA, 753 bp, Artificial Sequence
  Description of Artificial Sequence: Synthetic coding sequence
atgcccgcctcctcaccctttctgctggccccgaagggcccgcccggtaacatgggaggacccgtgcgagagccagccctttcagttgcactgtggctgagttggggcgccgctttgggcgcggtagcctgcgccatggcgctgctcacacagcagaccgagctacagagtctgagaagggaagtgtccagactccagggtacaggcggcccaagccaaaatggcgagggctatccctggcagtccctcccagaacagagcagcgatgccctcgaggcatgggagaacggagagaggtcccgcaaacggagagccgtgttgacccagaagcaaaagaagcagcattcagtgcttcacctggtgccaattaacgccacctcaaaagacgacagtgatgttacagaagtaatgtggcaacctgccctcaggcgcggaagaggcctgcaggcacagggttacggcgtgcggattcaggatgcaggagtgtatctcctgtattcacaggtcctgtttcaagacgtgaccttcacgatgggccaggtagtgtctcgggagggccagggtagacaggagaccctgttcaggtgcatacgaagtatgcccagtcatccggatagggcttacaatagttgctacagtgccggcgtatttcacctgcaccagggagatatcctttctgtgattatcccacgggcgagggctaagcttaatctgagccctcatggcaccttcttgggtttcgtcaaactgtag

SEQ ID NO: 5554 - DNA, 1437 bp, Artificial Sequence
  Description of Artificial Sequence: Synthetic coding sequence
atgtcacctcccctactcaaactgggggccgtcttgagcaccatggccatgatttctaactggatgtctcagaccctccctagtttggtgggccttaacactacacgtctgagcacaccagacacactaacacaaattagcccgaaggaagggtggcaagtatacagcagtgcccaagaccccgacggccgatgcatttgtacagttgtcgctcccgagcaaaacttgtgctcaagagatgccaagagccggcagctccgtcagctgctagaaaaggtccagaacatgtctcagtctattgaggtcctgaatctcaggacccagcgcgattttcagtatgtactcaaaatggaaacacaaatgaagggcctcaaggccaagtttcgacagattgaagacgatagaaaaacactcatgacaaaacatttccaggagctgaaagaaaagatggacgaactcctgccacttataccagtgctggaacaatacaagacagacgctaagttgatcacccagttcaaagaagagatccggaacctatccgcagtgctgaccggcatccaagaggaaatcggcgcatacgattacgaggaactccaccagcgggttctctccttggaaacccggttgcgagactgtatgaaaaaactcacctgtggcaaactcatgaaaatcactggaccagttacagtaaaaacctcagggaccaggtttggcgcatggatgactgacccactggctagcgagaagaacaatcgggtgtggtacatggacagctacaccaacaacaagatcgtccgagaatacaagagtatcgccgattttgtgtccggggcggaatcaagaacgtataatctcccttttaaatgggccggtacaaatcacgttgtgtataatggctccctatacttcaataaataccagagcaatattataattaaatatagttttgacatgggccgagtcctggcccagcgcagtctcgagtacgccgggtttcacaacgtgtacccttacacctggggcggcttttcagacatcgatcttatggccgacgaaatcggcctttgggctgtgtacgccaccaatcaaaacgctggaaatatagtcatctcccaactgaaccaggacaccttagaggtgatgaagtcttggtccaccggttacccaaagagatctgcgggggaatcctttatgatctgtggcaccttatacgtgaccaattctcatttgacaggagctaaggtctattactcctactctacgaagaccagcacctacgaatacactgacatccccttccacaatcagtattttcatattagtatgctggactacaacgcaagggatcgtgcactatacgcttggaataacggtcatcaggtccttttcaatgtgacactgttccacattataaaaactgaagacgatacctag

SEQ ID NO: 5555 - DNA, 1101 bp, Artificial Sequence
  Description of Artificial Sequence: Synthetic coding sequence
atggctagagaaagacccccaggaagaggttgtggagtcctacggcgctgtctgctcggcgcagtccttttattcgggctcagattgtgcgccgagctgcggcgcgccggtcctggatctcccacccggtctgccccacctggcccagcctggcgcccccctggacctcacctcccacctgcaccaggtcagccaaggggggccagcagacgtcaggttacctatgtgcgcagcggaagaagagccccacccggcgggggaggctccggtactccagagcctggctgttgcgcccccaggggaagacctcgcagaaaaggcccaagatggcacatagatctgcagccttgggcaggaagtgcccagagtctggacgaagaagcatggagatttctgcgctatatctcaacgacccaaattgcttgtaaccatatgaacacggatagtctcgctacggatagtagtccgacccataagccgtggtctgtgtgcctggacgatcggttcaatctcgctcaccagatacggaacaaacagtgccgcttgtacagcctaggattggggagcgacgatacgcatttcgaggtaagcatggctaataatggctgcgaggtccaccggttcgaccccagtgtgaagtccgcccacattctcgagtcacagcatctgtggtaccaccggctctcaatcgattggagagatccccacccggccgtagccgcccagaaacctcactccaacacgagaaagttgggatccattctgaatgagtttgggcaccacaagatcgatgtgctgaaggctgatttagaaagtgcagagtggaaagtccttgaaaatctgatcctggaggacgtgttagaacagattgggcagttaatcttcgaaatccatctccactggcctggttttgaagtttccggcagcgattcgtccgttgtcagattctggtatagcctgttaaaggagttggaacaaaaagactttcggctgtttcatagctacaaggatttgtctaagcctcagctgttcctcaagaaagacatttttaacgctagtagctgctacacattgtcctgggtgaatacacgatggaagtag

SEQ ID NO: 5556 - DNA, 300 bp, Artificial Sequence
  Description of Artificial Sequence: Synthetic coding sequence
atgaagatcccagttctgccagccgtggtcctgctctcactgctggttcttcactctgcgcagggggctactctgggaggccccgaggaggagagcaccatcgaaaactatgcatcccgcccagaagctttcaacacaccattcctgaacattgacaagctgcgaagtgcatttaaagctgacgagtttctgaactggcatgccctatttgaatcaattaaaaggaaattgccttttctgaattgggacgccttccccaagttgaagggactaagaagcgccactccggatgcgcaatag

SEQ ID NO: 5557 - DNA, 618 bp, Artificial Sequence
  Description of Artificial Sequence: Synthetic coding sequence
atgatgcgaacgctgatcacaacccatcctctccccttgctgctcctgcctcagcagctcctgcagctcgtccagttccaggaagttgacacagactttgacttcccagaggaggataagaaggaagaatttgaagaatgtctggaaaagttcttctctactggtccagctaggcctccaaccaaagaaaaagtgaagagaagggttttgattgagccaggcatgcctctgaaccacatcgaatattgtaaccacgaaataatggggaagaatgtgtactataagcatcgctgggtagctgagcattatttcctgctgatgcagtatgatgagttacaaaaaatctgttataatagattcgtcccttgcaagaacgggattaggaagtgcaatagaagcaagggtctggtggaaggagtatactgcaatctgaccgaagcttttgaaatcccggcgtgtaagtatgagagtctgtacaggaagggatatgtgctgataacgtgctcctggcagaacgaaatgcagaaacgcataccccacaccattaacgacctcgtcgaacccccggaacaccgctcctttctcagtgaggatggggttttcgttataagtccgtag

SEQ ID NO: 5558 - DNA, 402 bp, Artificial Sequence
  Description of Artificial Sequence: Synthetic coding sequence
atgctagactggcgcctggcctccgcacattttatcctggctgtgacattgaccttgtggtctagcggaaaggtgctctcagtggacgtgacaacaaccgaagcattcgacagcggcgttattgacgtgcagtctacccctaccgtgcgtgaggagaaatccgcaactgacctgactgctaagctcctgctgctagatgagctcgtgtcactggagaatgacgttattgaaacaaaaaaaaagcggagcttctccggattcgggtcaccactggatcgtctcagtgcaggctcagtggaccataaaggcaagcagaggaaggtggtggaccatcctaagcggcggtttggcatacctatggatcggataggacgaaatcgcttatcaaattctcggggatag

SEQ ID NO: 5559 - DNA, 846 bp, Artificial Sequence
  Description of Artificial Sequence: Synthetic coding sequence
atgggatctcggggacaggggctcctgttggcctattgcttgcttctagcttttgctagcggtctcgtcctaagccgcgtgcctcacgtgcagggtgagcagcaagagtgggagggaaccgaggaactgccgtctcctccagatcacgcggagagggctgaggaacagcacgagaaatatcggccatctcaggaccagggcctgcccgcaagcagatgtctgaggtgctgtgatccaggaacatccatgtaccctgcaactgcggtgccccaaataaatatcaccatccttaagggagaaaagggtgaccgtggagatcgcgggcttcaggggaagtatggaaagacgggttctgccggtgcgagggggcacaccggaccaaagggccagaaaggctcgatgggcgctccgggcgagagatgtaagtcccactatgccgcattctctgtcggtagaaaaaaacctatgcactcaaatcactactaccagacagtgattttcgataccgagttcgttaatctatacgaccacttcaatatgtttactggtaagttttattgctacgttccgggactgtacttctttagtcttaatgtgcatacatggaatcagaaggagacatatctgcacataatgaaaaacgaggaggaggtggtaatcctattcgcccaagttggtgaccgatcaattatgcagtcccagtctctcatgctcgagttgcgcgaacaggaccaagtatgggtccgcctgtacaaaggagagcgcgaaaacgctattttctccgaagagctggatacttatattaccttctccggttacctggtcaagcacgcgacagaaccttag

SEQ ID NO: 5560 - DNA, 132 bp, Artificial Sequence
  Description of Artificial Sequence: Synthetic coding sequence
atgaaattgttgtatctgttcctcgctattctgcttgccatcgaagagcctgtgatttctgcgctggtgcgcacagtgggctgctgtctcgacacagcgaggcagacgcctcatccctccatgcatgggtag

SEQ ID NO: 5561 - DNA, 861 bp, Artificial Sequence
  Description of Artificial Sequence: Synthetic coding sequence
atgaaagtgctcctgctgacaggactgggtgccctgtttttcgcctattattgggatgacaatttcgaccccgcttcattacaaggagccagagtgcttctcactggagcgaacgccggcgtcggggaagagcttgcttaccactacgccagactgggttcccatctcgtcctgacagctcatacggaggcacttctacaaaaggtcgtgggcaattgtagaaagctgggagcccccaaggtgttttatattgcggccgacatggcaagcccagaggctcctgaatccgtagtccaatttgccctcgacaagcttggagggttggactatctggtattgaaccacattggcggggcaccagccggcactcgagcacggtctccacaagcgacccggtggctgatgcaagtgaatttcgtaagctatgttcaactgacaagccgggctcttcctagcttaactgactctaagggctcactcgtggtggtctcgagtcttctggggagagtgccgacctcttttagtacaccctattccgccgctaagtttgctctggacggcttctttgggtctctgcgtcgtgaactcgatgtccaggatgttaacgtagccattaccatgtgcgtgctgggcctgcgtgatcgtgcttccgctgcagaggctgtccgaggcgtgacccgtgtgaaggctgctcctggccccaaggccgctttggcagtgattcggggcggggctaccagagctgcaggagtgttttatccctggcggtttcgactcctgtgtttgctgcgccggtggttgccgaggcccagggcgtggttcatcagacaggagttgaacgttaccgctgctgctgcctag

SEQ ID NO: 5562 - DNA, 1326 bp, Artificial Sequence
  Description of Artificial Sequence: Synthetic coding sequence
atgagagtagttacgattgtgatcctcctctgcttctgcaaggctgccgagcttcgcaaggctagtccaggctcagtgagaagtcgggttaatcacggcagagcgggcggaggtaggcgggggtctaaccccgtcaagcgctacgcacccgggctgccgtgtgacgtgtatacatacctgcacgagaagtacctcgactgccaggaacggaagctggtctacgtgctgcctggttggccacaagacctcctgcacatgttgttggccagaaacaaaataaggaccctgaagaacaatatgttttccaaatttaaaaaactcaagtcactggacctgcagcaaaatgagatctccaaaatcgagtctgaagctttcttcggactcaataaactgaccacgctgctcttacagcacaaccagataaaggttcttactgaggaggtctttatctacacaccgttgctgtcctatctgcgcctttatgacaacccatggcactgtacatgtgagattgaaacactgatttctatgctgcagataccacggaatcggaatttgggcaattacgcgaagtgtgaaagcccgcaggagcaaaaaaataaaaagctccggcagattaaatcggagcagctctgcaacgaagaagaaaaggagcagctcgatccaaaaccacaggtaagtggccgtccccccgttattaaacccgaggtggatagcaccttttgtcacaattatgtgttcccaattcagaccttagattgcaaaaggaaagagctgaagaaagtgccgaacaatataccccccgatatcgtcaaactggatttatcatacaacaaaattaaccaacttaggcccaaagagtttgaagacgttcacgagctgaagaagcttaacctgtcaagtaatggcatcgaattcatagacccagccgcattcttgggactgacccaccttgaggagttagacctcagtaataatagcctgcaaaacttcgactacggggtattagaagacctgtattttctcaaactgctgtggctaagggacaacccctggaggtgtgattacaatattcattacctgtattattggcttaaacatcactacaatgttcacttcaacggactcgaatgcaaaactccagaagagtataaaggttggtctgtcggtaagtacattagaagctactatgaagagtgccctaaggataaactaccagcctatcccgagtccttcgaccaagatacagaggatgatgaatgggagaaaaaacatcgggatcacaccgccaaaaagcagagtgtgatcattacgatcgtgggctag

SEQ ID NO: 5563 - DNA, 1539 bp, Artificial Sequence
  Description of Artificial Sequence: Synthetic coding sequence
atggcagaatctggcctggcgatgtggcctagtctccttttgcttctactgctccccggccctccaccagtcgcggggctagaggatgccgcctttccacatctgggagagtcgttgcagcccctgccacgcgcatgtccactacgctgttcctgtcctcgggttgacactgtggactgtgacggcctggacctgcgcgtgtttccggataacatcactcgagccgctcagcacttgagcctccagaacaatcagctgcaagaactgccctacaacgaactaagccggctgagtgggctcaggactctcaacctccataataatctgatctccagcgaagggctgcccgacgaggcattcgaatccttaacccagctccaacacctgtgtgtggcccataataagctcagcgtggctcctcaattcctgccaaggtcactgcgggtggccgatctggccgcaaaccaagtgatggaaatatttcccttgaccttcggcgagaagcccgccctgcggagcgtgtatttgcataacaatcagctcagcaacgccggattacccccggacgccttcaggggctctgaagcaattgctacactgagcctgtccaataatcagctcagctacctgccaccttccctccccccgtcgcttgagcggctccatctccagaacaatctgattagtaaggttccccggggggccctcagccgtcagacccagctcagggaactctacctgcaacacaaccagcttacagatagtggtctcgacgccacgactttttccaaactgcattccttagagtatctcgacctgtcacacaatcagctaacaaccgtccccgcggggcttccccgcacactggccattctgcaccttgggcggaataggataagacaggtcgaagccgcgagattgcacggcgcccgaggattacggtatttgttattgcagcataatcagctagggagttccggattgccagctggggccctcaggcccctaaggggattgcacacactccacctgtacgggaatggcctggaccgggtcccacctgctctgccacgtcggcttagggcactggtgcttccccacaaccacgtcgcagccctcggagcacgcgatctcgtggctacgcctggcctaaccgagctgaatctggcctacaatcggttggcttccgctcgcgtgcaccaccgggcttttcgtaggcttagggcattaaggagtctggatctcgccggcaaccaactcacaagacttccaatgggactgcctacagggcttaggaccttacagttgcagcggaaccagcttagaatgctggagcctgaacccctggcgggtctggaccaattaagggagttgagcctggcgcacaacaggctcagagttggagatattgggccaggaacatggcatgagctgcaggcactgcaggtcaggcacaggctggtgagccacacggttccccgcgctccaccgtcaccttgtcttccttgtcacgtgccaaacattctcgtctcctggtag

SEQ ID NO: 5564 - DNA, 2328 bp, Artificial Sequence
  Description of Artificial Sequence: Synthetic coding sequence
atgaaggaaggtccagaggaagcgggctctgggagatacggcccgcgctatattacagacatgggtgcgggcgaggacgacgaaggcttcgaagatgacctggatctggacatctccttcgaggaagtgaagccccttccagccacaaaaggaggcaacaagaagtttctcgtggagtcaaaaaagatgagcattagtaacccaaagactatatcgcgtttgattccccctacatccgccagcctgccagtgacaactgtggcccctcaacccattcctatacaaaggaaaggtaaaaacggcgtggctattatgagtcgactgtttgatatgccatgcgatgaaacgctgtgctcagccgattcattctgtgttaacgactatacttggggcggcagtagatgtcagtgtaccttaggcaagggtggtgagtcttgttccgaggatatcgtgattcagtatcctcagtttttcggacactcctacgtgacattcgagcctctaaaaaactcataccaggctttccagatcacgttggaattcagagcggaggctgaagatggactacttctttactgtggcgagaacgaacatggccggggcgatttcatgagcctagccattattaggagaagtttgcagttcagatttaattgtggaacaggcgttgccatcatagtgtccgaaaccaaaattaaattgggcgggtggcataccgttatgttatatcgcgatggattgaatgggctgttacaacttaataacgggacgccagtcactggccagagtcagggccagtattcaaaaattacctttcgtaccccactgtacctcggcggcgcccccagtgcgtactggttggtgcgcgccaccgggactaacaggggttttcagggctgtgtccagtcattggccgtgaatggccgtcgtatagatatgcgtccttggcctctgggtaaggccctaagcggcgcggacgtaggggaatgctcttctggcatctgcgacgaagcgagctgcattcacggcggaacttgtaccgctattaaagccgatagctatatctgcctgtgtccactcggctttaagggtcgtcactgcgaggacgctttcaccctgacgattccccagttcagagagtcgctcaggagctacgcagcaactccctggccattggagccacaacattacctgagctttatggagttcgagataacatttcgacccgatagcggcgatggagttctgctgtacagctacgataccgggagcaaagactttctcagtattaacctggctggtggacacgtggagttccgtttcgattgcgggtccggaacaggggtcctgcggtctgaagacccacttacattaggtaattggcacgagctgagggtctcccggactgctaaaaatggaatcctgcaggtcgacaagcagaaaattgtggaggggatggccgagggcggtttcacgcaaattaaatgtaacacggacatattcatcgggggcgtccccaactatgacgatgtcaaaaaaaacagcggtgtgctgaagcccttctcagggtcaattcagaaaatcattctgaacgatcgaaccatccacgtgaagcatgactttaccagcggcgtaaacgtggaaaacgctgcccacccctgtgtgagggccccttgcgcacacgggggctcttgcagaccaagaaaagaaggttacgactgcgactgtccgttgggtttcgaaggactccattgccagaaagcgatcattgaggccattgagattccccagttcatcgggcgcagttatctgacctacgataaccctgatattctgaaacgggtctctggttcgagaagtaatgtgttcatgcgctttaagaccaccgctaaagatggtctgttgctgtggcgcggagattcccccatgcgccccaatagcgattttatatcgcttgggctgcgcgacggcgctctggtgttcagttacaatctaggtagcggggtggcatcgattatggtaaacggctcgtttaatgatggtcgttggcacagagttaaggctgtgcgagacggccaaagtggtaagataactgtcgacgattatggtgctcgaacaggcaaatccccaggtatgatgagacagctgaatataaacggagccctgtacgtaggaggaatgaaggagattgccttgcataccaacagacaatatatgcggggtctggttggatgcatttctcattttaccttatcaacggattaccatatctcccttgttgaggacgccgtagatgggaagaacatcaacacttgcggtgccaagtag

SEQ ID NO: 5565 - DNA, 1431 bp, Artificial Sequence
  Description of Artificial Sequence: Synthetic coding sequence
atgaagttccagggacccctggcatgcctgctgctcgccctgtgtctgggatcaggcgaggccggccccctacagtcaggtgaagagtctaccgggacgaacataggcgaggcgttggggcacggactgggggatgccttatccgaaggagtgggaaaggctattggtaaggaggccggcggagcagctggctctaaggtgagcgaggccttaggacagggaactcgggaggcggtcggaaccggcgtgcgccaggtccccggctttggcgttgccgatgcactgggcaaccgagtcggagaggctgcacacgccctggggaacacaggtcacgaaatcggacgccaggctgaggatgttatccgtcatggggctgacgccgtaagaggatcctggcagggggtgccagggcacaatggcgcctgggagacctccggggggcacggcatctttggttcacaggggggcctgggggggcagggccagggtaatcctggcggtctgggcactccttgggtacatggctacccaggtaattctgccgggagtttcggaatgaatcctcagggagctccatggggccagggtggtaacggaggcccacccaatttcggaaccaacacacagggtgcggtggcccagccaggatacggctcggtgcgcgcgtccaatcaaaatgaaggatgtaccaatccccctccctctggctcagggggggggtcatcgaactcaggggggggaagcggaagccagtccggttcatcagggagtggcagtaatggggataacaacaatggctccagctcaggcggcagctcgagtggctcctctagcggcggcagttctggtgggtcgtccggcggatcttcaggcaactccgggggctctagaggggatagcgggagcgaatccagttgggggtcttccactgggagctcctccgggaaccacggcggctccggaggcggaaacggacacaaacccggctgcgagaaaccaggaaatgaggcccgaggaagtggagaatccggaattcaaaattcagaaactagtcccggaatgttcaacttcgacactttttggaagaacttcaagtcgaaattgggatttattaactgggacgcaattaacaaaaatcaagtccctccgccctccacgcgggctctgttgtactttagtcgcctgtgggaggacttcaagcaaaatacgcccttcctgaactggaaggcgatcattgagggggcagatgcctcatcactgcaaaagcgagccgggcgcgacgatcaaaattacaattacaaccagcatgcctacccgacagcatacggagggaagtactccgtgaagacgcctgccaaagggggagtgtcacctagctccagtgcatctcgcgtgcagccgggcctgctgcagtgggtgaagttctggtag

SEQ ID NO: 5566 - DNA, 1911 bp, Artificial Sequence
  Description of Artificial Sequence: Synthetic coding sequence
atgaccacctggtccctgaggagaagacccgcacgaactctggggcttctcctcctggtcgttttgggctttctcgtccttcgaagactggattggagcactttggtacctctcaggctgaggcaccgacagttgggcctccaggccaaggggtggaacttcatgttggaggatagtacattttggattttcggaggaagtatacactacttcagagtgcccagagagtactggcgagaccgcctccttaaaatgaaggcctgtggcttgaacaccctgacaacctacgtgccatggaacctgcacgaaccagagcggggcaaattcgatttctccggtaacctggacctggaagcatttgttttgatggcggcagagatcggtctttgggttattctgcgccccggcccatacatctgcagcgaaatggatctgggggggctgcctagctggcttctgcaggatccagggatgcggcttcgaaccacttacaaagggtttacagaagcggtggatctgtacttcgatcatttaatgagtagagtcgttccactgcagtacaagcggggcggtcctattattgctgttcaggttgagaatgaatatggcagctataacaaagatcccgcctatatgccctacgtgaagaaggcgcttgaagatcgcggcattgtggaactactgcttacatccgacaataaggatggactttctaaggggattgtgcagggcgtgctggccacgatcaatctgcagtccacacacgaacttcagctgctgaccacgtttttgtttaacgtgcaagggacacagccaaagatggtgatggaatactggaccggatggttcgactcatggggtggaccacacaacatcctcgactcgagcgaggtccttaagaccgtgagcgcaattgtggacgccggctcctccatcaatttatatatgttccatgggggcactaactttggatttatgaacggtgccatgcactttcacgactataagtctgatgtgacttcctatgattatgacgctgtcttgactgaggccggcgattataccgctaaatatatgaagctgcgcgactttttcggatccatttctggaatcccactccctcccccacccgacttactacccaagatgccctacgaaccattgaccccggtgctgtacctctcactgtgggatgccttgaagtatctgggcgagccaatcaaatcggagaagcctattaacatggagaatcttccagttaacggaggcaacggtcagagttttggctacatcctgtacgaaacaagcatcacctcaagcggcattctttctggccatgtgcatgatcgcggccaggtatttgtcaatactgtttctatcggttttctggattacaagacaaccaagatcgccgtccccttgattcagggctataccgtgcttaggatcctggtggaaaaccgaggtcgcgtcaactatggtgagaacatcgatgaccagagaaaaggactcatcgggaatctgtacctaaacgattcgccattaaaaaacttccgcatatattccttagacatgaagaaatccttctttcagcgatttggcctggacaagtggagcagcctccctgagacacccacattacccgctttttttcttggaagtcttagcatatcaagcactccctgcgacacgtttctgaagctggaggggtgggagaaaggcgttgttttcataaatgggcagaacctggggcgctattggaacatcgggccccaaaagaccctgtacttacctggcccctggctatcatcaggtattaaccaggtcatcgtgtttgaagagactatggcaggccccgccctgcaatttaccgagactccacacctaggtcggaatcagtatataaagtag

SEQ ID NO: 5567 - DNA, 672 bp, Artificial Sequence
  Description of Artificial Sequence: Synthetic coding sequence
atgacaagatggtcttcatatctgctgggttggacaacatttctgttgtactcttacgagagtagcggcggaatgcacgaggagtgtgtgtttccattcacgtataaaggttcagtgtattttacgtgcacacacatccacagcctctcaccatggtgcgcgacccgcgccgtttacaacggccagtggaagtattgccagagtgaagattacccgaggtgtatcttcccttttatctatcgcgggaaggcctataactcttgcatatcccaaggaagctttctgggctccttatggtgctctgtgacctctgtgttcgatgagaagcagcagtggaaattctgtgagacgaacgagtacgggggaaattcgctgaggaagccatgtatctttccctctatctaccgcaataacgtggtgtctgactgcatggaagacgaatccaataagctttggtgccctactactgaaaacatggacaaagacggcaagtggtccttttgcgcagacacacgaatcagtgcactcgtgccaggattcccatgccatttcccatttaattacaaaaacaagaactacttcaattgcacaaatgagggcagcaaagaaaacttggtttggtgtgcgacatcatacaattacgaccaggatcacacatgggtgtattgctag

SEQ ID NO: 5568 - DNA, 1368 bp, Artificial Sequence
  Description of Artificial Sequence: Synthetic coding sequence
atgttgcaccccgagacctcgcccggaagagggcatctgttagcagttctgcttgcgctgctcggaactacctgggcggaagtctggccaccacaactgcaagaacaggctccaatggcaggcgcactgaaccgtaaggagagttttctcctgctgagcctgcacaaccgcctgaggagttgggtgcagccaccggctgctgacatgagacgcctggattggtctgactccctagcccagttagcacaggcacgagctgccctgtgtgggattccgactcccagtctggctagcggcctgtggagaaccctccaagtcggatggaatatgcagctgctgcccgccggcctggcgagctttgtggaagtggtgtcactgtggttcgctgaggggcagcgatactcccacgcagctggcgagtgcgctagaaatgccacctgcacacattacacgcaacttgtgtgggccactagtagccaactggggtgtggcagacacctctgcagcgccggacagaccgccatcgaagcattcgtgtgtgcatactcacccggaggaaattgggaagtaaacggtaagaccataattccatataagaagggcgcttggtgctctctctgtactgcaagcgtgtccggctgtttcaaggcatgggaccacgctggaggcttgtgcgaggtccctcgaaacccgtgtcgtatgtcctgccagaatcacgggcggctgaacataagtacctgccactgccattgccccccaggttataccgggagatattgtcaggtgcgatgcagccttcagtgcgttcacggccgctttcgggaagaggaatgttcatgtgtctgtgatattggatacgggggagctcagtgcgcaactaaggtgcactttccgttccacacgtgcgacctgcgtatagacggagactgcttcatggtcagttccgaggccgatacatactatagggcacgaatgaagtgtcagcggaagggcggtgtgctggctcagattaaatctcagaaggtacaggacatcctggctttttacctgggcagactcgaaactactaacgaggtcatcgacagcgacttcgaaaccaggaacttctggattggcttaacgtacaagacggcgaaagacagctttcggtgggccaccggagagcaccaggcttttacctcatttgcctttggacaacctgacaaccacggtcttgtctggttgtcagctgccatgggctttggcaactgtgtcgagttacaggctagtgcagcctttaattggaatgatcaacgctgcaagacgagaaacaggtacatttgccagttcgcccaggaacacatctctagatggggccctggctcctag

SEQ ID NO: 5569 - DNA, 1425 bp, Artificial Sequence
  Description of Artificial Sequence: Synthetic coding sequence
atggccgacatgcagaatttagtcgagcggctggagcgcgcggttggtaggctggaggctgttagccacacttcggatatgcaccgaggatacgcagatagtcctagcaaaggcgctgcgccatatgttcaagcttttgatagtcttctcgccggaccagtcgccgaatatctgaagatcagtaaagaaatcggaggtgatgtgcagaagcacgcagagatggtccacactggactcaagctcgagcgcgcattactcgtcacggcctcacagtgtcagcagcccgcagagaacaagctctcagatctgctggcccccatctctgaacagattaaggaagtcataacattcagggagaaaaacaggggatctaaactgtttaaccatctcagtgcggtgtccgagtccattcaggcactgggctgggttgcaatggcccctaagcctgggccctatgtgaaagaaatgaacgacgcagcgatgttctacactaatagagtgttgaaagaatacaaggacgtggacaaaaaacacgttgactgggtgaaggcctaccttagcatctggaccgaactgcaggcatacattaaggaatttcacacaacgggcttagcctggtcaaagaccggccccgtggccaaagaactgtctggcctgcctagtggcccatcagctggctcttgcccacccccacctcccccttgcccgccacccccgcctgtctcgacaatctcctgctcctacgaaagtgctagcagatcttctctttttgcacagatcaaccagggagagtccataacacacgccttgaagcatgtctcagatgacatgaaaacccacaaaaatcctgccctcaaagcccaaagtgggcctgtccgctctggccctaaacccttctccgctcctaagccgcagactagtccttcccccaagagggctactaaaaaggagcccgcagttctagagttggaagggaaaaaatggcgagtggagaaccaggagaatgtatccaacctcgtgatcgaggacacagagctgaagcaagtcgcatatatctacaagtgtgtgaacacaaccctacagattaaaggaaaaattaatagcatcacagtcgataactgcaagaagcttggcctggtttttgacgacgttgtggggattgtggagataatcaactcaaaggacgtgaaggttcaggttatgggaaaagtgcctacgatctccattaacaagacagacgggtgccacgcatatctcagtaaaaattctctggactgcgagattgtgagtgccaagtcaagcgaaatgaacgtactgataccaacagaaggaggtgacttcaatgagttcccagtacctgaacaattcaagactctctggaacggccagaagctggttaccactgttaccgaaattgcagggtag

SEQ ID NO: 5570 - DNA, 360 bp, Artificial Sequence
  Description of Artificial Sequence: Synthetic coding sequence
atgaataaaattctgtctagcacggtgtgctttggcttactcacactgctttctgttttgagctttttacagtccgtgcacggcagaccctacctgacgcaaggaaacgagatctttcccgataagaagtatacaaaccgggaagaactgttactggcactgctgaacaaaaacttcgactttcagcggccttttaataccgaccttgcccttcctaacaagctggaagagctgaaccagctggaaaaattgaaggagcaactcgtggaggagaaagacagtgagacaagctacgcagttgatggtctatttagctcccacccgagcaaaagggcgtgcttttggaagtactgcgtatag

SEQ ID NO: 5571 - DNA, 3756 bp, Artificial Sequence
  Description of Artificial Sequence: Synthetic coding sequence
atgcgactcctactgctcgtccccctgctgctggcgcccgcacctggcagctcagcaccaaaggtgaggagacagtcggatacctgggggccatggtcacagtggtcaccttgttcaagaacatgtggaggcggagttagctttcgggagagaccatgctacagccagagaagagacgggggctcctcttgtgttggcccggcccgtagccacaggtcatgtcgcacggagtcatgccctgatggcgcacgggattttcgggccgaacaatgtgcggagttcgacggtgccgaatttcaagggcggcgctaccggtggcttccttactactcggcccccaacaagtgtgagctgaattgtataccaaaaggcgagaacttttactacaaacaccgggaggcagtcgtcgatggaacgccctgcgagcccggtaagagggatgtgtgtgtggacggaagctgccgggtggtaggatgtgaccacgaacttgattcctccaagcaagaggacaagtgtcttagatgcggcggagacggtaccacttgctaccctgtggctgggacattcgacgccaatgatctctccagagctgttaagaacgtgagaggtgagtactacctcaacgggcattggactatagaggctgctagggccctgccagcagcttccaccatcctgcactacgagaggggcgccgagggcgaccttgcccctgagcgcctccatgcccgcggtccaacatcagaaccactcgtgattgagctgatctcccaggagccgaaccctggcgtgcactatgagtatcatcttccgctgcgacgacccagccctgggttctcctggtctcatgggtcttggagcgactgttctgctgaatgtgggggtgggcaccagtctcggctggtcttttgcacgatcgaccatgaagcttaccctgatcatatgtgtcagcgccagccccggcctgctgataggcgatcctgtaacctgcacccttgccctgaaacaaaacggtggaaagccggcccatgggctccgtgtagcgcaagttgtggaggcggctctcagtcccggtctgtctattgcatctcatccgacggtgcggggatccaagaagcagtagaggaagctgagtgcgctgggttgcccggaaaaccgccagctattcaggcctgcaacctccagcgttgtgccgcctggtcaccggaaccgtggggcgagtgtagcgtgagttgtggtgttggagttcgcaaacgttcggtcacttgccgaggcgaacggggatctctactgcatactgctgcgtgctccctggaggatcgaccaccgctgactgaaccttgtgtgcacgaggactgtccactcttgagtgaccaggcctggcacgtaggcacttggggtctttgctcaaaatcctgcagtagcggcacgagacgcagacaggtcatatgtgccataggtcccccctctcattgcggctccctccaacattcaaagccggtcgatgtcgagccctgtaatacccagccctgtcacttgcctcaagaggtgccatctatgcaagacgttcataccccagcttccaatccctggatgcctctgggtccccaggagtcacctgcttccgactctcgcggtcagtggtgggcagcccaggagcacccgagtgctcggggcgaccaccggggggagcgcggcgatccaaggggggaccagggtacccacctgtcggccttaggtccagcacctagtttacaacaacccccctaccagcagccgctgagaagcgggagcggcccccatgactgccggcattccccccacggatgctgccccgacgggcatactgccagcctgggcccccagtggcagggctgtccgggtgcaccttgccagcagtcccgttacgggtgttgccccgaccgggttagcgtagctgagggcccacaccacgctgggtgtaccaagagttatggcggcgatagtaccggaggcatgccccggtctcgcgccgtagccagtacagtgcacaatacccatcagccccaagctcagcagaacgagcccagcgagtgtcgcggtagtcagttcggatgttgttacgacaatgtcgcaacagccgccggacccctaggtgagggctgtgtggggcagccctcacatgcttaccccgtcaggtgcctattgcctagtgcccatggcagttgcgcagactgggcggcccgatggtacttcgtggcttctgtcgggcaatgtaatcgtttttggtacggaggctgtcacggcaatgcgaacaactttgccagcgagcaagaatgtatgagctcttgccagggatcactgcacggtcccagacgcccgcagccaggtgcttccggaaggagcactcatactgacggaggggggtcaagccccgctggagaacaggagccatcgcagcatcggacaggggccgccgtgcaacgcaagccttggcccagtggtggcctgtggaggcaggatcagcagcctggtcccggagaggccccccacacacaggctttcggcgagtggccatggggacaagagctcggctctcgggcccctggactgggtggtgatgcaggctctccggccccaccattccactcctcatcatacaggatctccctagccggagtggagccatctctggtccaggcagcgttagggcagttggtgaggctgtcctgttctgacgatacagcgcctgaaagtcaggccgcttggcagaaagacggacagcccatatcctcagatagacaccgccttcaattcgatgggtcactcattattcaccctctgcaggctgaggacgccggaacatactcatgcgggtctactagacctggaagagacagccaaaagatccagctgaggataattggcggggatatggcagtattgagcgaggctgaattgagccgatttcctcaacctagagacccggcgcaggacttcggtcaggctggggcagccggcccactcggggcaattccgtcaagtcacccccagccagcgaacaggctccgcttagaccagaaccagccgcgcgtcgtggatgctagccctggccagcggatccgcatgacgtgcagagccgaaggcttccctccgccagccatcgagtggcaaagggatggtcagcccgtcagcagcccacgtcaccaactccagccagacggatctttggtgatttcacgtgtagccgtggaagatgggggcttttacacctgtgtggccttcaacggccaggatcgagaccaaaggtgggtgcagttgcgtgtgttgggagaactgactatttccggtcttcccccgactgtaacagtccctgagggggacacagcaaggctgttatgcgtggtggccggagagagcgtgaatattcgctggtctcgcaacgggctgcccgtgcaagccgatggacaccgcgtgcaccagagtccagacgggacccttctgatatataacttaagagcaagggacgaaggcagctatacgtgcagcgcctaccagggatcgcaggcagtgtctcgatccactgaggtgaaagtggtgagcccggcaccgaccgcccagcctcgagacccgggccgcgattgtgtggatcagccagagctagcaaattgcgatttgattttacaagctcagttgtgcgggaacgaatactattcttctttctgttgtgcgtcctgttctaggttccagccccatgcccagcctatatggcagtag

SEQ ID NO: 5572 - DNA, 1731 bp, Artificial Sequence
  Description of Artificial Sequence: Synthetic coding sequence
atggcacagggggtcctatggatactgctggggctactgttgtggagcgacccaggtactgcctctctcccattgctgatggactccgtaattcaggccctggccgagctcgaacaaaaggtacccgcggctaagacccgccacacagcctctgcttggctaatgtccgcaccaaactctgggccacataatcgattgtaccacttcctgctgggcgcatggtcgctcaatgccacggaactagacccatgtcccctgtcacccgaactgctgggacttactaaggaggtggcgcggcacgatgtgcgcgaggggaaggaatacggggtggtcctggcacctgacggatctaccgtagctgttgagccattgctggcgggactagaggctggcctccagggacgaagagtgattaacctcccattagactctatggccgcgccttgggaaaccggcgacacatttcctgatgtggtcgctatcgcccctgacgtgagggctacttcatcccccgggctgcgtgatggctccccagatgttactaccgctgatatcggagccaacacaccagatgctaccaagggatgtcctgacgtacaggcatccctgccggatgctaaagcaaagagccccccaaccatggtggactctctgctggcagtcaccctggccggcaacctggggctcaccttcctgagaggcagccagacgcagtctcatccagacctggggacagaggggtgttgggatcagctgtcggcacctagaacttttacattattggatccaaaagctagcttgttaaccatggcttttctcaatggggccctcgatggcgtgatcctcggtgactatctgagtcggacgcccgagccaaggccaagcttgagccatctgctgagccagtactacggcgctggcgtagcccgcgatcctggatttcgatctaatttcagacgtcaaaacggagccgcacttactagcgcttccatattggcacagcaggtctggggaaccctcgtgttacttcaacgacttgaacctgtgcatctccaattacagtgcatgagccaggagcagctggctcaggtggctgccaacgccactaaagaattcactgaggccttcctcggatgtccagccattcatccccgatgccggtggggtgcagctccatacagaggaagaccaaaactgctccagcttcccctcggattcctgtacgtccaccacacatatgttcccgcaccgccatgcacggattttacacggtgcgcagcgaacatgcggagtatgcagcgctaccatcaggatacccaagggtggggagatatcggatatagctttgtggtgggttccgatgggtacgtgtatgaaggacgcggatggcattgggtgggtgcccacactcttggccataacagccggggcttcggggtcgcaatcgtcgggaactataccgctgccttaccaacagaggctgctcttaggactgtgcgggacaccctgccttcatgcgctgtaagggccggactattgcgccctgactacgccctcctcgggcatagacagcttgtgcggacagattgtccaggtgacgccctctttgatctgctacggacatggccccacttcacagccacggttaagccacgccctgcacgctccgtgagcaagaggtcccggcgtgagcctcctcctcggacactacccgccaccgacttgcaatag

SEQ ID NO: 5573 - DNA, 846 bp, Artificial Sequence
  Description of Artificial Sequence: Synthetic coding sequence
atgttgccaaagagtcgcagagcactcactattcaggagatcgccgccttggctaggagcagtctccatggcatttcccaggtggtgaaggaccatgtgaccaagccaactgcaatggctcagggcagggtggcccacttgatcgaatggaaggggtggtccaagccttctgatagccccgcggcactggagtccgccttttcctcctatagtgatctctccgaaggggagcaggaagcacgctttgccgccggcgtggctgaacaattcgctatcgccgaagcaaagttacgagcatggagctcagtcgacggtgaagactccactgacgacagttatgatgaggacttcgccggggggatggacaccgacatggctgggcaactcccacttggcccacacctccaggacctctttacaggacatagattctccaggcccgttcgccagggatctgttgagcctgaatccgactgctcccagacagtctctcccgataccttatgctccagtctgtgctctttggaagatggtctgctggggagccccgccaggctggcaagccagctcctgggcgacgaacttctcctggcgaagttacccccaagccgagagagtgcgtttaggtctttaggacccctggaggcccaggatagtctgtataactccccccttaccgaaagctgtctttcacccgccgaggaagaacctgcaccctgtaaagactgccaaccactgtgcccccctttaacagggagctgggaacgacagaggcaagcaagcgatttggcaagttctggtgtggtctcactggatgaggacgaggccgaacctgaagaacagtag

SEQ ID NO: 5574 - DNA, 2619 bp, Artificial Sequence
  Description of Artificial Sequence: Synthetic coding sequence
atggggatcgtctggatcttgatgtccgtcttgccatggtgggggcgatgtgcagatctagcgattgcaagcactcagctggtgcccagcaccgcctctgcccgtatggccctgtcttcgcagctgatgggccgcaccgtgtggacaccaatgagtgctagcgccttacaggagcccgcctaccccgccttggctcggacatccagggcgccatccgcagcctcggtccccctggccagcaggtgtcgggtgacgacagccctaatcagtacttctgctcagagatcccccacaagtgcgtcgcttgccccggtgccgactgctttgggcgcgtctagcgcctccgctcacttagcactgagcagtctgaccatgggcacagtggctttaacacatggaagggtaagcgcgtcacccgtgctgcgtctgggctctgcacgctgtcctaagctgagcactcccccccgtcctgcagccgctgccgtgcgaggcctggggagagctggtgagaccccggctaactgtgtaccaagaagggcagtgcccggcccggatgattcccgagaggacgtcaacgaatgtgccgaaaaccccggcgtctgtacaaatggcgtgtgtgtgaataccgacggatctttcaggtgtgaatgtccatttgggtacagtctggatttcaccggaatcaattgcgttgacactgacgaatgtagcgtgggccacccgtgtgggcaggggacttgcaccaacgttattgggggcttcgaatgtgcgtgtgctgatggattcgagccaggactcatgatgacgtgcgaggatattgacgaatgttccctcaatcccttactgtgcgcttttcgatgccacaacactgaaggatcctacctatgtacttgtccagccggctatacccttagagaggatggcgccatgtgccgagatgtcgacgaatgcgcggacgggcaacaagactgccacgcacgcggcatggaatgcaaaaacttgataggtaccttcgcctgcgtttgtccacctggtatgcggcccctgccgggcagcggtgaaggatgtacagatgataatgagtgtcatgcgcagcccgatctatgcgttaacggacgttgcgttaacacagctgggtccttcaggtgcgattgcgatgaaggctttcagccaagcccgacattgacggagtgccacgacatccgacaggggccttgtttcgccgaggtgctgcagactatgtgccgcagccttagctcttctagtgaagcagtaacaagagcagagtgctgttgcggcggagggcggggctggggaccccgctgcgagctttgtcctctgcccggtacttctgcatacagaaagctctgtccacacggcagcgggtacaccgctgaaggcagagacgtggacgagtgcaggatgctcgctcacctctgcgctcatggagaatgtattaattctttagggtccttccggtgtcactgccaggccgggtatacaccagacgcaacagctaccacatgtttagacatggatgaatgtagccaggtgccgaaaccctgcacttttctgtgcaagaacacaaaggggtcttttctctgttcgtgtcccagaggctacctccttgaagaagacgggcgcacctgcaaggatctcgacgaatgcacatccagacagcataattgtcaattcttgtgtgttaacacggttggggccttcacctgcaggtgccccccgggctttacgcaacaccatcaggcatgcttcgatgttaacgaatgcgacggcccccatcggtgccaacacgggtgtcagaaccagctgggcgggtatagatgctcatgtccccagggattcactcagcacagtcaatgggcccaatgcgtcgacgagaacgagtgcgcccttagcccccctacctgtggctccgcctcctgtagaaacaccctgggtgggttcaggtgcgtttgtccgagcggctttgatttcgatcaggctctgggcggctgccaggaagtcgacgaatgcgcgggccggagagggccatgctcttattcttgcgccaacacccccgggggctttctttgtggctgtccacaggggtattttcgggctgggcagggacattgcgtctcaggccttggattctcaccaggtcctcaagacacccctgacaaagaagagcttctttcctctgaagcctgttacgaatgcaaaattaatgggctctcaccaagagatcgcccccgtagatccgcgcacagggaccatcaggtgaacctggcgacgttagactctgaggcccttctaacactagggctgaacctatcccacctgggtcgggccgagagaattctggagctgagaccagcattggaagggctcgagggcagaattcgatatgtgatcgtgcggggaaacgagcagggtttctttagaatgcatcacctccgtggcgtttcctctttgcagctgggccggaggcgccccggaccaggaacatatcggctcgaggtagttagccacatggcagggccatggggggtgcagccagagggacagccgggaccgtgggggcaagcgctgaggctcaaagtacagctccaacttctgtag

SEQ ID NO: 5575 - DNA, 1368 bp, Artificial Sequence
  Description of Artificial Sequence: Synthetic coding sequence
atggcccggaaggcactgaaactcgcttcatggacatccatggccttggctgcatcaggtatttatttctacagcaataagtacctggatcctaacgacttcggcgccgtgcgagtaggcagggctgtcgcgactacagcagtcatttcttacgactacctaacctcactcaagtctgtgccttatggttcagaggagtacctacaactcagatcaaagatccacgatctcttccagagcttcgacgacactcctctgggcacagccagtctggcccaggttcacaaggcagtgttgcacgacggccggacggtggctgtgaaagttcaacacccaaaagttcgcgcacagagttctaaggacatcctccttatggaagtgctggtcctagccgtgaagcaactgttccctgagtttgagttcatgtggctcgtagatgaggcaaagaagaacctccctcttgaacttgattttttgaatgaagggagaaatgctgagaaggtttcccagatgttgcggcatttcgatttcctgaaagtcccgcgaatccactgggatctgtccacagagcgtgtgctcttgatggaattcgttgacggaggacaggttaacgatcgggattacatggagaggaacaaaatcgatgtgaatgaaatcagccgtcacctcgggaagatgtattcagagatgatttttgtcaatggtttcgtgcattgcgacccccaccctggtaacgtgctggtgaggaagcatcctgggactgggaaagcagaaattgtcttactcgatcatgggctgtaccagatgctcacagaggagtttaggctgaactattgtcacctgtggcaaagtttgatatggactgatatgaaacgagtgaaggaatattcacagcggctgggagcaggcgatctgtatcctcttttcgcatgcatgctgacagcgagatcttgggattcagtgaatcgcggtattagccaggccccagttactgccaccgaggatcttgagattcggaacaatgccgccaattatctgccccagatttcacacctgctgaaccacgttccgcgacagatgctgctcatcctgaagaccaacgatttgctgaggggcattgaagccgcgctcggaactagagctagcgcctcgtcctttctcaacatgagccgctgctgcattcgcgcactcgccgagcataagaaaaagaatacttgttcatttttcagaagaacgcagatttcgttttccgaagcattcaacctgtggcagatcaacctccacgaattgatcctgagggtaaagggcctcaaattagctgacagagttcttgcgctgatctgctggctgttccctgcaccgttatag

SEQ ID NO: 5576 - DNA, 1245 bp, Artificial Sequence
  Description of Artificial Sequence: Synthetic coding sequence
atgaaccctaccctgggtctggccatctttctagctgtccttttgaccgtaaagggactgcttaagcctagcttcagcccaaggaactataaagcactgagcgaggtgcagggttggaagcagcggatggccgccaaggaactggctcggcagaacatggatctgggcttcaagctgctgaaaaagctggcattttataatcccggaagaaacattttcttgtccccgctgtccatctcaacagctttctccatgttatgtctgggcgcccaggactccaccctcgatgaaatcaaacagggatttaattttagaaaaatgccagaaaaggatcttcacgagggatttcactacataatacacgaactgacacagaagactcaggatctcaagctctccattggaaatacgctgtttatagatcagaggctgcagcctcaaaggaaattcctcgaagacgccaagaacttttattctgccgagactatcctgaccaacttccagaatctggaaatggcacagaagcaaatcaacgatttcatttcacaaaagacgcacgggaaaataaacaatctcattgaaaacattgatccgggcaccgtgatgctgcttgcaaactatattttttttagggcccgctggaagcacgaatttgacccaaacgtcaccaaggaagaagattttttcctggagaaaaacagctctgtcaaggtacctatgatgtttagatctggaatctatcaggttggctacgacgacaagctctcatgcacaatcctggagatcccctaccagaaaaatatcacagcgatttttatcctacccgacgaggggaaattaaaacacttggaaaaagggctgcaggtggacacattttcgcgttggaagacactcctatctagaagggttgtggatgtctccgtgcctcgcctccacatgaccggtacattcgatttgaaaaaaacgctgagttatatcggggtcagcaaaatatttgaggagcacggggatctcactaaaattgcacctcaccggtccctgaaggtaggcgaggctgtgcataaagccgaacttaaaatggacgaaagagggacggaaggggccgcaggtacaggagcccagactttgccaatggagacacccctggtagtgaagattgataagccctatctgctgcttatctacagtgaaaaaattccatcggtgttgtttttaggcaaaattgtaaatccaatcggtaaatag

SEQ ID NO: 5577 - DNA, 942 bp, Artificial Sequence
  Description of Artificial Sequence: Synthetic coding sequence
atgagcgacttactcctgctgggtcttattgggggcctcactcttctactgctgctgactttattggctttcgccggttactcgggtttactcgccggagtcgaggtttcagccggatcccccccaatcagaaatgtgaccgtggcctacaagttccacatgggcctgtatggcgagaccggacggctattcaccgaaagttgctcaataagccctaagctgcgtagcatcgcagtgtactacgacaatcctcacatggtccctcctgacaaatgtcgctgtgctgtcggtagtatcctgagcgagggggaggagagtccctcccccgaactcattgatctttatcagaagtttggcttcaaggtctttagcttccctgccccaagccacgtggttacagctacatttccttacacgacgattctgagcatctggctggctacgagaagagtccatccggccctcgatacctacattaaggagcgcaaactgtgcgcctacccgcgcctcgaaatttaccaagaggatcagatccatttcatgtgccctctcgccaggcagggcgatttttacgttcccgagatgaaggagactgagtggaaatggcgggggctcgtggaggctatagacacacaggtagatggcactggggcagacacaatgagcgatacttccagcgtctcccttgaagtgagccctgggagtcgcgagacgtcagcagcaacactttctcctggagcctcttctagaggatgggacgatggggacactagaagcgagcattcctacagcgagtctggcgcaagcggtagctctttcgaggagctggatctagagggggaggggcccttaggagaatctcgccttgaccctggcacggaacctctcggaacgacgaaatggctgtgggaacccactgccccagaaaaagggaaggaatag

SEQ ID NO: 5578 - DNA, 603 bp, Artificial Sequence
  Description of Artificial Sequence: Synthetic coding sequence
atggcttggggaggtgtccacacctgctgttttcatctctgttgctgctgttcatggccacaaggcgccgtcccagaagaacttcataagcatccgggacagactctgctgctccagtgccagtacagccccaagcgcgggccttaccaaccaaagtcttggtgccaacagacgagcccatccaggtgtaccttactagtcacatcatctaagccatggaccgcggttcaaaagtcgcactacaccatctgggataagccaaatgccggattcttcaacatcaccatgatccagctgacacaaaatgactctggcttctattggtgcggcatttacaacgcatcagagaatatcatcacagtactcagaaatatttcgctggtggtgagtccagctcctacaaccagtccaatgtggaccctcccatggctcccgacgagtaccgtgctcattacatcaccagaggggacatctggtcacccaagcatcaatgggagcgaaacaagaaagtctagggcacccgcctgcttaggcagcgggggcccgcgtttcctggtgctggtgctctgtggtctgctgctagccaaaggcctgatgctgtag

SEQ ID NO: 5579 - DNA, 1035 bp, Artificial Sequence
  Description of Artificial Sequence: Synthetic coding sequence
accacccccagcagagctttgccaggatggagcaattgtcgacccaggtggagagcagggccgactccacagagtccaaccccccagagccgtatgcgtctgtcacccggccccccctcggaatggacctggctcctgccccattttaacccgtgccatcatcaccacagacaccatcatcccaatcctacaactagcctgttgcccactgaacctcctagcggcccagaagtatcgagtcagggcagggaagcatcgtgtgagggaactttgcgtgcggtggatccccccgtgcgccatcacagctacggccgccacgaaggggcttggatgaaggacccagcagcccgggatgaccgaatctacgtgaccaactattactacggaaactccctagtggaatttcgtaacctggaaaactttaagcagggcaggtggagtaacatgtacaaactgccatataattggatcggcaccgggcacgtggtatatcagggagccttctactataacagggcattcacaaaaaacatcatcaagtacgacctgagacaaagatttgtggcgagctgggcactcttacccgacgttgtatacgaggatacaactccttggaagtggagagggcattccgacatcgatttcgccgtggacgagagcggcctgtgggtgatctatccagccgttgatgaccgagacgaggcccagcccgaggttatcgtactatcaagattggatccaggcgacctgtccgtacatagggagacgacatggaagacaagactgcgccgcaattcttatgggaattgctttctggtgtgtggaatcttatacgccgtggatacatataaccagcaggagggccaggttgcatacgcatttgatactcacaccggcacggacgcacgcccccagctgccattcctgaacgagcacgcttacacaacccagattgattacaatcccaaggagcgcgtgctgtatgcctgggataatggacaccaattgacatatactttgcatttcgtagtatag

SEQ ID NO: 5580 - DNA, 2682 bp, Artificial Sequence
  Description of Artificial Sequence: Synthetic coding sequence
atggccgaagccgccttagaagcagtcaggtccgagctacgggagttcccagctgcggctagagagttgtgcgtgccactggctgttccttaccttgacaagcccccaacccctttgcatttctacagagattgggtgtgccctaatcgcccctgtatcatccgtaacgccctccagcattggcctgcactccaaaagtggtctttaccgtacttccgggccacagtagggagcactgaggttagtgtggccgtgacccccgacggctacgccgatgcggtaagaggtgataggtttatgatgccggccgagcggcgcctgcccctttcattcgtgctcgacgtcctggaaggccgtgcacagcacccaggggtcctttacgtgcagaaacaatgctctaatctgccaagcgagctaccccagttgctgcccgatttagaatcacacgtcccttgggcctcagaagctctgggtaaaatgccggacgctgtgaacttttggctgggagaggctgctgctgtcacatcattacacaaagatcattacgaaaacctgtattgcgtcgtcagtggcgagaaacacttcctgttccatccccctagtgaccgacctttcatcccatatgaactctacactccagccacctatcaactcacagaggagggaacatttaaggtggtcgatgaagaagccatggaaaaagctgaagttagtcgcacatgtctgctcacagtgagagtactccaagcacaccgtttacccagcaaagatctagttactccaagtgattgttacgtgactctttggctgcctaccgcctgctcccacagactgcagactagaacagtgaagaattctagttctcccgtgtggaatcagtcttttcacttccgtatacatagacagcttaaaaacgtgatggaactgaaggtcttcgaccaggacctcgttaccggcgacgaccccgtgctaagtgtgttattcgacgctggtacattgagggccggagagttcaggcgcgagagcttctccttatcaccacagggtgaaggcaggctcgaggtcgagttccgcctgcagagtctggcagaccgaggcgagtggctcgtgagtaatggggtcttggtcgcccgcgaactgtcctgtttgcacgtacagctggaggagaccggcgaccagaagtcttcggagcatagagttcagctcgtcgtccccggttcttgtgagggtcctcaggaggcctctgttggcaccggcacattcaggttccattgtcctgcctgttgggaacaggagctgtccatcaggctacaagacgcacccgaagagcaactcaaagcgcccttgtccgcactcccatctgggcaggtggttagactggtgttccctaccagtcaggagcccctgatgcgagttgagctgaagaaggaggcaggcttgcgagaactcgcagtcagactgggcttcggaccatgcgcagaggagcaagcattcctatccagacgcaaacaggtcgtagcagctgccctccggcaggcactccaactggacggcgacttacaagaggatgagattcctgtagtggccattatggctaccggaggtggaatccgggcgatgacctccctgtatggacagctcgcgggtctgaaggagctcggcctgctggactgtgtttcatacatcacaggcgcatctggtagcacgtgggccctcgccaacctgtacgaagacccagagtggagccagaaggacctggcaggcccaacagagctcctcaagacccaggtaactaaaaataagttaggagtgctggctcccagccagctgcagcgctacaggcaggagctggccgagagggcgcgcctgggttacccctcctgcttcactaatctctgggccttgataaacgaagccctgctccacgatgagcctcacgatcataaactgtcggaccaacgggaggcactgtcccacgggcaaaaccctctacctatctactgcgccctaaatacaaaggggcagtcgctaactaccttcgagttcggagaatggtgcgagttttccccttacgaggttggtttccctaaatacggagcctttatcccgagtgagttgtttggctccgaattcttcatgggacagctgatgaaacgcctgcccgaaagcaggatttgcttcctggagggcatctggagcaacctgtatgctgccaatttacaggatagcctgtactgggcctcggaaccatcacagttttgggatcggtgggtgagaaaccaggcaaacttggacaaagagcaggtcccgctcctcaagatcgaggaacctccaagcactgccggaaggattgcggaattcttcaccgatctgctgacgtggcgtccgttggcccaagctacccacaatttcttgagggggcttcattttcataaggactacttccagcatcctcacttctcgacttggaaggccactacactggacggactccccaaccagttgactccaagcgaacctcacctctgtcttctcgatgtcgggtatttgattaatacctcgtgcttaccactcctgcagcctacacgagacgtagaccttatcctcagtctcgactacaacctccacggtgcttttcaaggctccggcgggcaccctcgccgccgccagcttgggcgctag

SEQ ID NO: 5581 - DNA, 354 bp, Artificial Sequence
  Description of Artificial Sequence: Synthetic coding sequence
atgattattgactcgtcacggatcccaagcttcacccagttacatagtactatgaccagagcaccactgttactgttatgcgtagcactcgtgctccttgggcacgtaaatggagcgacagtgcggaatgaagacaaatggaaacccctgaacaatcctcgaaacagagacctgttcttcaggaggctacaggcatactttaaaggtaggggcttggacctgggaactttccccaatccatttcccactaacgaaaatcccagaccattgtcgttccagtctgaactcacagcatcagcaagtgccgattacgaggagcagaaaaattccttccataactacctcaagggttag

SEQ ID NO: 5582 - DNA, 4143 bp, Artificial Sequence
  Description of Artificial Sequence: Synthetic coding sequence
atgaggcacggcgtggcttgggcactgctggtagccgccgctctgggactgggagcccgaggggtacgcggcgcagtcgcccttgctgatttctaccccttcggagctgagcgcggagatgcggtaacccctaagcaggacgacggtggcagcggcctaagaccgctgagtgtgcccttcccctttttcggggctgaacattctgggttatacgtcaataataatggcatcatctcattcctgaaggaggtttcccagtttacaccagttgcctttcccattgccaaggatcggtgcgtggtggccgccttctgggctgatgtggataatcgtagggcaggagatgtttattacagagaggctacggatcctgccatgttgcgtcgggcgaccgaagatgtccggcactattttcccgaacttctggactttaatgcaacttgggttttcgtggcaacatggtatagagtgaccttctttggaggcagcagctctagccctgtaaacacgttccagacagtcctgattacggacggaaaacttagcttcacgatatttaattacgagagcatcgtgtggacaacagggacccatgccagctccgggggaaatgccactggcctcggcggcattgcagcacaagccggcttcaatgcgggggacggtcagagatatttttctatcccaggaagtcggacggctgatatggctgaggttgagaccacgacgaacgtgggagttccagggcgctgggcatttcggatcgatgatgcacaggtgagagttggtgggtgcgggcacacaacgtctgtctgtttggccctgcgaccttgcctcaacggaggaaaatgcatcgatgactgcgtcaccggtaacccctcctatacatgcagctgcctctctggcttcacgggacgccggtgccacctagacgtgaacgagtgtgctagccaaccatgtcagaatgggggcacttgcacacatggcattaactcatttcgctgtcagtgcccagctggattcggcggccccacgtgcgaaaccgcccaatctccttgcgacactaaggaatgtcagcatggggggcagtgccaggtagaaaatggcagtgccgtctgcgtgtgccaggctgggtatacgggggccgcatgtgaaatggatgtggacgactgttctcccgacccctgcctgaatgggggcagttgcgtagatttagtcggaaattatacttgcctctgcgccgagcctttcaaaggtttacgatgcgaaactggcgaccaccctgtacccgacgcctgtctgagtgcaccttgccacaatggaggtacctgcgtcgatgcagaccagggctacgtctgcgaatgccctgaagggttcatgggattagactgtagagaacgcgtgcccgatgattgcgaatgtcgaaacggcgggcgttgcctgggtgcaaatacgaccctctgccagtgtccccttgggttcttcgggctgctctgcgagtttgagatcactgcaatgccttgcaacatgaatacacagtgtcctgacgggggatactgtatggaacacggagggagttatctatgcgtatgccacaccgaccataacgcctcccattcacttcccagtccctgcgactcagatccctgctttaacggcggctcctgcgatgcacacgatgactcctacacctgtgaatgtcccagaggtttccacggaaagcattgtgaaaaggcaagacctcatttgtgtagcagtggcccatgtcggaacggcgggacctgcaaggaagctggcggcgagtatcactgcagttgtccttaccggttcacaggacgccattgcgagatcggtaaacccgattcctgtgctagtgggccatgccacaatgggggaacatgtttccattacatcggtaagtacaaatgcgactgtccccctggcttctcaggccgccactgcgaaattgccccatctccttgctttcgctccccttgtgtcaatggcggtacttgcgaggatcgggacaccgacttcttttgccattgtcaggcaggatatatgggtcggagatgtcaggctgaagtggactgtggcccgcccgaagaggtgaagcacgcaacactgcgatttaatggcactagactaggtgccgtggctctctacgcatgcgaccggggctactcactgtccgccccctcccgtattcgcgtgtgtcagccccacggagtatggagtgagcctccccagtgcctggagattgatgaatgccggagccagccatgcttgcacggaggcagctgccaagaccgcgtcgctgggtacctctgtctctgttccactggctatgaaggcgcacactgtgaactggagcgggacgaatgccgtgcacatccttgtcggaatggcgggagctgtcgtaatctgccaggagcctacgtttgtcggtgccctgcaggcttcgtaggagttcactgcgagacagaggttgacgcgtgcgactcatctccctgtcagcatggaggcagatgtgagtctggcggaggcgcgtatttatgcgtttgtccagaatcattctttggttaccactgtgaaactgtttcagatccatgcttttcgtcaccttgcggcgggagggggtattgcctggcatcaaatggctctcattcgtgtacgtgcaaggtcggctacacgggcgaagactgcgccaaagaactgttccccccgactgcactgaagatggagcgtgtggaagaatccggcgtctcaattagttggaatccacctaatgggccagccgcgcgccagatgctcgatggctatgccgtaacatatgtatcatccgacggaagttatagacgaacagacttcgtcgaccgaaccaggtctagccatcagctacaggcgctcgcagcagggcgggcatacaatatttccgttttttcggttaaacgaaattcaaacaacaaaaacgacatctcccgaccagccgtgcttcttgctcggaccagacctcggcctgtcgaggggttcgaagtaacgaacgtgaccgcgtctactatcagtgtgcagtgggccctacatcgtatccgccacgctacggtgagtggtgtgcgagtgagcatccggcatcccgaagctcttcgtgaccaggcaactgacgtagatcggtcagtggatcggttcactttccgggcccttttgccgggaaaacgttataccatccaactcaccacactgagcggtttgcggggcgaggagcatccaacggaaagtttggcgactgctcccacgcacgtgtggaccaggccgctcccacctgctaatctaaccgccgctcgcgttactgctactagtgctcatgtcgtgtgggacgcgcccacccccggcagtctactcgaggcttacgtcatcaatgtcactacatcacaaagcactaaatcacggtatgtgcccaatggaaagctggctagctatacagtacgtgatttactgcccggacgccgataccagctctccgttatcgcagtgcagtccacggagcttggtccgcagcatagcgaacccgctcacctgtatataattacctccccgagggacggcgccgatagacgctggcaccagggtggacaccatcccagggtactcaagaaccgcccacctcccgccagactccccgagctcagactgctgaacgaccacagcgcgccagaaacaccaactcagccaccccggttttccgagttggtcgatgggaggggcagagtcagtgcccgattcggaggatccccgtccaaagcagctacagtacggtcacatgtgcctgggaattgctctgagaatccttgccagaacggcggaacttgcgtacccggcgccgatgcacattcgtgcgattgtggccctggctttaaaggccgtcggtgcgaactggcgtgtatcaaggtttctagaccgtgtactagactcttctctgagaccaaggcatttcccgtctgggaaggtggagtgtgtcaccatgtgtacaaacgggtgtacagagttcatcaggatatttgcttcaaagagtcatgtgagagtacctctcttaagaaaactccaaaccgaaaacagagtaagtctcaaaccctggaaaagtcatag

SEQ ID NO: 5583 - DNA, 474 bp, Artificial Sequence
  Description of Artificial Sequence: Synthetic coding sequence
atggaggcactccgtcgggcccatgaggtcgcactgaggctgctgttgtgtaggccctgggctagccgcgctgcggccagacccaaaccctctgcatctgaggtcctaactagacacctgctccagcgaaggttaccacactggacctccttctgcgtgccttatagcgctgttaggaacgaccagtttggtctttcacatttcaattggcctgtgcagggcgcaaattaccatgtcctccgtacagggtgttttccttttattaaataccactgcagtaaggctccgtggcaggatctggccagacagaataggttcttcacagcgctgaaggttgtgaacttgggtatcccaacgctgctttacgggttggggtcatggctgttcgcacgtgtgactgagacagtgcatacatcctacggccccatcacagtgtattttttgaacaaagaagatgaaggtgcgatgtattag

SEQ ID NO: 5584 - DNA, 288 bp, Artificial Sequence
  Description of Artificial Sequence: Synthetic coding sequence
atgaaaggaagtagggccctgcttctggtggcgctcaccttattctgcatttgcagaatggccactggagaggataacgatgagttctttatggatttccttcagacacttcttgtagggacaccagaagagctctatgagggaacgctggggaagtacaacgtcaatgaggacgctaaggcagcgatgaccgagctaaaatcctgtatcgacggactgcaaccaatgcacaaggccgagctcgtgaaactcctggttcaagttctgggaagtcaggacggcgcttag

SEQ ID NO: 5585 - DNA, 1053 bp, Artificial Sequence
  Description of Artificial Sequence: Synthetic coding sequence
atgaaatgcagtctgcgggtgtggtttttgagcgtcgcctttctgctggtatttataatgtctctcctgtttacctactctcaccattctatggcgactctgccttatctcgactctggcgccctggatgggacgcatcgcgtcaagttagtccccggctatgctggacttcagagactttccaaagagaggctctctgggaaaagctgcgcatgtagacgctgtatgggcgatgctggagcgtcagactggtttgacagtcattttgatggtaatatctctccagtgtggacaagggagaatatggacctgcctcccgatgttcaacgttggtggatgatgttacagccccagtttaagagccacaacacaaacgaagtgctcgaaaaacttttccagatagttcccggggagaacccatatcgctttcgcgaccctcaccaatgtcgaagatgcgccgtggttggtaattcaggcaatctccggggctcgggctacggtcaggacgtagacggccacaacttcattatgaggatgaatcaagctcccacagtgggctttgaacaggacgtaggtagtcggactacacatcattttatgtaccccgagtcagctaagaatcttcctgccaatgtgagcttcgtgcttgtaccatttaaagtcctggatcttctgtggattgccagcgcactatctacgggtcagatccgtttcacttacgcaccggtgaaaagcttcctgcgggtcgataaggagaaggtacagatttacaatcctgcattttttaagtacatccacgacaggtggactgagcaccacgggagatatcctagtacaggaatgctcgtgctctttttcgccctccacgtctgcgatgaggtcaacgtctacggtttcggcgccgacagccggggcaattggcaccactactgggagaacaatcgctacgccggagaatttcggaaaacaggcgtgcacgacgccgatttcgaagcccacattatcgacatgcttgcaaaggcaagcaagatagaggtctaccgtgggaattag

SEQ ID NO: 5586 - DNA, 600 bp, Artificial Sequence
  Description of Artificial Sequence: Synthetic coding sequence
atggcctcccctgaggcaccagagagcgtggtccaatttgccttagacaagctgggagggctggactatctcgtcctgaatcacatcggcggcgctccagccggcactcgggctcgctcaccgcaggcaacaagatggctgatgcaagtaaactttgtgagctacgtgcagctgacttccagagcgctgccgagcttgaccgacagtaaagggagcctggtcgtggtgtcttcgctactgggcagggtgcctacttcttttagtaccccctatagtgcagctaaatttgcgttggatggcttctttggcagtctgagacgggaactagatgtgcaggacgtcaacgtggctattaccatgtgtgtactggggctgagggatcgggcttctgccgctgaagcggttaggggtgtcacccgcgtcaaggccgcccctgggcccaaggcagccttagcggtgatcaggggcggcgctacccgtgcagcaggagtgttctacccttggcggtttcgcctcctgtgtctcctcagaaggtggttacctcggccacgcgcatggtttatacgccaggaactgaatgttacagctgctgccgcgtag

SEQ ID NO: 5587 - DNA, 411 bp, Artificial Sequence
  Description of Artificial Sequence: Synthetic coding sequence
atggttcggccatacccactcatatacttcctgtttctgcctctaggggcttgttttcctctactcgataggagggagcctacagacgctatgggcggtctgggcgccggtgagagatgggccgacctggccatggggccccggccccattccgtatggggtagctctagatggctgagggcatcacagccacaggcccttctcgttatcgcccgcggcctccagaccagtggccgcgaacatgccggatgtaggttcaggttcggaaggcaggacgaaggttctgaagcaacagggtttctgcctgccgccggggagaagacatctggcccactcggcaacttggcagaagagctgaacggttattccagaaagaaaggcggcttctcgtttcggtttggccgtcgttag

SEQ ID NO: 5588 - DNA, 663 bp, Artificial Sequence
  Description of Artificial Sequence: Synthetic coding sequence
atgcgtggacaaggaaggaaagagagtctttccgacagccgagatttagacggctcttatgaccagttgaccgactctgtggacgacgagttcgagctgagcacagtgtgtcaccgcccagaggggctggagcaactccaggagcaaaccaagttcactcgcaaagagctgcaagtcctgtacaggggcttcaaaaatgagtgtccgtcaggtattgtcaatgaagagaattttaaacagatctatagtcagttctttccgcaaggcgattcctcaacctacgccacatttctgtttaacgcctttgacaccaaccacgacgggagtgtgagcttcgaggacttcgtcgccggcctcagtgtcattctgcgaggtacggttgatgaccgccttaactgggcttttaatttatatgatctgaacaaagatgggtgtattacaaaggaagagatgttggacattatgaagtcaatttatgacatgatgggaaagtatacataccctgctctgagagaagaggctcccagggagcacgtcgagagtttcttccaaaagatggatcggaacaaggacggcgtagtcaccatcgaggaattcatcgagtcttgccagaaggatgagaatataatgaggtccatgcagctgtttgacaacgtaatatag

SEQ ID NO: 5589 - DNA, 2175 bp, Artificial Sequence
  Description of Artificial Sequence: Synthetic coding sequence
atgttgaggactagcacgccaaacctctgcggcggcctgcactgcagagctccttggcttagcagcggcattctgtgtctctgccttatctttttgttgggccaggtgggcctcctacaaggtcatccacagtgcttggattatggtccccccttccaaccacccctgcatctagagttctgttccgattatgaatctttcggttgctgtgaccagcacaaggatcggcggatcgcagcccgttactgggacattatggaatactttgacctgaagagacatgaactttgcggcgattatattaaggatattctgtgccaggagtgttcaccctacgcagcccacctgtacgacgcagaaaacactcaaactcccttaagaaacctcccaggcttgtgctccgactattgttctgcttttcattcaaactgccactccgcgatatccttgctaacgaacgacagggggcttcaggaaagtcacggccgggatggaacccgattctgccacctcctggatctccccgacaaggactactgctttccgaatgttttgcggaatgattacctaaacaggcacctgggtatggtggctcaagatcctcaagggtgtctgcagttgtgcctgtctgaggttgctaatggtctgaggaatccagtgtctatggttcacgccggggacggcacacaccgtttttttgtggccgaacaagtgggtgtcgtatgggtgtacctgccagacggctcacgactagagcagccatttctcgacttgaaaaatatagttctgaccaccccgtggatcggcgacgagcgggggtttctcggcctcgcctttcaccctaagttcaggcataatagaaaattttatatttactatagttgcctagacaagaaaaaagttgagaagattcgcatctcagaaatgaaagtttctagggctgaccccaacaaggccgacctcaaatccgaacgagttattctggagattgaagagcccgcctctaatcataatggggggcagctattattcggtttagacggctacatgtatattttcacaggtgacggaggtcaggctggggacccttttggacttttcggaaatgcacagaataaatctagtttgctcgggaaggtattacgaattgacgtgaacagggctgggtctcacgggaagcgataccgagtgccctcagataaccccttcgtaagtgagcctggagcacacccagccatttatgcttacggcatccgaaacatgtggagatgtgctgttgacagaggcgatcctatcacacgacaaggacgagggagaattttctgcggggatgttggccagaatcggtttgaagaagtagacctgatccttaagggtggaaattatggctggcgggctaaggagggcttcgcctgttatgacaaaaaactgtgtcacaacgcctcattagacgacgtcttgccgatttacgcctacggacatgctgtgggaaaatccgtgacgggcggttatgtttaccgcggctgtgaaagtcctaatctcaatggtctgtacatcttcggagattttatgtccggccgtttaatggcactccaagaagatcgaaaaaataagaaatggaagaaacaggacctgtgcctcggttccactacaagctgtgcctttcccggcctgatatcgactcattcaaagttcattatttcctttgccgaggacgaggctggcgagctttacttcctggctacctcctaccccagtgcctatgccccacggggctcgatctataaatttgtcgatccctcgagaagagccccgccgggaaaatgcaaatataagcccgtccccgtgcggaccaaatcaaaacgaatcccattcaggcccttggccaagacagtgcttgatctgctaaaggagcagagcgaaaaagctgcacgaaaatcctcatctgccactctagcatccgggcctgcccaaggcctgtccgaaaaaggctcctcaaaaaagctggcgagccctacctcttcaaagaacactttgcgcggacctggcacaaaaaaaaaggctcgggtagggccccacgtacggcagggcaagcgaaggaagagtcttaaaagccattccggcagaatgcggccttcagctgagcagaagcgagccggacgaagcctcccctag

SEQ ID NO: 5590 - DNA, 1218 bp, Artificial Sequence
  Description of Artificial Sequence: Synthetic coding sequence
atgtggtacgtctctacgcggggtgtggctccacgcgttaacttcgagggagccttgttttccggatatgcgcctgatgggggattattcatgcccgaggaattaccacagctcgaccgagggacgctttgtcagtggtctaccctgtcttatcccgggctggtaaaggaactgtgtgcactttttattggatctgaactgcttccaaaagatgagttgaatgacctcatcgatagagctttctcacgattccggcacagagaggtggttcatctatcgaggctcaggaacggcctcaatgtgcttgagctttggcacggagtcacgtatgcattcaaggacctgagcctctcttgcaccactcaatttctgcaatatttccttgaaaagcgagaaaaacacgtcacagtcgtcgtgggcaccagcggcgataccgggagcgccgccatcgagagtgtgcaaggagctaagaatatggacatcattgttctgctacccaagggtcattgtaccaaaatccaggagttgcagatgacaacggtgttgaagcagaatgtccatgtttttggggtggaaggtaatagcgacgagctcgacgagccaattaaaaccgtcttcgctgatgtcgctttcgtcaagaaacataatctgatgtccctgaacagtattaactggagtcgcgtgcttgtccagatggcccaccatttttttgcatactttcagtgtacacctagcctggatacacatcctctacccctcgtggaggtggttgttcccacaggtgcggctgggaatttggcggccggatatattgcccagaaaatcggcttgcccatccgcctggtggtcgccgtgaaccggaatgacatcattcacagaacggtacaacaaggcgatttctcccttagtgaggccgtgaagagtacactcgccagtgctatggatatccaggtcccatataacatggagagagtattttggcttctgtccgggtctgactcccaagtgacccgcgcactcatggagcagtttgagagaacccagtctgtgaacctgccaaaggagctgcatagtaagtgggagagacaggattacgagaaaatggctgtaatggagtgtgacggatgctgcgtcgaattgtgtctgggcaattgtggcccacggcgcggctccgtcaccgatattcccggcacggccatggtccgcggcggtggatag

SEQ ID NO: 5591 - DNA, 492 bp, Artificial Sequence
  Description of Artificial Sequence: Synthetic coding sequence
atgaccatgaggcataattggactcccgacctgagcccattatgggttttgcttctctgtgcgcacgtggtaaccctgctcgtaagagcaacacctgtcagccagacaaccaccgctgctacagcatctgtccgctccacaaaggacccctgtccatctcaaccaccagtgtttcccgctgctaagcaatgcccggccctggaggtgacatggccagaagttgaggtgccactaaatggcactctgtcgctatcatgtgtcgcgtgctcaaggtttccaaactttagcattttgtattggttaggtaacggaagtttcatcgagcaccttcctggccggttatgggagggttcaaccagtcgggagaggggaagcactgggtgggccgagggtaacctggccccccacccaaggagccctgctctccagcctcagcagagcacggcagcgggcctgcgattgtccacaggccccgcggccgcgcaaccatag

SEQ ID NO: 5592 - DNA, 1590 bp, Artificial Sequence
  Description of Artificial Sequence: Synthetic coding sequence
atggctccagccagaactatggcgagggcccggcttgcacccgctgggatccccgcggttgccctgtggctgctttgcactcttgggctccaaggtacccaggctgggccccctcctgctcctccaggacttcctgctggcgctgattgcctgaacagtttcaccgccggagttcccggattcgtcctggacacaaatgcatccgtctccaacggagcaaccttccttgaaagcccaacagtgcggcgtggatgggactgcgtcagggcctgctgcacaacacagaattgcaatcttgctctcgtggagctgcagccagatcgtggcgaagacgcgatagccgcctgctttctgatcaactgtctgtacgagcagaatttcgtctgcaaattcgcacccagagaggggtttatcaactatttaacccgcgaggtttatcggtcatatcgccagttgcgcacacagggatttggaggatcagggataccaaaggcatgggctgggatcgacctgaaagtgcagcctcaggagccgctggtgctcaaggatgtagagaacactgattggaggctgctgagaggtgacactgacgtacgagtcgaaaggaaagatcccaaccaggtggaactgtggggcctcaaggaaggcacgtatctatttcagcttacagttaccagctcggaccaccccgaggacactgccaacgtcaccgtaacagtgctttctacaaagcagacagaagactattgtctcgcttccaacaaggtaggaagatgtcggggatccttccctcgatggtactatgacccaaccgagcagatttgcaagtcctttgtgtatgggggctgcctgggcaataaaaataactacctaagagaagaggagtgcatccttgcctgcagaggagtccaggggggccccttgaggggctcatccggagcccaggcaaccttccctcaaggtccatccatggagaggagacatccagtgtgctctggaacctgccaacctactcagtttcggtgctcgaacggatgctgcatagacagctttctcgagtgcgacgacactcctaactgccctgatgcctccgacgaggccgcctgtgagaaatatacttccggattcgacgaactccagcgcatacattttccgagcgataagggccattgcgtcgacctgcccgacaccgggctctgtaaggagtctataccgaggtggtattataaccctttctctgaacactgtgccaggttcacttacggcggatgctacggcaacaagaacaattttgaagaagaacagcagtgtctggagagttgtaggggaatcagcaaaaaggatgtgttcggcctgaggagagagatcccgatcccctccaccggaagtgttgaaatggctgtagccgtatttctggttatctgcatagtcgtcgttgtagccattctggggtactgcttttttaaaaaccagcgtaaggacttccatgggcatcaccaccaccctccccccacccctgcttcatccaccgtctcgacaactgaagataccgagcacttagtttacaaccacacaacccgcccactctag

SEQ ID NO: 5593 - DNA, 1803 bp, Artificial Sequence
  Description of Artificial Sequence: Synthetic coding sequence
atgcaagggcccttgctgcttcccgggttatgtttcctgctctccctgttcggggcagtgactcagaagaccaagacgtcatgcgctaaatgcccaccgaacgcgtcttgcgtcaacaacacgcactgcacttgtaaccacggctatacctcagggagcgggcagaagctttttacttttcccctggaaacctgtaatgatactaccagttctaagaccactgaaggtagaaaggaactccagaagatcgtggacaagtttgagtctcttctcacgaaccaaacattgtggagaacggaaggtcgccaggaaatatcttctacagccacaaccatcctccgagatgtggagtccaaggtgctggagactgctcttaaggaccccgagcagaaggtgctgaaaatccagaatgactctgttgctatcgaaacccaggctatcactgacaattgtagcgaagagcgcaaaaccttcaacctgaacgtccagatgaactctatggacatccgctgttccgatattattcaaggtgacacgcagggccccagcgccattgcatttatatcctatagttccctgggcaatataatcaatgcaacattttttgaagagatggacaagaaagatcaggtgtacctgaatagccaagtcgtctcagcagctataggccccaagagaaacgtctccctcagcaaaagtgttacgctgacattccaacacgtcaagatgacgccttcaacaaagaaagtgttctgtgtgtactggaaatcaaccggccaaggctcacagtggtcacgtgatggatgcttcctgatacacgttaataaatctcataccatgtgtaactgcagccatctaagctcgttcgccgtgctaatggctttgactagccaggaagaggacccagtgttaaccgttattacctacgttgggttgagtgtgtctctgctgtgtctgctgctcgcagcactgacattcctgctatgtaaagccattcggaacacctctaccagtctgcacctgcaattatccctttgtctatttttagctcacctcctgttcctggttgggatagataggacagaacctaaggtcctgtgttccattatcgcaggcgcgctgcactacttgtacttggctgcattcacatggatgctgttggagggtgtgcacttgtttttaactgctcggaacttaactgtggtgaactatagctccatcaaccgcctgatgaagtggatcatgtttcccgtgggctatggagttcctgccgtgaccgtggccatcagtgctgcaagctggccccatctgtatggaaccgcagaccggtgctggctccatctggaccagggattcatgtggtccttcctcggaccagtgtgcgcgatattttccgccaatcttgtgcttttcatcttggttttttggatcctgaagcgcaaactgagctccttgaattccgaggtatccactattcaaaatacacggatgctggcttttaaggccactgcccaactctttatactgggctgcacctggtgtctggggcttctgcaggtcggtcccgcagcccaggtgatggcgtatttgttcacaattattaactcactccagggctttttcatcttcctggtgtactgtcttctttctcagcaagtgcagaaacagtatcagaagtggttccgggaaattgtcaaatccaagtccgaatctgagacatatacgctttcatccaaaatgggacctgattccaaaccttcagaaggtgacgtgttcccaggccaggtgaaacgaaagtactag

SEQ ID NO: 5594 - DNA, 660 bp, Artificial Sequence
  Description of Artificial Sequence: Synthetic coding sequence
atgaagctcttgctgtgggcctgtattgtatgcgtggcctttgctcggaagcgacgcttcccatttatcggtgaagacgacaacgacgacgggcatccgctccatccgagcctgaatatcccttacggcattcgaaacttgcctccacctctctactatcggcccgtcaataccgtaccctcttatcccggcaacacatacaccgacaccgggctgccgtcatacccttggattttaacaagtcctggttttccttacgtctaccatattcgagggtttcctttggctacacagctgaacgtgccacctcttccccctaggggttttcccttcgtccccccaagccgcttcttttcagccgctgccgctccggcagccccacccatcgcagccgagcctgccgcagcggcgccactaaccgccaccccggtggccgccgagccggccgctggagctcccgttgccgcagaacccgcagccgaggctccagttggggccgaaccagccgcagaggcgcctgtcgcggctgagccggccgccgaggctccggttggagtggaacccgccgctgaggagcccagtcctgcagagcctgcgacggcaaagccagcagctccagaaccacacccttcacctagtctggagcaggccaatcagtag

SEQ ID NO: 5595 - DNA, 1743 bp, Artificial Sequence
  Description of Artificial Sequence: Synthetic coding sequence
atgcacctttcggcggtcttcaacgcactattagtatccgtcctggcagccgtcctgtggaaacatgtcagattaagggagcacgccgccaccctggaggaggaactggccctgtctagacaggccacagagcctgcgcccgctctgaggattgactaccccaaggcactgcagatcttgatggagggcggaacacacatggtatgtacggggcggactcatacagatcgtatttgcaggtttaagtggctatgctatagcaatgaggcagaagaattcatcttctttcacggtaatacgtccgtgatgctgcccaatctggggagcaggcggttccaacctgctctgctggatctgtccacggtggaggatcataacacgcagtactttaatttcgttgagctgccagccgctgccctcagatttatgcccaagccggtcttcgtgcccgacgtggccctgattgcaaaccggttcaacccagacaacctgatgcacgtgttccacgacgacctgctcccacttttttacactcttaggcagtttcctggtctggcccatgaggccaggctcttctttatggaggggtggggtgagggagcccattttgatctgtacaaattgttatctccgaagcagcctttattgcgggcacagcttaaaacacttggaaggcttttgtgttttagccacgcttttgtggggcttagtaagatcactacttggtaccagtatggcttcgtgcagccccagggccctaaagcaaatatactggtctccggcaatgaaatcaggcagtttgcccgttttatgacagagaagctgaatgtgagccacactggtgtgcctctgggagaggaatatatccttgtgttcagtaggacccagaatagactgatacttaacgaggctgagctactcctggctcttgctcaagagttccagatgaaaaccgtgaccgtgtccctggaggaccacacatttgccgatgtggtacgacttgtctctaacgcctctatgctggttagcatgcacggtgcccagcttgtgacaactttgttcctcccccggggggctacagtcgtggaactatttccgtacgctgtgaatcccgaccattacacaccatataaaaccctggccatgctgccaggcatggacctccagtacgtcgcctggaggaatatgatgcccgagaatactgtgacccaccccgaacgaccttgggaccagggtggcatcactcatctggaccgggctgaacaggcgcgcatcctgcagtcacgagaggtgcctcgtcacctgtgctgtaggaatccagaatggctgttccggatatatcaggacaccaaagtggacattccatcgctgatccagacaatccggcgggtggtcaaaggacgcccaggtccccgaaaacagaagtggacagtagggctgtatccaggcaaggtgagagaagcgagatgccaggctagcgtacacggagcctccgaggcaaggctcacggtctcctggcagattccttggaatttaaagtatctgaaggtccgcgaagtgaagtacgaagtctggttgcaggagcagggtgagaacacctacgtgccttatattttggccctgcagaatcataccttcactgagaacatcaagccatttacgacatacctggtatgggtccggtgtatttttaataaaatactgctgggaccgttcgccgacgtgctcgtctgcaacacctag

SEQ ID NO: 5596 - DNA, 5130 bp, Artificial Sequence
  Description of Artificial Sequence: Synthetic coding sequence
atgggttttttgcccaaactgctcctcctggcatcttttttcccagcaggccaggcatcatggggagtgagctctccgcaggacgtgcagggggtgaaggggtcttgcctcttgatcccgtgcatcttctcatttcccgccgatgtggaggtgccagacggcattacagctatctggtattacgactacagtggccaacggcaggtggtgtctcacagtgcagatccaaagttagttgaggctcgtttccgcggaagaaccgaatttatgggcaatcctgagcacagggtctgcaatctgctgctcaaggacctgcaacccgaagactccgggtcttataacttcagatttgagatcagtgaggtcaataggtggtcagacgtgaaaggcaccctggtgacggtcaccgaagagccacgagtccccaccatcgcctctccagtggagctgctcgaaggcactgaagtggactttaactgctctacaccatatgtgtgcctgcaagagcaggtgcgcctccagtggcaaggccaggaccccgcgcgttctgtgaccttcaattcccagaagtttgagcctactggagtggggcatctagagactctgcacatggccatgagttggcaggaccacggccgcattctcaggtgccaactcagcgttgcgaatcaccgggcccaaagcgagatccatctgcaagttaaatacgctccaaaaggagtcaaaatccttttgagcccatctgggcggaatatcctgcccggcgagttggtcacactgacctgccaggtgaatagtagttaccccgctgtgagtagtatcaagtggctcaaagacggcgtgagattacaaaccaagactggggtactccacctgccacaagccgcctggtctgatgccggagtctacacatgtcaggccgaaaatggcgtgggtagcctggtctcacctcctatcagcctccatatctttatggcagaggtacaagtaagccccgcgggccctatattggagaatcagacagtgaccctcgtatgcaacacacccaatgaagctccatccgacctacggtattcttggtacaagaaccacgtcctgctggaggatgcccattcccatactctgagattgcaccttgctaccagggctgatacaggtttttacttttgcgaggtccaaaacgtgcacggatctgaaagatcaggtccagttagtgtggtcgttaatcacccaccacttactcctgtgcttacagccttcttagaaacccaggctggccttgttggaatcttacactgttccgttgtctccgaaccactggccaccctagtcttgtctcacggcggtcatatcctggcctctaccagtggggactctgaccacagtccacggttctccggtactagtggacccaattccctcaggctggagatcagagacctggaagagactgatagcggcgaatataagtgcagtgcaaccaactctctggggaatgccacgtccacactggatttccacgctaacgctgccaggctgctgatctctccagccgccgaggtcgttgaaggccaggctgtcacactgtcatgccgaagtggcctgagtcccacgcctgacgccagattcagttggtatctcaatggcgctctgctccacgaaggtcctgggtcgagcctgcttctaccagcagcgtcttctactgatgctggctcttaccattgtagagccagagatgggcacagcgcttccgggccgagtagccctgcagtgctgacagttttgtacccaccccgtcagccaacttttaccactcggcttgacctggatgctgctggggccggggccggaagacgcgggctcctgttgtgccgggtggacagcgaccccccggcacgactgcagctgctgcataaggacagggtggtcgccacttctcttccatctggcggaggttgtagtacatgtggagggtgctcacctagaatgaaggtgacgaaagctcccaacttgctgcgagtggagatacataaccccttgctggaagaggagggcttgtacctctgtgaggccagtaatgcgctagggaatgcctctacatcagctacctttaacgggcaggccaccgtcctggcaatcgccccttcacacacactccaagaggggactgaggcaaacctgacctgtaatgtatcaagagaagcagccggttcaccagcgaattttagctggtttaggaatggggttctatgggctcaagggcccctggaaacagtgactctcctacctgtcgcccggactgatgccgcgctctacgcgtgtcggatcctaacggaagctggagctcaactaagcacccccgtcctgttgtccgttctgtaccctccagacagacctaaactttcggcactcctggatatgggtcagggacatatggcactcttcatctgcacagtagattcacgtccacttgccctcctggccttgtttcacggagaacacctgctcgctacttcccttggcccacaagtcccaagccacggaaggttccaagctaaggctgaagcaaattcattgaagctggaggtgcgtgagctgggactcggtgatagcggtagttacagatgcgaggcgaccaacgtcctgggcagctcaaatacttcactgttctttcaagttcggggagcatgggtgcaggtgtccccgagtccagaactgcaggaaggacaagccgtagtactgagctgtcaagtgcacaccggggtgccggagggcacaagttatcgatggtacagagatgggcagcccctacaggaatcgacgagtgctacactgaggtttgccgcgataacactgacacaggccggagcttaccattgtcaagcacaagcaccaggaagtgctacaacatcccttgctgcccctatctctctccatgtctcatatgctcctcggcacgttacgctcacaaccctgatggacaccggtccaggtcgtctcggccttctgctgtgtcgcgttgacagtgacccccctgcccagttgaggctgcttcatggtgatcgtcttgtcgcgtccactctccaaggtgtggggggccccgaggggagtagcccacgtctgcacgtggctgttgctccgaacaccttaagacttgaaatccacggagctatgctcgaggatgagggcgtctacatttgtgaagcgagcaacacgttaggccaagcatccgcttctgcggactttgacgcccaagcggttaatgttcaggtgtggccaggggcgacggttcgcgagggccagcttgttaatctgacctgtcttgtgtggaccacccacccagcgcagctgacatacacatggtatcaggacggccagcagcgcttggatgctcactctatccctttgcctaacgtgactgttagggatgcaacatcttataggtgcggcgtggggcccccagggcgggccccacggttatccaggcctattactctcgacgtcttgtatgccccacgaaacttacggttgacgtatttactcgaatctcacgggggtcagctagcgctggtgctttgcactgtggattcacgccctccagcccaactggctttgtcccatgccggtaggctgttagcatcctccactgccgccagtgtgccgaacactcttcgcttagagctacgcgggccacagcccagagatgagggcttctacagctgctcggcgcggagtcccctgggccaagccaacacttcccttgaactccgattggagggcgttcgggtcatcctggcacctgaggccgccgtgccagagggagcacccatcacggtgacttgcgctgacccggctgcgcatgctcccacgctgtatacgtggtaccataatggtcgctggctgcaggagggcccagcagcaagcctgagcttcctggtggcgaccagggcccacgcaggcgcgtacagttgtcaggcccaagatgcccaggggacacgcagttcccggccagctgccttgcaggtcttgtacgctcctcaggatgcagtgctgtcctccttcagggactctagagcccgctcgatggcagtcattcagtgcacagttgatagcgagcctcctgctgagctagcactcagtcacgatgggaaggtgctggctacctccagtggtgtgcatagcctagcaagtggtacagggcatgtgcaggtagcccggaatgcattgagattgcaggtgcaggacgtccccgccggtgacgacacgtacgtgtgcacagctcaaaatctgctggggtcaattagcacaatcggccgcttgcaggtagagggagctcgtgtggttgccgaaccagggctggatgtccccgagggtgccgccttgaacctatcatgccggctgctcggagggccaggcccggtagggaactcgacatttgcttggttctggaacgaccgacgcctgcatgcggaacccgttccaactctcgccttcacgcatgtcgcccgggcccaagctggcatgtaccactgcctagctgaactaccaacaggtgcagctgcttcagcccccgtgatgttaagagtgctgtacccccccaagaccccaaccatgatggtcttcgtggagccagaaggagggctacgtgggatcttagattgtcgcgtggattctgagcccctcgcctcactgacactacatcttgggagtcgactggtcgcgtcctcacagccccagggtgctcctgctgagccccatatacatgtgcttgcaagcccaaatgcgctcagggtagatattgaggcccttcggcctagtgatcaaggggagtacatttgcagtgcaagtaatgtgctgggaagcgcttctacctcaacctacttcggggtgcgggccctccatcgactgcaccagtttcaacagctcctgtgggttctcgggctattggtggggcttctgctcttactattgggtctgggagcatgctatacctggcgaaggcgaagggtgtgtaagcaaagcatgggcgagaatagcgtggagatggccttccagaaagagactacccagctcattgaccctgacgcagcaacctgcgagactagtacctgtgccccacctttgggctag

SEQ ID NO: 5597 - DNA, 693 bp, Artificial Sequence
  Description of Artificial Sequence: Synthetic coding sequence
atgtgtgtgacttaccacaatggcacaggatattgcaagtgtcctgagggttttctgggtgagtattgccagcaccgtgatccttgcgaaaaaaacaggtgccagaacggtggcacctgcgtagcccaggcgatgttgggtaaggcaacgtgccgatgcgctagcgggtttaccggggaggactgccagtatagcactagccacccatgtttcgtctccaggccttgcctcaacggcggtacctgtcacatgctttctagggacacttatgaatgtacctgccaggtcgggttcacgggtaaagaatgccagtggacagacgcatgcctctcccacccatgcgccaacggatcgacttgcaccacagtagcaaatcagttctcctgcaaatgtttgacaggcttcaccggacagaagtgcgagacagacgtcaatgagtgtgatattcctggacattgccaacacgggggtacgtgtttgaatctgcccgggagctaccagtgccagtgtctacagggttttaccggacaatactgcgactcactttacgtcccttgcgctccctccccctgcgtaaacggcggcacgtgtcgtcaaacaggtgactttacgttcgagtgtaactgcctccccgcgacatggccaatcttccccaaactccttagcctgcaggaaaaggaatcctattgctag

SEQ ID NO: 5598 - DNA, 660 bp, Artificial Sequence
  Description of Artificial Sequence: Synthetic coding sequence
atgttcgtgtcctatctgattctgactctgttacatgtgcagacagccgtactcgccagacccggcggggaaagtatagggtgcgacgattacctgggaagcgacaaagtggttgataagtgtggggtgtgtgggggggataatactgggtgtcaagtggtgagcggcgtattcaagcacgcattgacttctctaggataccaccgagtcgtcgagattccagagggtgctaccaagatcaacattaccgagatgtataaatctaacaaaaagaaatctcacctgaagccggcaacacgcggttctcagttctctagcgtgaaagtatgctccgtgcctgcggcatgcaagctattagggacacccgggcgggcccgccagccggtgccggccccaagagagctcgaacatgataagaattctcctcattgcgcttatctgagtctgtatcttacttcacttgctcagtccagttggcgtgtattctcactgttctcttacgtgctaatatatctcttcagcaagtatttagccttcaatacactttttgcattgaagcggatggctctacagagagatcgtaaggaaaagacacgcgcatggtgcatttttattaaactgtgtgggagggagatccagatcctgcccgggcctgtgtag

SEQ ID NO: 5599 - DNA, 363 bp, Artificial Sequence
  Description of Artificial Sequence: Synthetic coding sequence
atggacaacgtgcagcccaagattaaacaccgtccgttttgcttttccgtcaaaggacacgttaaaatgttacgactagcccttacagtcacctcaatgactttcttcatcattgcacaggccccagagccttatattgtcattaccggattcgaggtgacggtcatcctgttcttcattctactgtacgtgcttcgccttgatagactaatgaaatggctgttctggcctctgctggtcttcgctttagttacggcagtgtgttgcctggctgatggtgcccttatatacagaaagctgctattcaatccctccggcccttatcagaagaagcctgtgcacgagaagaaggaggtgctatag

SEQ ID NO: 5600 - DNA, 864 bp, Artificial Sequence
  Description of Artificial Sequence: Synthetic coding sequence
atggccccttggagccacccttccgctcagctgcaaccagtgggtggggacgccgtctctccggccctcatggtgctgctgtgcctgggtaacctcagtaaagctaccttatgggctgaaccgggcagcgtcatctcgaggggtaactctgtgaccattcgttgtcaagggacactcgaggcccaggagtaccgtctggtgaaggaagggagcccagagccctgggacacccagaacccgctggagcccaagaacaaagcccgcttttctattccgtccatgacagagcatcacgctgggagataccggtgttattattactcaccggccggctggagtgagccaagcgatccactggagttggttgtgaccgggttctacaataaaccaaccctgtcagcactgccgtccccggtagtgacctccggggagaacgtcacgttgcagtgtggttctcggctgagatttgatagattcatcctcacagaagagggagaccacaaattgtcatggacactggactcccaactaacacctagcggccaattccaggctttgttcccggttggtcctgtgacacctagccaccgctggatgttgcgatgctacgggtctaggcgccacatcctgcaagtctggagtgaaccaagcgacctcctggaaatccctgtatctggtgccgcagataatctcagtccttctcaaaacaagtctgattcaggtaccgccagtcacctccaggactacgcggtggagaatctgatcagaatgggaatggcaggactgatcctagtggtcctgggtatcctgatttttcaggactggcattcacagcgatccccgcaggctgctgcaggccgatag

SEQ ID NO: 5601 - DNA, 438 bp, Artificial Sequence
  Description of Artificial Sequence: Synthetic coding sequence
atgggcattggttgttggagaaatcctttgctgttgttgatcgccttggttctctctgccaaactcggccattttcagcgctgggagggcttccagcaaaaactgatgagcaaaaaaaacatgaacagcacgctcaattttttcattcagtcatacaataatgccagtaacgacacttatctgtatcgggttcagcgccttatccgaagccagatgcaactgacgaccggcgtggagtacatcgtgaccgtgaagataggctggacaaagtgtaagcgcaatgatacctcaaatagctcctgtccactgcagtccaaaaaattaagaaagtcattgatatgtgaatccttaatctacaccatgccctggattaactattttcagctctggaacaacagttgcctggaagcggagcacgtcggtcggaacctgaggtag

SEQ ID NO: 5602 - DNA, 1776 bp, Artificial Sequence
  Description of Artificial Sequence: Synthetic coding sequence
atgcagcaagacggactgggtgtaggtacaaggaatggcagcgggaagggacgcagtgttcatccatcctggccatggtgtgccccaaggcctctgcgctacttcggccgagatgcccgcgctcggcgagctcagaccgctgccatggcgttagccatccaagtgaccgtgagtaatccttaccatgtggtgatcctgtttcagcctgtcaccctgccttgtacataccaaatgacgtccacacctacgcaacccatcgtcatctggaaatataaaagcttctgccgggaccgtattgctgatgctttctcaccggccagtgtagataaccagctcaacgctcaattggcggctgggaaccccggctacaacccttacgtcgagtgtcaggattccgtgcgcaccgtcagggttgtggccacaaaacaggggaatgccgtcacactcggcgactactaccagggaaggaggataaccattactggcaacgccgacctcacattcgaccaaacagcttggggggatagcggggtgtattactgttccgtggttagtgcgcaagatctccaggggaacaacgaggcttatgctgagctcatagtactgggccggacatctggcgtcgccgagctcctgcctggattccaggcaggccctattgaagactggctattcgtggtggtagtctgtctggctgcgtttctcatcttcctacttctcggcatctgttggtgccagtgttgcccccatacctgttgttgttacgtgagatgtccctgttgtcctgacaaatgctgttgccccgaagcattgtacgcggcgggcaaggccgctacatctggtgttccatcgatctacgcaccatcaacctacgcccacctcagccctgctaaaaccccgcctccaccggccatgatcccaatggggcctgcctacaacggctacccaggcggttatcctggagacgtggacagatctagctcggtacggtctggataccgcatccaggcgtcgcagcaggacgactcaatgcgagtgctgtactacatggaaaaggaattggcgaacttcgatccaagcagacctggcccccctagtggccgcgttgagcgagctatgagcgaagtcacctctctacatgaggatgattggcggtcaagaccatcacgcgggcctgccttaacccctattcgggacgaagagtgggggggccactctcctcggagtccaagggggtgggaccaagaacccgcaagggagcaagccggcggaggatggcgcgcgagacgtccccgtgctagatcggtggacgcactggatgacctcacacccccctccacagctgagtctggcagtaggagccccacatcaaatgggggccggagtcgcgcctatatgccaccaagatcccgctcacgggacgatctgtatgaccaggacgattctagggatttccctcggtcccgggacccccactatgacgacttccggagccgcgagcggcctccggctgaccctaggagccatcaccaccgtacgagggacccaagggacaacggttcaaggtccggggatcttccttatgacggcaggctgctggaggaggcggtccggaaaaaagggtctgaggaaaggcggcgccctcataaggaggaagaggaggaagcctactatcccccagcccctcccccttactctgagacggattctcaagcatcaagggagagacgtctaaagaagaatctcgccctgtctagagagtctcttgtcgtgtag

SEQ ID NO: 5603 - DNA, 678 bp, Artificial Sequence
  Description of Artificial Sequence: Synthetic coding sequence
atgaaccggtgcccaagaaggtgcaggagtcccttgggacaggccgcccgcagcctgtaccagctggtcaccggcagcctgagtcctgatagcgtcgacgatgaattcgaactttctaccgtctgtcataggccagaaggcttagagcagctgcaggaacaaacaaaatttacaagaaaggagttgcaagttctgtacagaggatttaaaaatgagtgcccatccggcatcgtgaatgaagagaactttaagcagatatactcgcaattctttccacagggggactccagcacttacgccacgtttctgttcaacgcgtttgacactaaccatgacggcagcgtgagctttgaggattttgtggccggcctgtcagttattctgcgcggaacggtggacgacaggctgaattgggcatttaacctgtacgatctcaataaagacgggtgtattaccaaggaggagatgctggatatcatgaaatcaatatacgatatgatgggtaagtatacatacccagctctgagggaggaggccccaagggagcatgtggagagcttctttcagaagatggacaggaacaaggacggcgtggtgacaattgaagaattcattgaatcttgtcagaaggatgagaacatcatgaggagcatgcaattgtttgataatgtaatctag

SEQ ID NO: 5604 - DNA, 705 bp, Artificial Sequence
  Description of Artificial Sequence: Synthetic coding sequence
atgcctgccagttcgccattcctactggcgccaaaaggccccccgggaaacatgggtggcccggttagagaaccagccctaagcgtggccctgtggctgtcctggggagccgctctgggggccgtggcctgtgctatggccctgttgacccaacaaaccgagctgcagagccttaggagagaggtgagtaggttgcaaggaaccggcggcccttctcaaaacggagagggatacccctggcaatcacttccagagcagtcttctgatgctttggaggcctgggaaaatggggagcgttcacggaaaagaagagccgtcctaacacaaaagcaaaaaaacgattccgacgttaccgaggtgatgtggcagcctgctttgcggagaggacgagggctccaggcgcaagggtatggcgtacgaatccaggatgcgggggtgtacctgctttactcccaggtcctgttccaggatgttacattcacaatgggccaggtggtaagcagagagggacagggcagacaggaaactctgtttcgctgcattagaagcatgcccagtcatcctgaccgtgcttacaactcctgttactccgcgggggtgtttcatctgcatcagggtgatatcctgtcagtgataatcccccgggcccgagctaagcttaatctcagcccccacggtactttccttggcttcgtgaaactgtag

SEQ ID NO: 5605 - DNA, 2400 bp, Artificial Sequence
  Description of Artificial Sequence: Synthetic coding sequence
atgaagccaatgctgaaggacttttctaatcttctgcttgtcgtgctctgtgactacgtgctaggcgaggccgaatatctgctgctgcgggagccgggccacgttgccctctccaatgataccgtctatgttgactttcagtacttcgatggcgccaatggaacactccgtaacgtctcagttctgctgcttgaggctaacaccaaccaaactgtcaccactaagtatctgctcactaatcaatctcagggaacattgaagtttgagtgcttttatttcaaggaagccggagattattggtttactatgacacctgaggcaaccgataattcgaccccatttccctggtgggagaagagcgcctttctgaaggtcgagtggccagtcttccacgtcgacctgaatcgcagcgctaaggctgcagaggggactttccaggttggattgttcacatcacagccactgtgccccttccccgtcgataaacctaatattgtggtggatgtgattttcacgaactcccttccggaggcccgcaggaacagccgacaacctcttgagatcagaacctctaagcgcacggagctggcccagggccagtgggtcgagttcgggtgcgccccgttggggccggaagcatacgtgactgtggtcctgaaacttttagggcgcgattcagttattacttccaccggaccaatcgacctcgcgcaaaagttcggatacaaacttgtcatggttccagagctgacctgtgaatctggggtggaggtgacagttctccccccaccttgcactttcgtgcagggagtagtcactgtctttaaggaggcaccgcggtacccaggaaaacggaccatacacttggcagagaactccctgccacttggcgaaaggcggaccatttttaactgtacactgttcgacatggggaaaaataagtactgctttgactttgggataagctcccgtagccacttctctgcaaaggaagagtgcatgctgattcaacgcaatacagcttttcaaccatcctctccctccccgcttcagccacagggaccagtaaaaagcaacaacattgtaactgtgactggaatctcactatgtctgtttattatcattgccaccgtcctcataaccctctggcggcgttttggacgccccgccaagtgctcgactcccgcccgacacaattcaatccattcccctagtttccggaaaaactcggatgaagaaaacatctgcgaactctctgagcagcggggatccttctcagacggcggcgacggacctacgggatctcctggcgacacggggataccgctgacctataggcgaagtggccctgtccctcctgaggatgatgctagcggtagcgagtcgttccagtcaaacgcccagaagataatcccacctttgtttagttaccggttagctcagcaacagctcaaggaaatgaaaaaaaaaggcctgactgaaacaacgaaggtgtatcacgtcagtcagtcccctttgacagacactgctatagacgctgctccttcggctcctcttgatctggagagccctgaggaggctgccgccaacaagttccgcatcaaaagtccatttcccgaacagcctgctgtcagtgccggagagaggcctccctctcgcttggatctcaatgtgactcaagcatcttgcgctatcagtccctcgcaaacccttatacgaaaatcacaagcacgccacgtcggatcccgtggtggcccctcagagagatcacatgccaggaatgcccatttccgtaggaccgcatcattccatgaggcacgacaggctagaccatttcgcgaaagatccatgagcaccctgacgcctcggcaggcccccgcctatagctccagaacgagaacctgtgagcaggcagaagatcgatttcgccctcagagtcgaggtgcacacctgttccctgagaagctggagcacttccaggaagcttcgggcacgagagggcctttaaatcccctcccaaagtcttacactctaggccagcctttgagaaaaccggatctgggtgatcaccaggcaggactggttgccgggattgaaagaacagaaccacaccgtgctcgcagaggcccctccccaagccacaagtccgtgtcaaggaaacagagctcacctatcagccccaaggataactaccagagagtgagctcactttctcccagtcagtgtcgtaaggacaagtgccagtcctttccaacgcatccagaatttgccttttacgacaatacatccttcggactgaccgaagccgagcaacgtatgctagatctgccaggctacttcgggtcaaacgaagaggacgaaacgacaagtactctttccgtcgagaaactggttatctag

SEQ ID NO: 5606 - DNA, 927 bp, Artificial Sequence
  Description of Artificial Sequence: Synthetic coding sequence
atgcgacttttgccggagtggttcttgttattgtttggcccctggctgctcagaaaggctgtgtccgctcagattcccgagtccgggagaccgcagtacctcggactgaggccagctgccgccggtgccggcgcacccggtcagcagctgcctgaaccgcggtcttcagacgggttgggagttggccgagcttggagctgggcctggccgaccaatcataccggcgctcttgccagggcaggcgccgccggcgcactccccgcccagcgaacaaaacgcaaaccctcgatcaaggcggctagggccaaaaagattttcgggtggggggacttttacttcagggtgcatacgctgaaattctcactccttgtcactggaaaaattgtggatcatgtcaatggtaccttttctgtgtatttccgccacaactctagtagccttgggaatttgagcgtgagcattgttccgccatctaagagggtcgagtttgggggcgtttggctccctggaccggtcccccaccctcttcaatctacactcgccctggaaggtgtgctgcccgggttagggccccccttaggaatggctgcagcagccgctgggccagggctgggcggcagcctcgggggggctttggcggggccccttgggggggccctgggagtccccggagctaaggaatcaagggcgttcaactgtcatgttgagtacgagaaaaccaatagagcgcgcaagcaccggccctgcttatacgaccctagtcaggtttgcttcactgagcacacacagagccaggcagcatggttgtgcgctaaaccgtttaaagtgatctgtatcttcgtgagtttcctgagtttcgattacaaactcgtacaaaaggtatgcccagactataactttcagtcagagcacccctattttggctag

SEQ ID NO: 5607 - DNA, 795 bp, Artificial Sequence
  Description of Artificial Sequence: Synthetic coding sequence
atgaaactggggtgtgtattaatggcctgggctttgtatctgtcactgggtgtgctgtgggtggctcaaatgctacttgcagcatcctttgagacactgcaatgtgaaggtccagtgtgtacagaagagtcctcttgccacacagaggacgacctgacagatgcacgcgaagctggctttcaagttaaagcttacactttttccgagccattccatctgattgtgagttacgattggttaattctgcagggacctgcaaagcccgtctttgagggtgacctgctggtgctcaggtgtcaagcttggcaggactggcctctgacccaggttacgttctatcgcgacggatcagcgctcggtccccccggccccaatagggaatttagtataacagttgtgcagaaagccgattcaggacactatcattgtagcggtattttccagagtccaggccccggcatcccagaaaccgcttcggtcgtagcaataacagtccaaggggcatcctcatctgctgcgccgcccacgctgaaccccgccccacagaagagcgccgcccctggaactgctccagaggaggcccccggtccactccccccacccccgaccccctcgtccgaagaccccggcttcagtagccctctggggatgccagatcctcacctgtaccaccagatgggattgctgctgaaacatatgcaggatgtgagggtgctgcttggtcacctgcttatggagttaagagaattatccggacatcggaagccgggcaccacaaaagctactgcggaatag

SEQ ID NO: 5608 - DNA, 1362 bp, Artificial Sequence
  Description of Artificial Sequence: Synthetic coding sequence
atgctgaggatcctctgcctcgcgctctgcagcctgttgaccggcacacgcgccgaccctggcgcgctcctgcggctgggcatggacattatgaaccaggtgcagagcgccatggacgaaagccatattcttgagaaaatggccgctgaagctggcaaaaaacaaccaggcatgaagccaatcaaagggatcaccaatctgaaagtcaaggacgttcagctccctgtgatcaccttgaactttgtacccggcgtcggtatatttcagtgcgtgtcaaccggtatgaccgtcaccggcaagtcttttatgggcgggaacatggaaatcatcgtcgccctcaacataacggctaccaatcgcctccttcgggacgaagagactgggctgccagtgtttaaaagtgaaggctgtgaagtcattctcgtaaatgtgaaaactaacctgcccagcaacatgttaccaaagatggtgaataaatttttagatagcaccctgcataaggtcctcccaggattaatgtgtccagccatagacgccgttttagtatatgtgaatcggaaatggacaaacctgtcagacccaatgcccgtgggccaaatgggtacggttaaatacgtgttaatgtcagcccctgcaaccaccgcttcatatattcagctggattttagccccgtggtgcaacagcaaaagggcaagaccattaagctggctgacgccggcgaggcattgacctttccggaggggtacgccaaagggtcttcccagctcctcttgccggcgacatttttgtcggcagagctagctctgctgcagaagagttttcatgtcaacatccaggatactatgataggcgagctgccaccacagacgaccaaaacattagcgcgtttcattcctgaggtcgcagttgcctatcctaaatctaaacccctgactactcagattaaaattaagaaaccacctaaagtcactatgaagactggcaagagcttactacatctgcactcgactctcgaaatgtttgctgctcggtggcgcagcaaggccccgatgtccctgtttttgttagaagtgcactttaaccttaaagtgcagtatagcgtccatgaaaaccagctacagatggccaccagtttagacagactgctcagtctgtctcggaaatccagtagcataggaaacttcaatgagagggagctcacaggcttcatcacatcataccttgaagaggcgtatatcccagtggtgaatgacgttttgcaagtcggactgccccttcccgacttcctggctatgaattacaatctggctgagctggacatagtggaaaacgccttgatgctcgacctgaaactaggttag

SEQ ID NO: 5609 - DNA, 1323 bp, Artificial Sequence
  Description of Artificial Sequence: Synthetic coding sequence
atgagtgctcgcgggcgatgggagggagggggacgtcgcgcctgtaggggaagtttggggctagcccgtgcccagggcgccgagcgtgtgacgtcttctgaacagagacccgccatggcctcgctgggcctgctgctgctgctgctgctgaccgcgttaccaccactgtggtcttcctccctgcccggcctcgacacggccgaatcaaaggctaccatcgccgatctgattctgagcgcacttgaaagggctaccgtttttcttgagcagcgtctacccgagatcaatttggacggcatggtgggggtgagggtgctggaggagcagctcaagtcggtgagggaaaaatgggcgcaagaaccactcctgcagccgctcagcctaagagtggggatgctcggtgaaaagcttgaggctgctatccagaggagcctgcactacctgaaactgagcgacccgaagtatctccgagagttccagctcacactgcaacccggattctggaagctgccacatgcctggatccatacagacgcgtccctagtgtaccctacctttgggccacaggactcattttccgaggagcgctccgatgtttgtcttgtgcaactcctcggaacaggcactgactcctcggagccttgcggattgagtgatctctgtcgctccttgatgacaaaacctggttgtagcgggtattgtctgtcgcaccagttactcttctttctttgggcccgcatgcggggctgtactcagggccctctgcaacaaagccaagattacatcaacttgttctgtgcgaacatgatggacctgaataggcgagcggaggccattggatacgcctaccctactagagacattttcatggagaatatcatgttctgcggcatgggcggcttcagcgatttttacaagttacgctggctcgaggctatcctctcgtggcagaaacaacaggagggctgtttcggcgaaccggatgctgaggacgaggagctctccaaggccattcagtaccagcagcactttagcaggcgggtgaagcggagagaaaagcaattccccgatagtcgatctgtcgcgcaggcaggagtccaatggagaaatctgggctctctacagcctctccccccaggcttcaaacagttctcctgcttgatactgccttcatcctgggactatcggtccgttcccccatacctggccaatttctatatttttttagttgagaccggattccatcacgtggcgcatgccggcctcgaactgttgatctcacgcgacccccctacatcaggatctcagagcgtgggcctttag

SEQ ID NO: 5610 - DNA, 708 bp, Artificial Sequence
  Description of Artificial Sequence: Synthetic coding sequence
atgaagtacgtcttctacctgggcgtgttggccggcacctttttttttgctgactcaagcgttcagaaggaagatcctgccccctacttggtatatctgaaaagccactttaacccttgcgttggtgttttgataaaaccgtcctgggtattggccccagcacattgctatctccctaatctgaaggttatgctcgggaattttaagtcaagggtccgcgacgggacagaacagactatcaaccccatccagatcgttcgctattggaattattcccacagcgcaccccaggatgacctgatgcttattaaactggcaaaaccggccatgttgaaccctaaggtgcagccactgacactcgcaactacgaacgttcgcccaggaaccgtgtgccttctttccggattggactggtcgcaggagaacagcggtagacaccccgatctgcgccagaacttggaagcccccgtaatgagtgatcgcgaatgccaaaagacagaacagggaaagagccaccggaactccctgtgcgtaaaatttgtaaaagtgttctccaggattttcggggaggtcgccgtcgcaaccgtgatttgcaaagataaactgcaggggattgaggttggccactttatggggggagacgtgggtatctacactaatgtgtacaaatacgtctcatggatagagaataccgcaaaagacaagtag

SEQ ID NO: 5611 - DNA, 426 bp, Artificial Sequence
  Description of Artificial Sequence: Synthetic coding sequence
atgctgaagaaaatttccgtgggagtggcgggcgacctcaatacagtgaccatgaagctggggtgcgttctgatggcatgggccttgtatttgagcttgggggtcctgtgggtggctcagatgcttctcggtgcatcgtcaagtgccgcaccccctactctgaatcctgccccacaaaaatcagccgctccaggcacagcaccagaagaagctccgggccccctgccaccccccccaactccctcaagtgaggatccaggattctctagtcccctaggaatgcctgaccctcacctctaccaccagatgggactgctcttaaagcacatgcaggacgtccgagtgctgctggggcacttactgatggagcttagggaactgtccggacacagaaaacctggaactaccaaggccacagccgagtag

SEQ ID NO: 5612 - DNA, 2886 bp, Artificial Sequence
  Description of Artificial Sequence: Synthetic coding sequence
atgttagccccgagaggagccgctgtcctcctgttacacctggtgttacagaggtggctggcagccggcgcacaggctaccccacaggttttcgaccttctaccatcctcttcgcaaaggttgaacccaggagcattacttccggtcctgaccgatcccgctttgaacgatttgtacgtgatctcaacgttcaaactgcagacaaagtcatctgcgactatctttggcttatactctagcactgacaacagcaagtactttgagttcacagtcatgggccgcctcaataaggccatcctgcgctacctgaagaacgacggaaaggtccatctggtggtctttaacaatcttcaactcgctgatggccgtcggcatcgcatcctactgcggttgagcaatcttcaaaggggcgctggatctctggaactatacctcgactgcatccaggtggactccgtgcataacttgccaagagccttcgccggtccttcacagaaacccgagacaatcgagctacgcactttccagcggaagcctcaggattttctggaggagctgaaattggtagtgcgcggatctctcttccaggtggcctcacttcaggactgctttctgcaacagtctgaacctctggccgccacaggaacaggcgacttcaaccggcagttcctgggtcaaatgactcagttaaaccagctgctcggggaggtcaaggatttgttgcggcagcaagtgaaggaaacttccttcctacggaacactatcgccgaatgccaggcatgcggacccttaaaattccagagccctacgcctagcacagtggtgcctccggccccaccagctccgcccacacggccccctcgaagatgcgactcaaacccctgcttccgaggagtgcagtgtacagatagtcgtgacggttttcaatgcggtccctgccctgagggttatacaggtaacggcattacctgcattgacgttgacgagtgcaagtaccacccatgctacccaggagtgcattgcatcaacttgtcaccagggttccgttgcgacgcgtgccctgttggcttcactggccctatggtgcagggagtgggaatctcattcgcaaagtcaaataaacaggtgtgtactgatatcgacgaatgtcggaatggcgcctgtgttcctaacagtatctgcgtcaataccctggggtcctacagatgtgggccctgcaaaccaggctacaccggcgaccagattaggggctgtaaagcagaaaggaactgtcggaatccagagctgaacccctgctccgtgaacgcacagtgcattgaggaaaggcaaggggatgtaacctgtgtgtgtggagtggggtgggccggcgacggctatatttgcgggaaagacgttgacattgatagctacccagatgaggagctgccgtgttcagccagaaactgcaagaaggataattgtaaatatgtgcccaactctggtcaggaagacgcagatcgcgacggcatcggagacgcatgcgatgaggacgcagatggcgacggtatccttaacgaacaggataactgtgtgctgattcataacgtggatcagagaaactccgataaggatatctttggagatgcatgcgacaactgcctgtctgtattgaataacgatcagaaggacaccgatggagacggtaggggcgatgcctgcgacgatgacatggacggcgacgggatcaagaatatccttgataactgcccaaagttcccgaatagagaccagagggataaggatggcgatggggtgggggatgcctgcgattcatgtcccgatgttagtaacccgaatcagagcgatgtcgacaatgatctggttggggactcctgtgatacaaaccaagacagtgacggcgacgggcaccaagacagtacagataactgtcccaccgtgataaactccgctcagctagatactgacaaagacggcatcggcgacgagtgcgatgacgacgacgataacgacggcattccagacctggtaccccccgggcctgacaactgccggctagtaccaaaccccgcgcaggaggatagcaactccgacggtgtgggggatatctgtgagtccgacttcgaccaagatcaggtcattgatcgtattgacgtttgccccgagaacgccgaagtgacccttacagacttcagggcctaccagaccgtcgtgctggaccccgagggcgacgcacagattgaccccaactgggtggttctgaatcagggtatggagatcgtgcagactatgaacagcgatcccggcctggctgtgggctatacagctttcaatggagtagacttcgagggcacgtttcacgtcaacacacagaccgatgatgactatgcaggtttcatatttggctaccaagacagctcttctttctacgtggtgatgtggaaacaaactgagcaaacctactggcaagcgactcctttcagagccgtcgctgaaccaggcattcagttgaaagccgtgaagtcaaagacagggcccggtgagcacctccgaaactctttgtggcatacgggagatacatccgaccaagtaagactgctctggaaggattccagaaacgtcggctggaaagacaaagtctcatatcggtggtttctgcagcaccgtcctcaggtgggatatatccgggtgagattttacgagggatccgagcttgtggcggacagcggggttaccattgatacaacgatgaggggcgggcggctgggcgttttttgtttcagtcaagagaacattatctggagtaacctgaaatacaggtgcaacgacaccatcccagaggattttcaggagttccaaacccagaattttgaccgttttgacaactag

SEQ ID NO: 5613 - DNA, 300 bp, Artificial Sequence
  Description of Artificial Sequence: Synthetic coding sequence
atggacaacgtacagcctaagattaagcaccgacctttctgtttctctgtcaagggacacgtaaaaatgctcaggctggacattatcaactctcttgttactaccgtgtttatgctgatcgtttccgtgctcgccctcatcccagagacaactaccctgactgtgggtggaggagtcttcgcactggtcacagccgtgtgctgtttggctgatggagccctgatttatcgaaaactgctatttaacccgtcaggtccataccagaaaaagccggttcacgaaaagaaagaggtcttatag

SEQ ID NO: 5614 - DNA, 408 bp, Artificial Sequence
  Description of Artificial Sequence: Synthetic coding sequence
atgtccccacatctgactgcactgctgggtttggttctgtgcctggcccagaccatccacacccaagaaggagcactcccacgccctagcattagtgcagagcccggtactgtgatatcacccgggagtcacgtgacctttatgtgtcgggggcccgtgggcgtgcagacattccgactcgagagggaagacagagccaaatataaagactcatataatgtgttcaggcttggtccctctgaaagcgaagcccgctttcacatcgattctgtctctgaggggaatgcagggttgtatcgttgtctgtattacaagcctcctggatggagtgagcactcggacttcctggagctcttagtcaagggcacagtgccagggaccgaggccagcggattcgacgctccctag

SEQ ID NO: 5615 - DNA, 231 bp, Artificial Sequence
  Description of Artificial Sequence: Synthetic coding sequence
atgctgccatgccttgcactgctccttcttatggagctgagtgtctgcacagtggcaggagatgggggcgaggaacaaactctctccacagaagccgaaacatgggagggtgcaggtccttctatccagctgcagttgcaggaggtgaagacggggaaggctagccagtttttcgggcttatgggcaaaagagtaggcggacgagaggacgaagcccaaggtagtgagtag

SEQ ID NO: 5616 - DNA, 684 bp, Artificial Sequence
  Description of Artificial Sequence: Synthetic coding sequence
atgcgcggtcagggacgtaaagaatctctgtctgactctcgcgatttggacggatcgtatgatcagctgaccgactccgttgatgatgaattcgagctctccacagtgtgccacaggcccgaggggctagagcagcttcaagaacagaccaagttcactagaaaggaactgcaggtcctgtatcgtggctttaagaatcctggggccctttcctttcaggagtgcccaagcggaatcgtcaacgaagaaaatttcaagcagatttactctcagttttttcctcagggcgactctagtacttatgcaaccttcctgttcaacgctttcgatactaaccacgatggttcagtttcctttgaggactttgtcgctggcctgtcggtcatcctgcgggggaccgttgacgacagacttaattgggccttcaacctctatgacctgaacaaggacggatgcattaccaaagaagaaatgcttgatattatgaagtccatttacgatatgatgggaaaatacacataccctgccctgagagaggaggctccacgagagcatgtcgaatcgttcttccaaaagatggataggaataaagacggcgtcgtgacgatcgaagagttcatagaatcttgccagaaagacgagaacatcatgagaagcatgcagctctttgataacgttatatag

SEQ ID NO: 5617 - DNA, 876 bp, Artificial Sequence
  Description of Artificial Sequence: Synthetic coding sequence
atgatgagcgctaccggacctggccgcaaaatgggcagtaggggtcagggcctgctgcttgcttactgtcttctcttggcttttgcatccggcttggtactttcgcgggtgccgcacgtgcagggcgaacaacaggagtgggaagggacagaagagctgccatcgccccccgaccatgccgaacgagccgaggaacagcatgaaaaatataggccaagtcaggaccagggattaccagcctctcggtgcctgcgctgctgcgacccaggcacatctatgtaccccgctaccgccgtaccccagattaacatcacgattctaaagggggagaaaggtgacaggggagacagaggactccagggaaaatatgggaagacaggatctgccggagccagaggccatacaggtccaaagggacaaaaagggtctatgggagcccctggtgagagatgcaaatcccactatgccgccttctcagtgggcaggaagaaaccaatgcactccaaccactattatcagacagtgatattcgacactgaattcgttaacttgtacgaccattttaatatgttcaccggtaaattctattgttacgtgcctggcctttactttttcagtctgaatgttcacacctggaaccagaaggagacctacttgcatatcatgaagaatgaagaggaggtggtgatcctgttcgcacaggtgggcgatcgatctattatgcagagccagtctttgatgctggaactgagggaacaggaccaggtgtgggtgagactttacaagggagagcgcgagaacgcaatcttctccgaagaactggatacctatatcacattctctggctacttagtgaagcatgcaacggagccttag

SEQ ID NO: 5618 - DNA, 213 bp, Artificial Sequence
  Description of Artificial Sequence: Synthetic coding sequence
atggaacgtggggctggagccaaactcctgcctctgctgctcctattgcgagccaccggctttacatgcgcccagacagacggtcgaaatggctatacagccgtcatcgaggtgacctccggcgggccctggggtgactgggcctggcctgagatgtgcccggacggtttctttgctagcggtttcagcctaaaactcgggaggatggagtag

SEQ ID NO: 5619 - DNA, 402 bp, Artificial Sequence
  Description of Artificial Sequence: Synthetic coding sequence
atgggttcatcgggattgctgtccctgttagtactatttgttctcctggccaacgttcaggggcctgggctcactgattggctattcccgcggagatgtcctaagattcgtgaagaatgtgagttccaagaacgagatgtgtgcactaaagacaggcaatgtcaagataataagaaatgttgcgtgtttagctgtggcaaaaagtgtttggacctaaagcaggatgtctgtgagatgccaaaggagacaggcccatgtctggcctattttttacactggtggtacgataagaaggacaatacttgcagcatgttcgtgtacgggggttgccagggaaacaacaataatttccagagcaaggcaaattgcctgaatacatgcaagaataagagattcccctag

SEQ ID NO: 5620 - DNA, 771 bp, Artificial Sequence
  Description of Artificial Sequence: Synthetic coding sequence
atgttccagactggcggccttattgtcttctacggcctgttagcccaaactatggcccagtttggcggactccctgttcctctggaccaaacactccccctgaacgtgaaccccgcactcccacttagtcccactggtcttgccgggagtctgaccaatgctctttctaatggacttctgagcggcggcctgttgggcattctggaaaatctccccctcctggatatcctaaagcctggtggaggcacaagcgggggactcctgggaggcctgttagggaaagtgacttccgtgattccgggactgaataatattattgatattaaggtgacggatccgcagctactggagttgggactggtgcaaagccctgacggacaccgtctgtatgttacaattcctctgggcattaagctgcaggtgaatacaccattggtaggcgcgtccctgctgcggctggcggtcaagcttgacatcactgccgagatcctcgcagtgagggacaaacaggagcgtattcatctggtcttgggagattgtacccacagcccggggtcacttcagattagtttgctggatggcctgggacctcttcccattcagggactgttggacagcttgactggcatacttaataaggtgctccctgaactggtgcaggggaatgtgtgtccactggtcaatgaagttctcaggggacttgatattaccttggtgcacgacatagtgaacatgcttatccacgggttacagttcgttattaaagtctag

SEQ ID NO: 5621 - DNA, 1386 bp, Artificial Sequence
  Description of Artificial Sequence: Synthetic coding sequence
atgagcctagatatccaaagtttggatatccagtgcgaggagctgtccgatgcccggtgggccgaattgctgcctctattgcagcagtgtcaagttgtccgattggatgactgcgggctaacagaggcccgatgcaaggacatcagctcggccctaagagtgaaccctgccttggctgaactgaatctcagaagcaatgaactgggagatgtgggtgtgcactgtgtgctgcaaggtctccagactcccagctgtaaaattcagaaactgagcttacaaaactgctgcctgacaggagcaggatgcggtgtcctctctagtacactcagaacactccctactttgcaggagctccatctgagcgataatctactgggagacgcaggactgcagctcctctgcgaaggtctattagatcctcagtgtagactggagaaattgcaactggagtactgctccctctcagcagcaagttgcgagcctctggcctcggtcctgcgggccaagcccgacttcaaggagcttaccgtgtctaataacgatattaatgaagcgggagtgcgggtactgtgccaaggcctaaaggatagcccatgtcagcttgaagccctgaagctggagagttgtggtgtaaccagtgacaattgccgcgatttatgcggcatagtcgccagcaaggcaagcctccgggaactcgctttgggaagcaacaagctgggtgacgtcgggatggccgagctctgtccagggctcctccacccctcttctagactgagaacgctgtggatttgggagtgtggcataaccgctaagggttgcggtgatctatgtagggtgctcagggctaaagagtccctaaaggagctgagcttggccggcaatgagctgggggatgaaggcgcccgcctcctgtgcgaaacactcctggaacccggctgccagctggagtccctctgggtgaagtcttgcagctttactgccgcctgctgctctcattttagctccgttctggcccagaatagattcctattagagctccagatttccaacaatagactggaggatgctggtgtgcgggaactgtgccagggactgggacaaccaggttctgtgctgcgggtgctgtggctggctgactgtgatgtgagtgacagcagttgttccagtctggctgccaccttgctcgcgaaccatagcctgcgggaactggatctgtccaataactgcttaggcgacgcaggcatcctgcagctggtggagagtgtgcggcagcccggctgcttactggaacagttagtactttacgacatttactggagtgaggagatggaggatcgcctgcaggccttggaaaaagataaaccttcgctgagagtaatatcatag

SEQ ID NO: 5622 - DNA, 534 bp, Artificial Sequence
  Description of Artificial Sequence: Synthetic coding sequence
atgcgactgttgatactgacttgcctggtcgcagtggcgctggcacgcccgaagctgcccttacgctatccggagcgtctgcagaacccttccgaatccagcgaacctatccctctggagtcacgcgaggagtacatgaacggcatgaatcgccagaggaatatattgagggaaaagcagactgacgagattaaaaactgcgttgtcgccgaacccgaaaagatggaatctagtatatccagtagcagtgaggagatgagcctgtctaagtgcgcggaacagttttgtcgcctgaatgagtacaaccagctccagttgcagaagatgagcaagcaagagcaaatccgaaggatgaacgaaaattcccatgtccaagtaccattccagcagttgaaccagctggcagcatatccctacgccgtttggtactatccccagattatgcagtatgtgcctttcccacccttttccgacatcagtaatcctactgcccacgaaaactatgagaaaaacaacgtcatgttacagtggtag

SEQ ID NO: 5623 - DNA, 3054 bp, Artificial Sequence
  Description of Artificial Sequence: Synthetic coding sequence
atggatcttattagaggcgtgctattacgcctgctgctcctagcctcctcgctggggcctggggctgtcagcttgagggctgctatccgcaaaccaggcaaagtcggcccgccgctcgacatcaagttaggagcattgaactgtacagctttcagcatacagtggaaaatgcctcgacatccaggaagtcccatactgggttacacagtattctattcggaagtaggggctgacaagtcccttcaggagcagctacactccgtccccctgtctcgcgacatccccacgacagaggaagtgataggcgacctgaaacccgggacagaatacagggtcagtatcgcagcatattcacaggctggtaaaggacgcctcagcagccctaggcacgttaccacattgagccaggactcttgtttgccaccagccgccccccaacagccgcatgtgattgtcgtcagcgatagcgaggtcgcactatcctggaaacctggtgcctctgagggctctgcacctatccaatactacagcgtagagttcatacgaccagacttcgacaaaaagtggacatccattcacgagaggattcagatggattccatggtgatcaagggtctggacccggacacaaattaccagttcgcagtcagggctatgaacagtcacggaccttctccccgttcctggccttctgatataatcaggacgctttgcccagaggaggccggttccggccgctacggccctcgatatattactgacatgggtgcaggagaggatgatgaaggtttcgaggatgacttggacctggatatttcctttgaggaggtgaagccactgccagcaactaaaggtgggaacaagaaatttctcgtagagtctaagaaaatgtccatctcgaatcctaagacgattagccgcttgatcccccccacatctgcatccctcccagtcactactgtggcacctcaaccaatccctattcagaggaagggcaagaacggcgttgccataatgtctaggctctttgatatgccttgtgatgagacgttgtgcagtgccgacagtttttgcgtgaatgattatacctggggaggatcaaggtgccagtgtactctgggtaagggcggagaatcgtgctctgaagatatagttattcagtatcctcagttttttggtcactcttacgttactttcgagcccttgaaaaactcttatcaagcctttcagatcacccttgagttcagggcagaggctgaagatgggctgttgctgtattgtggtgagaatgaacatggccggggagacttcatgagtcttgccatcataaggcggagtctgcagtttcgctttaattgtgggacaggggtcgcgattatagtctctgaaacaaaaatcaagctggggggctggcacactgtgatgctctaccgcgatggcctcaacggcctacttcagttgaataacggtactcctgtcacaggtcaatcccaaggtcaatatagcaagattactttcagaacccccctgtatctcggcggcgcccccagcgcctactggcttgtgcgagctactggaacaaaccgtgggtttcagggttgcgttcaatcattagcagtcaatgggcgtaggattgatatgcggccttggcccttagggaaagccctcagcggagccgacgtcggcgagtgtagctccggcatctgcgacgaagcatcctgcattcacgggggcacttgcaccgctatcaaggcggatagctatatttgcctctgtccccttggatttaagggccgtcactgtgaggacgcctttacactcacgatcccacagtttagggaatctctgcgttcatatgctgccacgccttggccattagagcctcagcactatctaagcttcatggagtttgaaattacctttaggccagatagtggggacggcgtgttgctctactcctatgacactggaagcaaggattttctctctatcaatctggccggcggtcacgtagagttcaggttcgactgtggttctggtactggggtgctgcggagcgaggacccattgaccctcgggaactggcacgaactgcgcgtgagcaggacagcaaagaacggtatccttcaggtagataagcagaaaattgttgaagggatggcagaaggtgggtttacccagattaagtgcaatactgatattttcataggcggggttcctaactacgatgatgtcaaaaagaattccggtgtgctgaagcccttcagcggcagtattcagaagatcattctgaacgataggactattcacgttaagcacgatttcacttccggagtgaacgtggagaacgctgcccacccatgcgtgagggccccgtgcgctcacggcggctcatgccgaccgcgaaaagagggctacgactgtgactgtcctttggggtttgaaggactgcactgtcagaaagagtgcggcaactattgcctgaacacaattattgaggccattgagatcccccagttcattgggcgtagctatctgacatatgacaatcccgacatccttaagcgcgtctccggaagtcgcagcaatgtgtttatgcggtttaagacaactgctaaggacggccttctgctctggagaggggactctcctatgcgcccaaattcagattttatcagtttggggctgcgtgatggcgcactagtgtttagctataatttgggctcgggggttgccagcatcatggtcaatggaagctttaatgatgggcgctggcaccgggtcaaagctgtgcgagacgggcagagtgggaaaatcacagttgacgactatggggccagaactgggaaatccccaggcatgatgcgccagttaaacatcaacggcgcactctatgtgggtggaatgaaggaaatcgcactgcacacgaatagacagtatatgagggggcttgtggggtgtatcagtcacttcaccctgtcaaccgactaccacattagcttggtggaggacgcagtggacggcaagaacataaatacttgtggtgctaaatag

SEQ ID NO: 5624 - DNA, 1893 bp, Artificial Sequence
  Description of Artificial Sequence: Synthetic coding sequence
atgcaacaagacggtctgggagtagggactaggaatggtagcgggaaaggcagatcagttcacccctcttggccatggtgtgcacctcgaccattacgatattttgggcgggacgctagggcccggagggctcaaacggccgcaatggcgctcctcgcaggaggattgagtaggggtctgggcagccatcctgccgccgctgggagagatgctgttgtttttgtatggctcctcctgtcaacatggtgtaccgcccccgccagagccatccaggtgaccgtctcaaacccgtatcatgtagtgattttgttccagcctgtgacactaccctgcacataccagatgacaagcactcctacccaacccatagtgatctggaagtacaagagcttttgtcgggaccgcattgcagatgctttcagtcccgcatcggtggataatcagttgaatgcccagctggctgccggaaacccaggatataacccctacgtagaatgccaagattcagtgaggactgtgcgagttgtggccacaaagcagggaaacgctgttacactgggagactactaccagggaagacggatcaccattaccggaaatgccgatctcactttcgaccagacggcatggggcgacagcggcgtgtactactgcagtgttgtctcagcccaggatttgcaggggaataacgaggcttacgctgagcttatcgtcctggactggctctttgtggtcgtcgtgtgcctcgccgcatttttgatatttctcctgctggggatatgctggtgtcagtgttgcccacacacatgttgctgctatgtcagatgtccctgttgccccgataaatgttgttgcccagaggccctctacgctgccggcaaagcagccacttccggagtacccagcatttatgcacctagtacctatgctcacctctcacccgcaaaaactccaccacctcctgccatgattcccatgggtcctgcttataacgggtacccaggcgggtatcctggtgacgtcgacagatcttccagcgctggcggccagggaagctacgtgccgttgctccgggatactgattctagcgtggcaagcgaggtgcgatctggataccgaatacaggcctcccagcaggatgattcaatgagggtgctctattatatggagaaggagctggcaaacttcgatccttcaaggcccggtccacctagtgggcgcgtggaaagggcaatgtcagaggtgacgtcactccacgaagacgactggcggtctaggccgagtagaggcccagcactgacccccatacgagacgaggagtggggaggacactcacctagaagccccaggggctgggatcaagagccagctcgggaacaggccggcggagggtggagggcacgtcgaccccgagcccgctctgtcgacgcactcgacgacctcacacctccttcgaccgccgagtctggatcgcgaagccctactagtaatggaggccgctcgcgggcatacatgcctccgcggtcaaggtcacgggatgatctgtacgaccaagacgattctcgggatttccctcggtccagagaccctcattatgatgacttcagaagtagggagcgaccccccgctgatccacgttcccatcaccatagaactagggatcccagggacaacggatcaagatctggcgacctgccctatgacgggagactgctggaagaggcagtgaggaaaaaaggctctgaggagcggcgtaggccacataaggaggaggaggaagaggcctattatccacccgcccctcccccatattccgagactgatagccaggcttcaagggaaagacgattaaagaaaaatctggcattaagtcgagagtctctcgtagtctag

SEQ ID NO: 5625 - DNA, 750 bp, Artificial Sequence
  Description of Artificial Sequence: Synthetic coding sequence
atgctacaactgtggaaattagtgttgctatgcggtgtactgacaggtactagtgagtctttgttggataacctaggcaatgatttaagcaacgtggttgacaagctcgaaccagtgctgcacgaggggctcgaaacagtggacaacaccctgaaagggatcctggagaaactgaaggtggacctgggtgtgctgcagaagtcctccgcttggcagcttgctaagcagaaagcgcaggaagctgagaagcttctgaataacgtgatctctaaactcctgccaaccaacacagacatctttgggcttaaaatcagtaactcgctcattctggatgtcaaggcagaaccaatagacgacggcaaagggctgaacttatcttttccagtgacagccaatgtgacggttgccggaccgataataggccagatcattaacctgaaagcatcccttgaccttcttaccgctgtgaccattgagactgatccacagactcaccagccagtcgccgtgctgggtgagtgtgctagcgatcctactagtatcagcttgagtttgcttgataagcactctcagatcatcaacaaatttgtgaatagcgtgatcaatacattgaagtcgaccgtcagttcgttgctccagaaggagatttgtcccctgatccgtattttcatccactccttggatgtcaatgttattcagcaggtggtggacaacccacagcacaagactcagctccagacactgatctag

SEQ ID NO: 5626 - DNA, 3057 bp, Artificial Sequence
  Description of Artificial Sequence: Synthetic coding sequence
atggtctcacacttcatgggatccctgtccgtcctttgtttccttcttctgctgggctttcagttcgtgtgtccccaaccatcaacccagcatcggaaagtgccgcagagaatggccgcagaaggggcacccgaagacgatgggggcgggggcgcgcctggcgtctggggtgcttggggaccgtggagcgcttgctccaggtcctgctccgggggggttatggaacagacccgcccgtgtctcccacgcagctatagacttcggggcgggcagcggcctggagcgcctgccagagccttcgctgatcacgtggtctctgcggtccggactagcgtgccactccatcgctcccgagatgagacgccggctctcgctgggaccgatgccagtagacaaggcccgactgttcttcgcgggtcgagacatccccagccccagggcttggaggttactggcgatcggagatccaggacccgcggaacaataggacctggaaagtatggatacgggaaagcaccctatatactgcccctccagacagataccgcccacacgccacagcgtttgaggagacagaaactcagctctcgccactcacgctcacagggagcctcgtcagctcgacatggatattcaagtcccgctcaccaggtccctcagcacggaccactttatcaatctgattcaggtcctcgttcgggccttcaagctgccgaggcacccatctaccagctgccacttacgcatgaccaggggtatcctgccgcttcgtcgctctttcattcccccgagacctccaacaaccatggcgtcgggacacatggggccacccagtccttttcacaacctgcacgctccacagccatctcgtgcatcggagcctacagacagtacaagttgtgtaatactaacgtgtgccctgagtccagccggtcaattcgtgaggtacagtgcgcctcatacaataacaaacccttcatggggaggttttatgaatgggagccattcgctgaagtgaagggcaaccgaaagtgtgagttaaattgccaggcgatgggatacaggttttatgttcggcaggccgagaaggtcattgatgggaccccatgcgatcaaaacggcacagccatttgcgtctccgggcaatgtaaaagtatcgggtgcgatgattacctcggatctgacaaggtggttgacaaatgcggcgtgtgtgggggggacaatacaggatgtcaggtcgtgtccggcgttttcaaacacgcgctaactagcctgggatatcacagggtggtggaaataccagagggagccaccaagattaacatcaccgagatgtacaagagtaacaattacttagcactcaggtctaggtccggtcgaagcatcatcaatggcaactgggcgatcgaccgcccgggaaaatatgaaggcggagggacgatgtttacttataaacgacccaacgaaatatcttccaccgccggtgagtctttcctggccgaaggacccactaatgaaatacttgacgtctacatgatccaccaacaaccgaatccaggcgttcactatgagtatgtgatcatggggacgaacgccattagccctcaagtaccaccacatcggcgaccaggcgaaccctttaatggccagatggtgaccgaaggcagaagtcaggaggaaggggagcagaaaggtcggaacgaggagaaggaggatcttcggggtgaggcacctgagatgtttacatcagaatccgcccagaccttccccgtgagacatccagaccgcttctctccacatcgcccggataatctggtgcccccggcaccccaacctccgcgccgttctcgcgaccacaattggaaacagctgggaaccaccgagtgctccacaacatgtggcaagggatcacaatatccaatctttcggtgtgtgcacagatccacgcatgaggaagctccagagagctattgcgacagcagcatgaaaccaaccccggaggaggagccgtgcaatatattcccctgtccggccttttgggatattggggagtggagcgagtgcagtaagacttgtgggctggggatgcagcacagacaggtgttatgcaggcaagtgtacgccaacaggtcgctcacagtccagccttatcggtgtcagcatctcgagaaaccagaaacaaccagcacgtgtcaactgaagatttgctcagagtggcagattcgcacagactggacatcctgctctgtgccctgcggggtcgggcaacgcaccagggatgtgaagtgcgtttctaatataggtgacgtcgtcgacgacgaggagtgtaatatgaaactgcgtcctaacgatattgaaaactgtgatatgggcccttgtgccaaatcttggtttttgaccgagtggagcgagcggtgttctgctgaatgtggcgcaggtgtccgcacccggagtgtggtgtgcatgaccaatcatgtttcgtcgcttcctctggagggatgcggcaataatagaccggctgaagcaacaccatgtgataacggcccctgcaccggtaaagtggagtggtttgccggctcatggtcccagtgtagtattgaatgtgggagcgggacccagcagcgcgaggttatttgcgtgcggaagaatgcagacaccttcgaggtcctggacccgagcgaatgcagtttcctggaaaagccccccagccagcagagctgccacctcaaaccgtgcggtgctaagtggtttagcactgaatggtctatgtgcagtaagtcatgccagggggggtttcgtgtccgagaagtgcggtgcttgtccgatgatatgaccctgtcaaacttgtgcgaccctcagctgaagcctgaggagcgcgagtcctgtaatccccaggactgcgtgccagaagtggatgaaaattgcaaggacaagtactataattgtaacgtcgttgtacaagccaggctgtgtgtatacaattactacaaaacagcctgctgtgcatcgtgcaccagggtggccaatcgccaaaccggcttcctgggcagccgatag

SEQ ID NO: 5627 - DNA, 1311 bp, Artificial Sequence
  Description of Artificial Sequence: Synthetic coding sequence
atgcagggtactccagggggtggtacgcgccctggcccatccccagttgataggcggaccctgttagtgttttcgttcatcctagctgccgctctgggacaaatgaatttcactggcgaccaggtactgagggtgttagctaaagatgagaaacagctgagcctgctcggcgatctggagggcctgaagccccaaaaggtggacttttggcgcgggccagctaggccatccctcccagtggacatgagagttccgtttagcgagctgaaggacataaaagcctatctggaaagtcatgggctggcctacagcatcatgatcaaagatatccaggttcttctagatgaagagcggcaggccatggcaaagagccggcgccttgaaagatctactaattctttcagttattctagctaccataccttggaggaaatttattcctggattgataacttcgttatggaacactcagatatcgtttccaagatacagattggaaatagcttcgagaaccagagcatccttgtactcaagttctccactgggggatctcggcacccagcaatctggatagataccggcattcacagtcgggagtggattacgcacgctaccggaatttggacagccaataaaatcgtaagcgactacggcaaggacagagtgctcaccgatatcctcaacgctatggacatttttatcgagctagtaaccaatcctgatggtttcgcctttacacacagcatgaatagactctggcgaaaaaataaatcgatcaggcctggtatattctgcatcggggtcgatctgaaccgtaattggaagtccggctttgggggcaatggctccaatagcaatccctgctcggaaacatatcacggtcccagccctcagtcggagccagaggttgcagctatcgtgaattttattactgcacatggcaacttcaaggctctgatatcgattcacagttactcacagatgctgatgtacccctatggaagacttctggagccagtgtctaaccaaagagaactgtacgatttggctaaggatgccgtggaagcactttacaaggtgcacggtatcgagtacatttttgggagtatttccactaccctgtacgtggcatcggggatcactgttgactgggcttacgactccggaataaagtatgcattttcattcgagctcagagataccgggcagtatggtttcctgcttcctgcaactcagattataccgacagcccaggagacctggatggccctcagaacaataatggagcatacccttaatcacccctactag

SEQ ID NO: 5628 - DNA, 492 bp, Artificial Sequence
  Description of Artificial Sequence: Synthetic coding sequence
atgtttcaaggtctgttactgctcctgctgctcagtatgggaggaacatgggcatctaaagaacctcttcggcccagatgccgtcctatcaatgccacactggcagtcgagaaggaagggtgccccgtgtgtataaccgtaaacactactatttgcgctggatactgcccgacgatgacacgggttttgcagggagtattaccggctctcccccaggtcgtgtgtaactatagagacgtccgattcgaatccatccgcttacccggatgcccacggggcgtcaatcccgtggtctcttacgccgtggcgctgtcttgccagtgcgccttgtgcaggcgttcaaccactgactgcggtggcccaaaagatcaccctctaacctgcgacgacccccgttttcaggactcttccagctccaaggccccgccaccatcactcccaagcccctcacgcttaccgggcccgtccgacacccccatcctgcctcagtag

SEQ ID NO: 5629 - DNA, 213 bp, Artificial Sequence
  Description of Artificial Sequence: Synthetic coding sequence
atgccgggagccatgaaaatcttcgtgtttattctcgcagctctgattctcctcgctcaaatctttcaggcccggactgccatccatcgtgcgctgatctcgaagaggatggaaggtcattgtgaggctgagtgcctgactttcgaggtgaagattggagggtgcagggcagaactggctccgttctgctgtaagaaccgcaagaaacactag

SEQ ID NO: 5630 - DNA, 1098 bp, Artificial Sequence
  Description of Artificial Sequence: Synthetic coding sequence
atgtggctattgttaacaatggcctccctgatctcagtcctggggaccactcacggtttattcggtaaactgcacccaggcagcccagaggtcaccatgaacatcagtcaaatgatcacctactggggctaccccaacgaggagtacgaagtggtgaccgaagacggctacatcctggaagtgaatcgcatcccatacggtaaaaagaacagcggtaatacggacgctggttatgatgtttggctaggcaactccagagggaatacctgggctcgacggaatctgtactacagccccgactctgttgagttttgggctttctctttcgacgagatggccaaatatgaccttccagccactatagactttatagtgaagaagaccggacagaagcagttgcactacgtcggtcattcgcagggtactaccattggttttatagcctttagcaccaacccttcactggccaaaaggatcaagactttctacgctctggcccccgtggccacagtgaagtatactaagtctctgattaataaactaaggtttgtcccacagtcactctttaagttcattttcggcgacaaaatcttttacccacacaatttcttcgaccaatttctggcaacagaggtgtgtagcagggaaatgttaaatctgttgtgcagcaacgccttatttatcatctgcggtttcgacagcaaaaactttaatacatcgcggctagatgtgtacctgtctcacaatccggccggaactagtgtgcagaacatgttccattggacacaggccgtgaaatcaggaaaatttcaggcatacgactgggggtccccagttcagaaccgaatgcattatgaccaaagtcagccaccctattacaacgttaccgctatgaacgttccaatcgctgtatggaacggcggaaaagaccttctggcagatcctcaagacgtcgggttgttgctgcctaagctgccaaatctgatctaccacaaagagattcccttctataatcacttggacttcatatgggcaatggatgccccgcaagaagtgtataatgacatcgtgtcaatgatttccgaagacaagaaatag

SEQ ID NO: 5631 - DNA, 2535 bp, Artificial Sequence
  Description of Artificial Sequence: Synthetic coding sequence
atgggtccgggcgcccccttcgcaagggtgggttggccgcttcccttactggtggtcatggcggccggggtggccccggtgtgggcttctcactcaccgcatctcccacggccgcactcaagagttcccccacatccctcttcagagcggcgggccgtttatattggggctctgttcccgatgtctgggggatggcctggtgggcaggcttgccaaccagcggtcgaaatggcactcgaagatgttaacagcagacgtgacattctcccagattatgaactgaaactgatccatcacgatagtaagtgtgaccccgggcaggccactaaatatctgtacgagttattgtacaatgaccccatcaagatcattctcatgcctggctgttcatctgtgagcacactggtggctgaggcagcccgaatgtggaatctgatagtgttgagttatggctcctcttccccggctctgtcaaatagacagaggtttccaaccttcttcagaacacatcctagcgcaacattgcacaatccaactagggtcaagctcttcgagaagtggggctggaagaaaattgcaacgattcaacagactaccgaggtctttacctctactttagacgacctggaagaacgggtgaaggaggcgggcatcgaaataactttcagacagagctttttctcggatccagccgtccctgtaaaaaacttaaagcgacaggatgcccgaattattgtaggactcttctacgagactgaggcaagaaaggtgttttgcgaggtttataaggaaaggcttttcggcaaaaagtatgtgtggttcttaattggatggtatgctgacaactggttcaagatttatgatccatcgattaactgtactgtggacgaaatgactgaggccgtggagggccacattaccacagagatcgtgatgctgaatcctgcgaatactaggagcatcagcaacatgacttctcaggagttcgtcgagaagttgactaaacggctgaaacggcacccggaagagactgggggctttcaggaagctcctctggcttacgatgccatctgggccctggcgttggctctgaataaaacttccggtgggggtgggcggagcggagtgcggctcgaggactttaattacaacaaccagactataacggaccagatttatagggcgatgaactcctcatcctttgagggcgtaagtgggcacgtagtgtttgatgccagtgggtcacgtatggcctggacccttatcgagcagctgcaggggggctcatacaaaaagataggttattacgatagcaccaaggatgatctatcgtggtcaaagactgacaagtggattgggggcagtcctcctgctgatcaaacattggtgatcaaaactttcagatttttatcgcagaagctttttataagcgtttccgtactcagctctctggggatcgtgctggctgtggtgtgcctgtccttcaacatttataattcccacgttagatatattcagaacagccagcctaatctgaacaatctcactgccgtcggctgttccttagccctcgccgctgttttccctctgggactggacggctatcacattggacgaaatcagttcccattcgtgtgtcaagcccgattgtggctccttggtcttgggttctctctgggatacggtagcatgttcacaaaaatatggtgggtacacacagtgttcacaaagaaggaagagaagaaggagtggcgcaaaaccctggaaccatggaagctgtacgcaacggtcggtctgctggtcgggatggacgtgttaaccctggccatctggcagatagtggatccactgcacaggacgattgagacttttgccaaagaggagcccaaggaggatatcgatgtctccatccttccccaactcgagcactgctccagccgaaaaatgaatacctggttgggaatattctacgggtacaagggactcctgctgctcctgggaatcttcctcgcgtatgaaaccaagagcgtgtccacagaaaaaatcaatgaccacagagcagtcggtatggcgatatacaacgtagcggttctctgcctcatcacagcgcctgtcactatgatcctgtcatcgcaacaggacgcagctttcgcttttgcctcattggcaatagttttctcctcctacatcactctggtggtcctgtttgttccgaaaatgcgacggctgattacgagaggggagtggcagagcgaggcccaggacacgatgaaaacaggcagctccactaataacaacgaggaggagaagtcacgactgttggagaaagagaatcgagagcttgagaagatcattgccgaaaaggaggagcgtgtatctgaactgcgccatcagctgcaatctcgtcagcagctgagatctcgaagacatccaccaactccacccgagcctagcggtgggctgccgcgaggacccccagagcctccagatcgcctgtcgtgcgatgggtccagagtgcatcttctatacaagtag

SEQ ID NO: 5632 - DNA, 1020 bp, Artificial Sequence
  Description of Artificial Sequence: Synthetic coding sequence
atggtctccaagtcccgctggaaactgctggcaatgctcgccttggtcttggttgtgatggtctggtattcaatttcacgggaggatcgctacatcgagctgttttactttccaatcccggagaagaaagaaccttgccttcaaggagaggccgaatcgaaggcgagcaagctgttcggtaagttatcgccactgtgctcgtactctcgggaccaacccattttcctcagactggaggattacttttgggtgaagaccccatctgcttatgagctaccgtacggaacgaaaggcagcgaggatctgttattaagagtcctcgccattacttcatcatcgattccaaagaatatccagtctcttcggtgtcggaggtgtgtagtcgtggggaacgggcatcgactgcgcaacagcagtcttggggacgcgatcaacaaatacgatgtggtgatccgtcttaacaatgctcccgttgcggggtatgagggcgacgtgggatccaagactacgatgagactgttttaccccgagtccgcacactttgaccccaaggtcgaaaacaacccagacaccctcctcgtgctcgtggcttttaaagccatggacttccattggatcgaaactattttgagcgacaaaaaacgcgtaagaaagggattttggaagcagcccccgctgatctgggacgtgaaccctaaacagattaggatcctgaacccttttttcatggagattgcagccgacaaactgttaagtctccccatgcagcagccaaggaagattaaacagaaacccactacaggactacttgcgattacccttgccttgcatctgtgcgatttagttcatatcgcagggtttgggtaccctgatgcctacaacaaaaagcagaccatccactattacgaacagatcacactgaaatcaatggctggaagtgggcacaatgtcagccaggaagccctggctatcaaacggatgctggagatgggcgctatcaaaaatcttacttctttctag

SEQ ID NO: 5633 - DNA, 1386 bp, Artificial Sequence
  Description of Artificial Sequence: Synthetic coding sequence
atgtccctggatatccagtccctggacatccaatgtgaggagctgagcgacgctcgctgggcagagctgctgcccttgctccagcagtgtcaggttgtgaggttggatgattgcgggctgaccgaggctcgatgtaaggatatctcttcagcactgagggtgaatcccgcactcgctgagcttaacttacggagcaacgagctaggcgatgttggtgtgcactgcgtgcttcagggactgcagacaccctcttgcaagatacagaaactgagtctgcaaaattgttgtctgaccggagccgggtgcggtgttctgtcgagcacacttagaacactgcctacactccaagagctacatttgagcgacaacctactaggagatgcaggtctccagttactctgcgagggcttattagaccctcagtgccgtcttgagaaactacagctggagtattgctccctgtcagctgcaagttgtgaacctttagcctccgtgctcagagccaaacctgatttcaaagagttgaccgtttccaataatgacatcaacgaagctggtgtgagagtactgtgccagggcctaaaggactccccctgtcaactggaggcactaaagcttgagtcatgtggggtcacttccgataattgtagagacctctgcggaatcgtcgcctctaaagcctccctcagagaattagccctcggttctaataagctgggagacgtgggcatggctgagctgtgtcctgggctcctgcatcctagttcacggctgcgaactctgtggatctgggagtgtggtataacggctaagggatgcggcgatctatgtagggttttacgcgccaaagagtccctcaaagagctgtcgctggcaggtaacgagctcggcgacgaaggtgcccggctactctgcgaaactctgctcgagccaggatgtcaactggagtcactttgggtcaaaagctgcagctttaccgctgcgtgctgttcccacttttctagcgtactggcgcaaaataggtttctcttagagctgcagatctcaaataatcgacttgaggatgccggcgtccgagagttatgccagggcctcggccaaccaggctccgtcctgcgcgtcctgtggctcgctgactgcgatgtgagcgattcctcatgctcctcgctcgccgcaactcttctagctaaccactcactgcgggaactggatctaagcaataactgtttgggggacgccgggatcttacagctggtggagtcggtgcgccagcccggatgcctcctcgaacagcttgtgctctatgacatctattggagcgaggagatggaagatcgcttgcaggcactcgaaaaagacaagccaagcttacgtgtgatctcatag

SEQ ID NO: 5634 - DNA, 1695 bp, Artificial Sequence
  Description of Artificial Sequence: Synthetic coding sequence
atggcacctaaaaagttatcctgccttagaagcctgttattgccattaagcttgacgcttctgttaccacaggctgatacacgcagttttgtcgtggatcgcggacacgatagattcctgctggatggggcaccatttagatacgtgagtggatcgcttcattactttcgggtccctcgagtcctgtgggcagacaggcttcttaagatgcgctggagtggcttaaatgctattcaattctatgtgccgtggaattatcacgaacctcagccgggggtgtacaacttcaacggaagccgcgaccttatcgccttccttaatgaagcagccttggctaatctcttggtgatccttaggccaggaccatatatatgtgcagagtgggaaatgggcggattgccgagttggcttctccgcaaaccagagatacacttacgcacgagcgatcctgccgacaatatgactaagatatttactctcctgaggaagtacgaaccccacggtccccttgttaactctgagtattacactggttggctagactattggggacagaaccacagcaccaggtctgtaagtgccgtgacaaaaggcttggaaaatatgctcaaactcggagcttccgttaatatgtacatgttccacggggggacaaacttcgggtactggaatggcgcagataagaaaggacgcttcttacctatcacaactagctacgactacgatgctccaatttctgaggctggcgatccaacacctaaacttttcgcactgcgtgatgtgatctcgaagttccaggaagtgcctttgggacctttgcctcccccaagtcctaaaatgatgctcgggccagtgacgctgcatttggtagggcacctcctggcatttctcgacttgctgtgcccacgcggtccaatccacagtatcctgccgatgaccttcgaagcagtgaagcaggatcacggatttatgctgtatcgcacatacatgacccataccattttcgagcctacccccttttgggttcccaataatggtgtacacgaccgagcctatgtcatggtggatggcgttttccaaggcgttgtcgagagaaacatgagggacaagctgtttctgaccggtaaactcggatctaaattagatatacttgtagagaacatgggccgcctttccttcggtagcaacagctcagacttcaaggggttgttgaagcctcctatcctgggacagaccatcttgacccaatggatgatgttcccccttaagatcgataacctggttaagtggtggtttccactgcagcttcctaagtggccctacccacaggcccccagcggccctacattctattccaagaccttccctatcctcggatccgtcggggacacattcctgtatcttcccgggtggacgaaaggacaggtgtggattaacggctttaatctgggccgctattggaccaagcagggcccccagcagacactctatgttccccgcttcctgctgtttcctagaggcgctttgaacaaaattactctgctggagctggaagacgttcctctacaaccccaggtgcagttcctggataagccaatacttaacagcacaagcactctgcacaggacccacattaactccctgtccgcagacacgttgtcagcttccgaaccaatggaactgtccgggcactag

SEQ ID NO: 5635 - DNA, 1317 bp, Artificial Sequence
  Description of Artificial Sequence: Synthetic coding sequence
atgatgtacgcacctgtagagttctcagaagcggaatttagtcgggcggagtatcagagaaagcagcagttttgggatagtgtgcgcctggctctctttacattggcgatcgttgctatcatcgggatcgctattggcatcgttactcacttcgtagtcgaggatgacaaatctttctactacctcgctagctttaaggttactaatattaaatacaaagagaactacggcatcagatccagtagagaatttattgaaagaagccatcagatcgaaaggatgatgagcaggatatttcgccactcatccgtaggaggacgctttatcaagagccacgttataaagctctcccctgacgagcagggcgtggacattctgatcgtcctaattttcagatatcctagcactgactccgcggaacaaataaagaagaagatcgagaaggcattataccagtctctcaaaactaaacagctgtcactgactatcaacaaaccttcattccgactgacccctatcgactctaaaaaaatgaggaacttgctaaatagtcgatgcggaatcagaatgacttctagcaacatgccgctcccagcatcaagctccacacagcggattgttcaggggagagagaccgcaatggagggcgaatggccgtggcaggcatctctgcaattgatcggttcaggccaccagtgtggcgcctcattaatctctaatacctggctgctgacagcagctcactgtttttggaaaaacaaggaccccacccagtggatcgccacttttggagcgacgatcactccgcccgctgtcaagagaaatgttcggaaaattattcttcacgaaaattaccacagggaaaccaatgaaaacgacatcgcccttgtccagctctccaccggcgtggagttttcgaatatcgttcagagggtgtgcctacccgactcgtccattaagctacccccaaagacaagcgtttttgtgaccggcttcgggtctattgtcgatgatgggccaatccaaaatacgctgcggcaagcccgcgttgaaactatttctactgacgtctgcaaccggaaagacgtctacgatgggctaatcactcccggcatgctgtgcgctggttttatggaggggaaaatcgatgcttgtaagggtgactccgggggtcccctggtgtatgataatcacgatatatggtacattgttggcattgtatcctggggccaaagttgcgctttacctaaaaagcctggggtgtacacacgtgtgaccaaatatcgggactggatcgcgagcaagactggaatgtag

SEQ ID NO: 5636 - DNA, 4392 bp, Artificial Sequence
  Description of Artificial Sequence: Synthetic coding sequence
atggaaccccgcctgttctgttggactacgctatttctgctcgcaggttggtgtctccctgggctcccttgcccatccaggtgtctgtgttttaaatcgacggtgcgatgtatgcatcttatgctggatcatattccacaggttccacagcagacaacggttctggatttgcggttcaaccgcatacgggaaatccccgggagcgccttcaagaagcttaagaacttgaatacattgttgcttaataataaccacatccggaagatctcacgaaacgcctttgaaggcctggaaaatttgctttacctgtacctgtataagaacgaaattcatgctttagacaaacagacgttcaaggggctaatatcattagagcacttgtatatacactttaaccagctcgaaatgctccagccggagacattcggtgatctgctcagactcgagagactgttcctgcacaataacaagctgagcaaaatccctgctggttctttcagcaacttggactccctgaaacgactgcgactcgattcaaacgccctcgtctgcgattgcgacttaatgtggttaggagagttactccagggtttcgcccagcacggacatacgcaagctgccgccacctgcgagtacccgcgccggctgcatggacgcgctgtggcatctgtaactgtcgaagagtttaattgccagtctcctagaatcacgtttgagcctcaggacgtggaagtgccatcgggcaatacagtgtacttcacatgtagggcggaagggaacccgaagccagagatcatatggatccataacaaccactccctcgatctagaggacgatactagattgaacgtctttgatgacggaacccttatgatccggaatacgagggaatcagatcaaggggtgtaccagtgcatggctagaaattctgctggcgaggctaagactcaaagtgcgatgctgaggtattcatcactgcccgctaaaccatcctttgtcattcaaccccaggacacagaagtgttaattgggacaagcactaccttagagtgtatggctacaggccaccctcacccgttaattacctggacccgggacaatggcttagaactcgacggatcccgccacgttgccactagcagcggcttgtatctccaaaatattactcagagggaccatgggagattcacgtgccacgccaataactcgcacggcacagttcaggctgcggcaaacattattgttcaggctcctccacagttcaccgtgacccctaaagaccaggttgtgctggaagaacacgcagtggaatggctatgtgaggctgacggcaacccaccccctgtaatagtgtggaccaagacaggaggccagctaccagtggagggccagcacacagtcctgagtagtgggacactccggatagaccgggcggctcagcatgatcaggggcagtatgagtgccaagccgtgagcagcctgggcgtcaaaaaggtgagcgttcagctgaccgtgaaacccaaagctctggcggtctttacgcagttgccgcaggacacaagcgtcgaggtaggaaagaacattaatataagctgccacgcccaaggtgaaccacagccaatcattacatggaacaaggaaggagtgcagattaccgaatctggtaagttccatgttgatgatgagggcacgctgactatttacgacgcaggatttccagatcaggggcgttatgagtgtgtggcgcgcaacagctttgggctggccgtgaccaatatgttcctaacagtaaccgctatacagggcaggcaggccggcgacgactttgttgaatccagcatcctagacgccgttcaaagggtagactccgcaattaattctactaggcgacatctcttcagccagaaacctcacacaagcagcgatctgctggctcagtttcactacccccgcgatccgctcattgtggaaatggctcgggcaggcgaaattttcgaacacaccctgcagcttattcgcgaacgtgtgaagcagggcctgacagtggacctggagggaaaggaatttaggtacaatgacctggtgtcccctcggtccctcagtctgatagccaacctcagtggttgtacggcccgaagaccattgcctaactgctccaaccggtgtttccacgcaaagtatagagcacacgacgggacctgcaataatctccagcaaccgacatggggggctgcattgaccgctttcgctcgccttttgcagccagcttacagggatggaattcgcgcccctcgaggcctgggcctgcccgtgggcagtaggcagccactacctccccctcgcctggtcgcaactgtttgggcccgggcagccgctgtgactcctgaccatagttacaccaggatgcttatgcattgggggtggtttctggaacacgatctcgatcacacagttccagccctctccacagcccgtttcagtgacggaagaccttgtagttccgtctgcacgaacgaccctccatgctttcctatgaacacccgtcacgctgatccacgcggaacacacgcaccctgcatgttgttcgccaggtcctcaccagcgtgtgcctcaggcagaccctccgcaaccgtggattccgtctacgcccgcgagcagataaatcagcagaccgcatatatcgacggcagcaatgtctacggcagttccgaacgcgaaagccaggctctccgcgatccaagcgtgccgcgtggcctgctgaaaacaggctttccctggcccccttcagggaaaccactccttccgttctctacagggcctcccacagaatgcgcccgtcaggagcaagagtccccttgctttctcgctggtgaccatcgggcgaacgagcacctcgccttggccgctatgcatacactttggttccgagaacataatcggatggcaacggaattgagcgcccttaacccccactgggaaggcaacacagtctaccaagaggcacggaaaattgtaggcgcagaactccagcacatcacatacagtcattggctgcccaaggtactgggagacccaggcacacggatgttacgggggtacagggggtataaccccaacgtcaacgctggcattatcaattcatttgcaacagctgcgttccgctttggccatacgctcattaatccgattctctatagactgaacgccaccttaggagaaattagtgagggacacctgccattccacaaagctctgttctctccatctcgaatcattaaagaaggtgggattgacccagtacttcggggactatttggagtggcggccaagtggagagctccatcatacctcctaagcccggagcttacgcagcggctcttttcagccgcctattcggcagcagtcgatagcgccgccaccatcatccaacgaggtcgcgaccacggcatcccaccctacgtagatttccgcgttttttgtaacctgacctcagtcaagaatttcgaggatctgcagaatgagatcaaggattccgaaatacggcagaagctgaggaagctgtacggctcccccggggacattgatctttggccagctctgatggtcgaggacttgatcccgggtactcgagtgggccctaccctgatgtgtctgttcgtgacacagttccagaggctgcgagatggagatcggttctggtacgagaaccccggcgtgttcaccccggcccagttaacgcagctgaaacaggcatctctctcaagggtgctgtgtgacaacggcgatagcatacaacaggtgcaggccgatgtgtttgtgaaagccgaataccctcaggactacctcaactgcagcgaaatacccaaggtggatctgcgggtgtggcaagactgttgtgccgactgtcgtagccgcggccagttcagggcggtcacacaggagtcacaaaaaaagcgctctgcccagtactcataccctgtggataaggacatggaactgagccacctgaggtcgcgccagcaggacaaaatttatgtgggggaagacgctagaaacgtcacagtccttgccaaaacgaagttctcccaggacttttccacatttgcggctgagatccaggagaccatcactgccctccgagagcagataaataaactagaagctagactgagacaggccgggtgcactgatgtgagaggggtgcctaggaaggctgaggagcgctggatgaaggaagattgtacacactgtatatgcgagagtggtcaggtgacctgcgtcgtcgaaatttgccctccagctccctgccccagtcccgagctcgtgaaggggacatgctgtcccgtctgtcgggacagaggcatgccctcagatagccccgagaaacgctag

SEQ ID NO: 5637 - DNA, 1206 bp, Artificial Sequence
  Description of Artificial Sequence: Synthetic coding sequence
atgggccttaaggctctctgcctcgggctgctctgtgtcctgttcgtcagccacttttacacccctatgccggataacattgaggagagttggaaaattatggctctggatgccatcgccaagacttgcacattcactgccatgtgcttcgagaatatgagaattatgagatacgaggagtttatatcgatgatattccgcctggactacacccagccactgtcagacgagtacattacagtcacagatacaaccttcgtcgatattcccgtgcggctttacctgcccaagcgtaaatctgagactcgccgtcgagccgtcatatattttcacggagggggcttctgtttcgggtcttccaagcaacgcgcattcgattttctcaatcggtggacagccaataccctggatgctgtagtggtgggtgtggattaccggcttgctccgcagcatcactttcctgctcagttcgaggacgggcttgccgccgttaaattcttcttgctggaaaagattctgaccaaatacggcgtcgacccaacccggatctgtatagccggagattccagtggtggcaatctcgccaccgctgtcacccagcaagtgcagaacgacgctgaaatcaagcacaagattaaaatgcaagtcctactgtacccgggtctgcagatcaccgatagttacctgccttcccaccgagaaaacgaacacggcatcgtactcacaagagacgtcgctataaagttggtatccttgtactttacaaaagatgaggccctgccatgggccatgcgcagaaatcagcatatgccactggaaagtcggcatttgtttaaattcgtcaactggagtatccttctgcccgagaaataccgtaaagactacgtatatactgagccaattctgggaggcctgagttattcactgcctggccttacagatagcagagccttgcctctcctggcaaatgactcccagctgcaaaatctaccgcttacttatatcctgacatgtcagcacgatcttctcagagacgacggcctcatgtatgttaccaggctgcgcaatgtgggcgtgcaagtggtccatgagcatatcgaagatggcattcatggcgccttatcctttatgacatcccccttttatctgaggctagggctgcgtatacgtgacatgtatgttagctggctcgataagaatctgtag

SEQ ID NO: 5638 - DNA, 264 bp, Artificial Sequence
  Description of Artificial Sequence: Synthetic coding sequence
atggtgtccctgatgaagctctggattccgatgcttatgacttttttctgtacggtgctcctcagcgtccttggtgagatgcgaaagaagcggtatgacaggaaggaactgctcctcgaggaatgctggggcaaaccaaatgtaaaagagtgcacgaataaatgctccaaggccttccggtgtaaggacaaaaattatacatgttgttggacatattgcggcaacatctgctggattaatgtagaaacttctggggattattag

SEQ ID NO: 5639 - DNA, 813 bp, Artificial Sequence
  Description of Artificial Sequence: Synthetic coding sequence
atgcgtggccagggacgcaaagaatccctgagcgatagtcgggacctggacggaagctacgatcagctcaccggacaccccccgggtcccacaaagaaagcactgaagcagcgctttcttaagttgttaccctgctgtgggcctcaggcacttccgtctgtgtctgagactctcgccgcacccgcttcactacgtcctcatagaccacgcctccttgaccctgactccgtggatgacgagttcgaattgtctactgtttgtcacagacccgaagggctggagcagctccaggagcagactaagttcacccggaaggagctccaggtcctataccggggtttcaagaacgagtgcccatcagggattgttaacgaggagaacttcaagcaaatatattcacagtttttccctcagggtgattcctccacatatgccaccttcttatttaatgcctttgacacaaaccacgacgggagcgtgtccttcgaggatttcgtcgccggtctgagcgttattctcagggggactgtcgacgaccgcttgaactgggccttcaatctgtacgatctgaacaaagacgggtgcatcacaaaggaagagatgctggatatcatgaaatccatatatgacatgatgggaaagtatacttaccctgccctgagggaagaagctccaagggaacacgtagagtcgttctttcaaaagatggacagaaataaagacggcgttgtgaccatcgaggaattcatcgagtcatgtcagaaagatgagaatattatgcgatccatgcagcttttcgacaatgttatctag

SEQ ID NO: 5640 - DNA, 819 bp, Artificial Sequence
  Description of Artificial Sequence: Synthetic coding sequence
atgcacttacgtttgatctcttggctgttcattatacttaacttcatggagtatattggcagccagaacgcctcaaggggaaggcggcagaggcggatgcacccaaacgtgtcccagggatgccagggtgggtgcgccacttgcagcgactacaacggatgtctctcatgcaaaccgagactattcttcgcactagaaagaatcggcatgaaacagatcggtgtgtgcttatcatcatgccccagtggttattacgggacacgatacccagatattaacaagtgcaccaagtgtaaggctgattgtgacacttgctttaacaagaatttctgtacaaaatgtaaatctggcttctatctccacctcggaaagtgtttagacaattgccctgaagggctcgaggcaaataatcacacaatggaatgcgtctccatcgttcattgcgaagtcagcgaatggaacccttggtcaccttgcacaaagaaagggaagacttgcggattcaagaggggcaccgaaaccagggtgagggaaataatccagcacccgagtgccaaaggaaacttgtgcccgcctaccaacgagacacgcaaatgcactgtgcagagaaagaagtgtcagaagggggaaaggggcaagaaaggaagagagagaaagcgcaaaaagcccaacaagggagagagtaaggaggcaattccagattcgaagagcctggaaagttccaaagaaattccggaacagagagaaaacaagcagcagcagaaaaaacgaaaagtgcaggacaaacagaagtcagtgtctgtgagcacagtacactag

SEQ ID NO: 5641 - DNA, 294 bp, Artificial Sequence
  Description of Artificial Sequence: Synthetic coding sequence
atggccaaaagcttcccagtattcagccttctctccttcattcttatacacctcgttctgagctctgtgtccgggccccgacactggtggcctcctcgagggatcatcaaggtgaagtgtccatacgaaaaggtgaacctttcatggtacaacgggactgtcaacccatgccctggtctgtatcagcccatctgcggaacaaacttcatcacttatgataatccatgtattctgtgtgtggagtcgttaaagtctcacggacgtataaggttttatcacgatgggaaatgctag

SEQ ID NO: 5642 - DNA, 726 bp, Artificial Sequence
  Description of Artificial Sequence: Synthetic coding sequence
atgtggacggttcggaccgagggtggacatttcccccttcactctcctacattcagttggcggaatgtggcctttctcctcctcttgtctttagctctggaatggacatccgccatgctgacaaagaaaataaagcataagcccggcctctgtccgaaggaaagactcacttgcaccaccgagctaccagatagttgcaatactgattttgattgcaaggagtaccaaaagtgctgtttcttcgcctgtcagaagaagtgcatggatccctttcaagaaccatgcatgctgcccgttcgccacgggaactgcaaccatgaagcacaaagatggcactttgattttaaaaactatagatgtacacccttcaagtaccgcggctgcgagggcaatgccaacaacttcctcaacgaggacgcatgtcgcactgcctgcatgttgatcgtgaaagacgggcagtgtcccttgtttccctttactgagagaaaggaatgcccaccgagttgtcacagcgacatagactgtccacagacagataagtgctgcgaaagtagatgtggattcgtgtgcgccagggcctggacagttaagaagggcttttgcccaagaaaacctcttttgtgcaccaaaatcgataagcccaaatgtctgcaagatgaagagtgccctcttgtagaaaaatgttgctcccactgtggcctgaagtgcatggatccgcggaggtag

SEQ ID NO: 5643 - DNA, 1827 bp, Artificial Sequence
  Description of Artificial Sequence: Synthetic coding sequence
atggcacgagcccgggcgggagccttacttgccctgtgggtcctaggcgcagcagcacatcctcagtgcttggacttccgcccaccttttcgtccaactcagcccctgagactttgtgctcagtatagtgacttcggatgttgtgatgagggtcgcgatgccgagctcacacgacgattttgggctctggcgtcgcgggtggatgccgctgaatgggctgcttgtgccggttatgcaagggacctgctgtgccaagaatgctctccctatgccgctcacctgtacgatgctgaggatccatttactccactgcgcaccgtgcctggtttatgtcaggattattgcctggacatgtggcacaaatgtcgcggactgtttcggcacctctcaacggaccaggaactttgggccttggaaggtaacctcgccagattttgtcgctacctttccctggatgacaccgactattgctttccctacctgctcgttaacaaaaatctgaactctaatctgggacacgtcgtcgccgatgccaaaggctgcctccagttgtgcttagaagaagtggctaacggcttgagaaaccccgtggccatggtgcacgcccgagacggcacccatcgtttttttgtcgcggagcaagtgggtctcgtgtgggcctaccttccagacagatcgcgacttggaaaacccttcctgaacataagccgggtagtgctcacctcaccttgggagggcgacgaaaggggctttttggggatcgcatttcatccatctttccagcataacaggcggctatacgtatactacagcgtcggcatccgctcatctgaatggatccgcatctctgaatttcgcgtttcagaggacgatgaaaacgcagtagaccacagctctgaacgcatcatactggaggtgaaggaaccagcctctaatcataatgggggacagctgcttttcggagatgacggctatctgtatatcttcacgggagacggcggaatggctggggacccttttggaacctttggcaacgcccagaacaagagtgccttgttagggaaagtacttaggattgatgtggatagaaaagagaggggcctcccctacgggatcccgcctgacaacccgtttgttggagaccccgctgctcagcctgaggtgtacgctttgggtgtcagaaacatgtggagatgctcattcgaccgtggagatccttcctccggcacaggcagagggcggctattttgtggcgacgtgggccaaaataagtttgaggaggtggacgtagtagagaggggaggcaactatgggtggagggcccgcgagggatttgagtgttatgataggtcgctgtgtgcaaatacaagcttgaacgacctactacctatttttgcctatccacacaccgtgggtaaaagcgtgaccggtggttacgtctatcggggatgcgaatacccgaatctgaacggcctctacatattcggagatttcatgtcaggtcggctgatgtcgcttcaggaaaaccctggcaccggccagtggcagtattcagaaatttgcatgggacatgggcaaacttgcgagttccccggtctcatcaataactattacccctatattatttcttttggtgaggacgaggccggcgagttgtacttcatgtccacaggagaacccagcgctaccgccccacgaggtgtggtatataaaattatagatgcttcctcctgcaaggcgcggtcagccatgcctgggtacgttccagcaccctcagtctgctcgtcactgaccagccagcccttcattttacaatggtggaagtag

SEQ ID NO: 5644 - DNA, 351 bp, Artificial Sequence
  Description of Artificial Sequence: Synthetic coding sequence
atggcacctcctagcgttccactggtgctcttgctcgtgttactcctctccctagccgaaacccccgcaagcgctccagcacatcggggccgtgggggatggaccctgaattctgcagggtacctcctcgggcctgttctccatcttccccagatgggtgatcaggacggcaagagggagacagcattagagattctcgatctatggaaagctatcgatggacttccatattcgcacccacctcaacctagcaaacgtaacgtcatggaaacctttgctaaacccgagatcggtgatctgggtatgctgtcaatgaaaatccctaaggaggaagacgtactcaaatcttag

SEQ ID NO: 5645 - DNA, 3618 bp, Artificial Sequence
  Description of Artificial Sequence: Synthetic coding sequence
atgagaaagccccgaagaaagagcaggcagaacgccgagggacgcagatctcctagtccctacagcttgaaatgcagtcccacccgggaaaccctcacgtacgcgcaggctcagaggattgtggaagtagatattgatgggaggttacataggattagtatctatgatccgctgaagatcatcaccgaagatgagctcacagctcaggatataactgaatgcaattctaataaagaaaactctgaacagccgcaattccccggaaaatctaaaaagccttctagcaagggcaaaaagaaggagagttgcagcaaacacgctagtgggacgagttttcacctcccccagccttcctttagaatggtagactccggaatacaacctgaggcccctccactgccagccgcttactaccggtatatcgaaaagccaccggaggatctggacgcagaagtagaatatgacatggacgaagaggaccttgcttggttagacatggttaacgagaagagacgcgtcgatggccattccctggtaagcgctgatacattcgaacttctggtggataggctagagaaagagagttacctggagagccgttcttccggagcacagcagtccctgattgatgaggacgccttctgctgtgtatgcttagatgacgagtgtcataattccaacgtgatcctattctgcgacatatgcaatctagcggtccaccaggagtgctatggagtgccctatatacccgaaggccaatggctgtgccggtgttgcctccagagccctagccgtcccgtggactgtatactgtgccccaataagggcggggcttttaagcagacctctgacggtcattgggcccacgtggtgtgtgcaatctggattccggaggtttgcttcgccaacaccgtgttcttggaaccaatcgaagggattgacaacatccccccagcacggtggaagctaacctgttacatctgtaaacagaaggggctaggagctgccatacagtgtcacaaggtcaactgctacactgctttccatgtgacctgtgctcagcgagctgggctgttcatgaaaattgagccgatgcgggagacctctttgaatgggaccatattcaccgtgcgtaagacagcctactgcgaggcccactccccgcccggcgccgctacagccagacggaagggggatagtcctcgcagtatctctgagaccggcgatgaagaggggttgaaagaaggcgatggagaagaggaggaggaggaagaagtagaagaggaagagcaggaggcccagggaggagtctcagggagcctcaagggcgtccctaagaaatctaaaatgagtttgaaacagaaaatcaaaaaagagcccgaggaggcaggccaagacactcccagcaccttgcctatgttggcggtgcctcaaatccctagctataggctgaataaaatctgcagcggactgagtttccaaaggaaaaaccaattcatgcagcgtctgcataactattggctgctcaagagacaggctcggaacggagtccccttgattaggcgtctacactcgcacctacagagtcagaggaatgcggaacagcgcgagcaggacgagaagaccagcgcggtcaaggaagagctcaaatactggcagaagctaaggcacgacctggagcgcgctagactcctcatcgagctgattcggaagagggaaaaactgaaaagagaacaggtcaaggttcagcaggctgctatggaattggagctgatgccgttcaacgtgctcttgaggactacccttgacctgctgcaagaaaaagaccctgcacacattttcgccgagcctgtgaatctgagcgaggttccagattacctggagttcatcagcaaaccaatggacttctcaaccatgcgaagaaagctggaatctcacttgtataggaccctggaagaatttgaagaagacttcaacctcatcgtcactaactgtatgaagtataacgcaaaggatactatattccatcgggccgccgtccgcctccgcgatctgggcggggctatcctgcgtcatgcccgcagacaggccgaaaatatcgggtatgacccagagagaggcacccatttacccgaatctcctaaattagaagacttctaccgcttcagctgggaagatgtggacaatattctgatcccggaaaacagagcccacttgtcaccggaagtgcaactcaaggagctcctggaaaagctggacttggtgtctgcgatgcgctcctctggggcccggacccggagggtgcggctgttgagacgtgagatcaacgctctgcgccagaaactggctcagcctccgccgccacagcctccttctctgaataagaccgtgagtaacggagagttgccagctggacctcaaggagacgcggccgtcctcgagcaggccctgcaggaagaacctgaggatgatggcgatagggacgactccaagctgcccccccctcctactttggagcctactggaccagcccccagtctgtctgagcaggagagccctcctgaaccccccacgctgaaacctattaatgacagcaagccgccttcccgcttcctaaagcctcggaaggttgaagaagacgaattgctcgagaagtctcctctgcaactcggcaacgaacctctgcagcgcctcctttccgataacggcatcaaccgcctgtcactgatggcccccgatactccagccggaacacccctgagcggtgtaggcagacgcacaagcgttttgtttaaaaaggccaagaatggagtaaaactccagagatcgccagatcgcgttctggagaatggtgaggatcatggcgtggccggctcacccgccagtcctgctagcatcgaggaggagagacacagccggaaaagaccaagaagtagatcttgctccgagagcgaaggtgaaaggagtccacagcaggaggaggaaacagggatgactaatggctttggcaaacatactgagagcgggtcagattcagagtgttcactcggtcttagcggcgggcttgcgttcgaagcctgttctgggctcaccccaccaaagcgatcgcgaggcaagcccgcgctaagcagggtcccctttctggagggcgtgaatggggactccgactacaatggctccgggagaagcctgttattgccttttgaggataggggagacctcgagccgcttgagctggtgtgggcaaaatgccgagggtatccgagctaccccgccctgattatcgaccccaagatgccacgagaaggattgttacacaacggagtacccatacccgtcccacctttagatgtgttgaagctgggagaacaaaagcaggccgaggcaggtgagaaactttttttggtcttgttctttgacaataaacggacatggcagtggctaccacgcgacaaggtgcttccactgggtgtggaggataccgtcgataaactaaaaatgctcgaagggcgcaagaccagcattaggaagtctgtgcaagtggcctacgatagggccatgatacacctgtctagggtccgaggccctcatagctttgtcacctcttcatatctctag

SEQ ID NO: 5646 - DNA, 1977 bp, Artificial Sequence
  Description of Artificial Sequence: Synthetic coding sequence
atgttcgtgagttatttgattctgaccctgctgcacgtgcaaaccgccgttctggctcgccccggcggagaatctataggatgtgacgactacttgggctccgataaggtggtggacaagtgcggtgtctgcggcggggacaacaccggctgccaggtggtgagcggtgtattcaaacacgcgctgacctctcttggctatcacagagttgttgaaattcctgagggggccaccaaaatcaacatcactgagatgtacaaaagtaacaattacctggcactgcgctcacggtctggccggtcaattataaacggaaattgggcaattgacagaccgggaaaatatgaagggggaggcaccatgtttacatacaagaggccgaatgagattagtagtacggctggagaatcatttttggccgagggccctacgaacgagattttagacgtgtacatgatccatcaacaacctaaccccggtgtgcattatgagtacgtgattatgggaaccaacgccatttcaccacaggtgcccccccatcggagacctggggagcctttcaacggccaaatggtgaccgagggacgctcacaggaagaaggcgagcaaaaaggacgaaacgaagagaaagaggacctgcgaggggaggcaccggaaatgttcacatctgagagtgcccagaccttccctgtgcggcacccagatcgcttcagccctcatagacccgataatttggtaccccccgcccctcagcctccaaggagatctagggatcacaactggaagcagctgggcaccaccgaatgtagtacaacctgtgggaagggcagccagtaccccatctttagatgtgtccatcgctcgactcacgaagaagcccccgaaagctattgtgactcctctatgaagcccactccggaggaggaaccttgcaacatatttccctgtccagccttctgggacataggcgaatggtcagagtgctctaaaacctgcggcctcggaatgcaacacaggcaggtcctctgcagacaagtttatgctaacaggagtttgactgtgcagccgtaccggtgccagcatctggagaaaccagagactacatcaacgtgtcagctcaagatctgttcagagtggcagatcaggaccgattggacatcatgctccgttccctgcggagtgggccagagaactcgagacgttaaatgtgtgtcaaatatcggcgatgtagtggacgatgaggagtgtaacatgaaattgcgacctaatgacatcgagaattgtgacatggggccctgcgcgaagtcatggttcctcacagaatggtccgagagatgctccgccgagtgtggggccggggtccgaactcgaagtgtcgtgtgtatgacaaatcacgtgtcctctttgcctttggaagggtgcgggaacaaccggcccgccgaagccaccccctgcgacaatgggccctgcacagggaaagtggagtggtttgccggttcctggtcccaatgctccatagaatgcggcagcggcacacagcagcgtgaagtgatttgtgtccgaaaaaacgctgacacctttgaggtgcttgacccttctgaatgctccttcctcgaaaagcccccgtcacagcagagctgccatttgaagccttgtggggcgaagtggttctcaacagagtggagcatgtgtagcaaatcttgccagggcggatttagggtgcgtgaggtccgttgcctaagcgacgatatgaccctgagtaacctgtgtgatccccagttgaagccagaggagagagagagctgcaatccccaagactgcgtgccagaagtagatgagaactgcaaggacaaatattacaattgcaacgtggtcgtccaggctcggctgtgtgtctacaactattacaaaaccgcttgttgtgcttcttgcaccagggtggctaaccggcagacgggatttctgggtagcaggtag

SEQ ID NO: 5647 - DNA, 708 bp, Artificial Sequence
  Description of Artificial Sequence: Synthetic coding sequence
atgcggcctctcgccggtgggctgctcaaggtcgtcttcgtcgtgttcgccagcttgtgtgcctggtatagtggctatcttctcgcagaattaattcctgacgcccccctgagctctgccgcctactccattcgcagcatcggcgagcgaccggtgctgaaggcaccagtcccaaagcggcagaagtgcgatcattggaccccctgccctagtgatacttatgcctaccgcttattatcaggcggaggcaggtccaagtatgcaaagatctgttttgaggacaacttgttgatgggggaacagctcgggaacgttgccagagggatcaacatagctattgtaaactatgtcactggcaatgtaacagccactaggtgttttgacatgtatgaaggtgacaacagtggacctatgaccaaatttatccagtctgcagccccgaaaagtctgcttttcatggtaacctacgacgacggctcaactcgattaaataatgatgccaagaacgcaatcgaggccctcggtagcaaggagatcagaaacatgaagtttcgcagttcctgggtgttcattgccgcaaagggcctcgaacttcctagcgaaatccagagagagaagattaaccattccgacgccaagaacaatcgctactccggatggccagcagagattcagatcgaggggtgtatcccgaaggaaaggtcttag

SEQ ID NO: 5648 - DNA, 759 bp, Artificial Sequence
  Description of Artificial Sequence: Synthetic coding sequence
atgaggggacaaggacggaaagagtctctcagcgattctcgagacttggatggatcatacgaccagctgacaggacatcctcctgggcctaccaaaaaagcactgaaacaaagattcctgaaattgttgccttgctgtggtcctcaggccctccccagcgtgtccgagaactcagttgatgatgaattcgaactgtctaccgtctgccacaggccggagggcctcgaacagctacaagagcagaccaaatttacaaggaaggagctgcaagtactctatcgggggttcaaaaatgagtgcccaagcggcatagtcaacgaggagaattttaaacagatttattctcagttttttcctcagggagacagtagcacttacgccacgtttctgttcaacgcctttgacaccaatcacgacggttccgtgagcttcgaagatttcgtcgcaggtttaagtgtgattcttagaggaaccgtggatgataggctgaattgggcctttaacctgtatgatctgaacaaagatggctgcataaccaaagaagagatgttggatatcatgaagtccatctacgacatgatgggcaagtacacatatcccgccctccgcgaagaggcaccccgcgaacatgttgaatcatttttccaaaagatggacagaaacaaagacggggtcgttactatcgaagaattcatcgaatcttgtcagaaagacgagaatataatgcgatccatgcagttgttcgataatgtcatctag

SEQ ID NO: 5649 - DNA, 312 bp, Artificial Sequence
  Description of Artificial Sequence: Synthetic coding sequence
atgtctggtagaggcaagggaggaaaggggctgggaaagggcggcgccaagcgtcataggaaagtcctgcgggataacatacagggcatcacaaagcctgctatacggagattagctcgccgggggggcgtgaaacggattagtgggctgatttacgaagagacgaggggcgtgttgaaggtgttcttagagaacgtgatcagggatgcggtgacatacacagagcacgcaaagcgaaagaccgtcacagccatggatgtcgtgtatgcgttgaagcggcagggacgcacattatatggctttggtgggtag

SEQ ID NO: 5650 - DNA, 3120 bp, Artificial Sequence
  Description of Artificial Sequence: Synthetic coding sequence
atggaggtgactgcagtagcgacccagggtgggtacggctcctctgactgggtgacatcatacctgcttatgtttagcgacggggggcggaattggaaacaatataggcgcgaagaaagtatctggggattcccaggtaacaccaatgctgactccgtggtgcactatcgcctgcaaccgccgttcgaagcacgcttcttgcggtttctaccgctggcctggaaccctagaggccgcattgggatgcgcattgaagtttacggctgcgcttacaaatccgaagttgtttatttcgacggtcagagtgctctcctgtacaggttggataagaaacctctgaagcctatcagagatgttatcagtctcaagtttaaggccatgcaatctaacggtatcctcctacaccgagagggacagcacggaaaccatatcacactggagctgatcaaaggaaagctggtattctttttgaacagcgggaatgccaagctgccatctactattgcacctgttaccttgaccctaggctccctactggacgaccaacactggcattctgtgctgatcgaattactcgacacacaggtgaactttacagtagacaagcacacacatcactttcaggctaagggcgattcaagctacctcgacctgaacttcgaaatcagtttcggcggaatcccaacacctggtagatcaagagcattccgccggaagtcttttcacggctgcttggaaaacctgtattacaacggggtggacgtaacagaactcgctaagaaacataagccgcagattctaatgatgggcaatgtaagtttctcttgccctcagccgcagacagtcccagtcaccttcctgagttcccggagttaccttgccttgcctggcaacagcggagaggataaggtgagcgtaacgtttcagttccgcacttggaatagggcaggccacctgcttttcggtgagctcagaagaggctccgggtcctttgtgcttttcctcaaggatggaaagctaaagctcagccttttccaacctgggcagagccctcgaaacgtgacggctggggcgggcctgaacgatggccagtggcatagcgtaagcttttccgctaagtggagtcacatgaacgtggtggttgatgatgacactgcagttcagcccttagtcgcagtgctgatcgatagcggagacacatattattttggcgggtgcctggataacagttctgggtctggctgcaagtcaccactcggtggattccaggggtgtctcagactaatcaccatcggggacaaggccgtcgaccccatcctagtgcaacaaggggcattaggaagtttccgagaccttcaaattgattcatgcggtataacggatcgctgcctgcctagttattgcgaacacggcggagagtgtagccaaagttgggacacctttagctgtgattgtctgggaaccgggtatacaggagaaacatgtcactcaagcttgtacgagcagagctgcgaggcacacaagcaccggggaaaccccagcggtttgtattatatagatgcggatggctctggcccgcttggaccttttctggtttattgtaacatgactgctgacgcagcttggactgttgttcaacacggaggtcctgacgctgtgactttaagaggcgctccaagcggacacccaagatcagcagtgagcttcgcatatgctgccggagcaggacagctacgttccgcagtgaacctggccgaacggtgcgagcagcgcctggccctgcggtgcggaactgcacggcgtcccgattctcgggacgggactcctctgtcctggtgggtgggccggaccaacgagacccacacgtcttggggcggcagcctcccagacgcccagaagtgcacttgcgggctcgaggggaactgcatagactcccagtattattgtaattgtgatgccggacggaacgagtggacgagtgataccatcgtgctctcccagaaagaacatttgcccgtgactcagatcgtgatgaccgatgctggtcggcctcattccgaagccgcatacacattgggaccactgctctgccggggggaccagtcattttggaactccgcaagcttcaacaccgaaactagctacctccacttcccagcctttcatggggagttaacagctgacgtgtgctttttttttaaaactaccgtgagttccggagtgttcatggagaacctcggcattaccgactttattcggatagagcttcgagcaccaaccgaagtgacgttcagttttgacgtcggaaatggaccttgcgaagtgacagtgcaatctcctaccccatttaacgacaatcagtggcaccacgtccgagcagaaaggaacgtcaagggcgcatcccttcaggtggaccagctgccacagaaaatgcagcccgcccccgcagatggccatgtcaggctgcaactgaatagtcagctgtttattggaggaaccgccacaagacagagaggttttctaggttgcatccgtagcctgcagttgaacggcgtggccctggacctggaagagcgagccactgtcactcccggcgtcgagcccggatgcgcaggccactgctctacctacggtcatctttgcagaaacggagggagatgcagggagaaacggcgaggggtgacctgcgactgcgcgtttagtgcgtatgacggccccttctgtagcaacgagatctccgcctattttgccaccggcagttctatgacataccactttcaggaacattatacacttagtgagaattcatcttctctggttagtagcttgcaccgggatgttacgctgactcgcgagatgataacattgtccttccggacgaccaggaccccaagcttgctcttatatgtgtctagtttctatgaggagtacctgtctgtgatactggcgaataacggcagtctgcagatccgctacaagttggataggcatcagaatcccgatgcctttacctttgacttcaagaacatggcggacggccagctacatcaggtgaagataaatagggaagaggccgtagttatggttgaggtgatcccgcagatgcagaagagcaattag

SEQ ID NO: 5651 - DNA, 1257 bp, Artificial Sequence
  Description of Artificial Sequence: Synthetic coding sequence
atgcgaagcctccttctgctgtctgctttctgtctgttggaagcagcactcgccgctgaggtcaaaaagccagcagctgcagcagctcccggaaccgccgagaaactcagtccaaaggccgcaacactggccgagcggtctgcgggtttagccttttcgctgtatcaggccatggccaaagaccaggcagtggagaacatcttggtatcaccagtagtggtggcctctagcctcggcctcgtgtcactgggtggcaaagctacgacggctagccaggctaaggcggtgctgagtgccgaacagctccgcgatgaggaagtgcatgccggcttgggcgagttgctcaggagcctgagtaacagcaccgcgagaaatgttacttggaaactcggaagcagactgtacggcccctccagcgtgtcattcgccgacgactttgtaaggtcctccaaacaacactataactgcgagcattcaaagattaatttcagagacaagcgctcagctctgcaaagcataaatgagtgggctgcgcagacaaccgacggaaagctgcccgaagtgaccaaggatgtcgagcgcactgacggagcactgctggttaacgccatgttctttaagccacactgggacgaaaagttccatcataaaatggtggataatcggggcttcatggtgactaggtcttacacagtgggggttatgatgatgcatcggaccggtctctacaattactatgacgacgaaaaagagaagcttcagatcgttgaaatgcccctggcccataagctgagcagcctgatcatactgatgcctcaccatgtggagccccttgagcggcttgaaaaactcttgaccaaagaacagcttaagatctggatggggaaaatgcaaaagaaggccgtggccattagtttaccaaagggcgtcgtagaggttacccatgatcttcagaagcatctggcaggattgggcttaacagaggctattgacaaaaataaagctgacctctccagaatgtcaggcaagaaggatctgtatctagccagcgtgttccatgctaccgcctttgagctggatactgatggaaatccatttgatcaggatatttatgggagagaggagctcagaagcccaaagctattttatgccgatcaccctttcattttcctcgtcagagacactcaatctggcagcctgttattcataggccggcttgtccgcccaaaaggtgacaagatgcgggacgagctgtag

SEQ ID NO: 5652 - DNA, 378 bp, Artificial Sequence
  Description of Artificial Sequence: Synthetic coding sequence
atgcagctgcttaaggcactctgggccctggccggcgctgccctgtgttgtttcctagtcctggtgatacatgcccagttcctgaaggaagggcagttggcagcgggcacctgcgagatcgtgactttagaccgcgactcctcacagcctcgacgtacaatcgctcgccagacagcacgttgcgcatgcaggaaaggacagatcgctgggacgacaagggccagacctgcatgcgtcgacgccagaatcataaaaaccaagcagtggtgcgacatgctgccttgtctggaaggagaaggctgtgatctgctgattaatcggagcggttggacctgtacgcagccggggggccggattaaaacaactactgtttcatag

SEQ ID NO: 5653 - DNA, 5859 bp, Artificial Sequence
  Description of Artificial Sequence: Synthetic coding sequence
atgccggctctgggacccgctctgctgcaggctctgtgggccggctgggttctcactctacagcctctgccacctactgcattcactcccaacggaacttacctacaacatctggcacgcgaccctacttcagggaccctgtaccttggagcaactaatttcctctttcaactgagtcccggtctgcagctagaggctactgtgtcaacagggcctgttcttgacagcagggactgcttaccgccagttatgccagacgagtgtccccaggcacaaccgacaaataaccccaatcagctgcttttggtatcccctggggcgttggtcgtgtgcggatccgtgcatcaaggcgtatgcgagcagcgaaggttgggtcagctagagcagctgctgctaaggccagagaggccaggagacacccagtacgtggccgcaaatgatcccgccgtatcgaccgtggggcttgtggctcagggattagcgggagaacccctactttttgtgggtaggggatatacgtcccgaggagtaggcggcgggatcccccccatcaccactcgagcactttggcctcccgaccctcaagcggcattttcttacgaggagaccgctaagttggccgtcgggcgcttgtctgagtattctcaccatttcgtgtcagccttcgcccgtggcgcatccgcctacttcctctttctgaggcgggacctccaggcacagagccgggcctttcgggcctatgtaagtcgtgtctgtctgagagatcagcattattacagctatgtagaacttcctctagcatgcgagggtggccgatatgggttaatccaagctgccgctgtggccacgtcccgcgaagtggcgcatggtgaagtcctgttcgccgccttctcatcagcagcgcccccaaccgtagggaggccaccctcagccgcagcgggcgcctccggcgcatcggcgctatgtgcctttcctctggatgaggtcgatcgcctagccaacagaacccgtgacgcatgctacacacgggaggggagggcagaagacggcacagaagtggcatacatagaatacgacgttaatagcgactgtgcacagctacctgtagacacactggatgcctatccgtgtggaagcgaccacacccctagtccgatggcatcaagagtcccgctcgaagctactccgatcttagagtggcccggcattcagttgaccgctgtggcagttactatggaagatgggcacaccatcgccttccttggcgacagtcaggggcagctccacagggtgtacttgggtccaggctctgacgggcatccttattccacgcagagcattcaacagggaagcgcagtgtccagagacctgacatttgacggcacctttgaacacctgtatgtgatgactcagtccacattattaaaggtgcctgtggctagctgtgcacagcacctggactgtgcatcctgtcttgcccatagggatccctactgcggttggtgtgtgctgctaggacggtgttcccgcagatcggaatgtagcagaggacaggggcctgagcaatggctgtggagttttcagcctgagcttggctgtctgcaggttgccgcaatgtccccagccaacatctctcgagaggagacaagggaagtatttttgtctgtgcctgatctgccacctttgtggcccggtgaatcttattcatgccactttggtgagcaccaatccccggctctgctgaccggctccggagtaatgtgtccttcccccgatccatctgaagcccccgtgctccccaggggagcggactacgtgagtgtgagcgtcgagctgcgctttggggcggtagtaattgccaaaacgtccttgagtttctacgattgcgtagctgttacagaattacgcccctctgctcagtgtcaggcctgtgtgtcttcgcgctggggatgcaattggtgtgtttggcagcacctgtgcacgcataaggcaagttgtgacgcagggcccatggtggcaagtcatcaatcccctctggtctctcctgatccgcctgctcgcggtgacggcgatagcgccgagctggaaggaccacctgcccctctgattctgcccagctccctggattaccaatacgacaccccgggcctatgggagctggaggaggcgactttgggggcctcatcttgcccatgcgtggagtcagttcaaggcagcacattaatgcccgtgcatgtcgagcgcgagattcggcttctcggacggaacttgcacctgttccaggacggccctggcgataacgagtgtgtgatggagctggaggggttggaggtggttgtggaagcgagagtggagtgtgaacctcccccggacacccagtgccacgtgacctgccagcagcatcagcttagttatgaggcactccagccagaactgcgggttgggctgtttctacgccgggcaggaagacttcgggtagactctgccgaaggattacacgttgtgctctatgactgctcggtcggccatggagactgctctcggtgtcagactgcaatgccacaatatggctgtgtgtggtgcgaaggagagagaccaagatgtgtcacaagagaagcttgcggggaggccgaagctgtggccacacaatgccccgccccattaatccacagcgtcgaacccctcacaggacctgtggacggaggcacccgtgtgaccatccggggtagcaatctaggtcagcacgtgcaggacgtcctgggcatggtgactgtggctggcgtaccctgtgcagtggacgctcaggaatacgaggtgtcatcctccctggtatgtattaccggggcctcaggggaggaggttgccggagccaccgccgtggaagtgcccggaaggggccggggcgtatcagaacatgattttgcttatcaggaccctaaagtgcactctatttttccagccagaggtccaagagcggggggcactagactaaccttgaatggaagtaaactgctcacgggaagactggaggacatcagagtggtggtgggcgaccagccttgccacctgctgccggagcagcagagtgagcagctccgctgcgaaacatcccctagaccaactccagctaccctgcccgtggcggtgtggttcggagcgaccgaaagaagactccaaagaggacagtttaagtatactttagaccctaacataacgagtgccggcccaactaaatccttcctatcgggagggcgcgagatatgtgtgagggggcaaaatctcgacgtagtacaaaccccaaggataagggtgaccgtggtttctcggatgttgcagccgtcccagggactgggaagacgacggagggtggtgcccgagacggcctgttcacttgggccgagttgtagctcccaacagtttgaagagccctgccacgtcaatagttctcaacttatcacctgtcgcacaccagcattgcctggactgccagaagatccctgggtgcgcgtagagttcatattagacaatctagtatttgattttgcaacactcaaccccacacctttcagctatgaagccgacccaactctgcagcccctaaacccagaggacccgaccatgccctttagacacaagcccggcagcgtgttctccgtggaaggggagaatctggacctagccatgtccaaggaggaagtagtggcgatgattggagacggcccgtgcgtggtgaaaaccctgactcggcaccacctgtattgcgaacctcccgtggagcagcctctgccaaggcaccatgcgttacgagaagctccagacagcttgccagaatttaccgtgcagatggggaatcttcgctttagcctcggacatgtccaatacgatggagagtcaccaggtgcctttcctgttgctgcccaggtcggactaggggtagggacgtctctgcttgccctgggcgtgatcattatcgttctgatgtaccggcgaaagagcaagcaggcactgcgcgattacaagaaggtgcagatccaactcgaaaacctggagtcttccgtgcgggacaggtgtaagaaagagtttacggatttaatgaccgaaatgaccgatttgacaagcgaccttcttggctctgggatcccattcctggactacaaagtgtatgctgagagaatcttttttccagggcaccgtgagtcacctttgcatagagatcttggcgtccccgaatctagaagaccgacagtggaacagggactcggacagttgtcaaacctgctgaattccaaactcttcctcaccaaattcatacatactctggagtcacagcgaacctttagtgcaagggatcgcgcctacgtggcgagtctgctcaccgtggcactgcatggcaaattagagtattttacggacattctcaggaccctgctttctgacctagtggcccagtacgtggccaagaatcccaaattgatgctgcgacggacagagaccgttgtggaaaagctgctcacgaattggatgtcgatatgcctgtacaccttcgttcgagactctgtgggtgaacccctgtacatgcttttcagaggtataaagcaccaggtggacaagggaccagtggacagcgtaactggcaaggcaaaatacactttaaatgataataggctgctccgagaagacgttgagtacaggcccctcacactcaatgcccttcttgccgtcggcccaggggcaggagaggcacaaggcgtaccggttaaagtactggattgtgacaccatcagccaagcaaaagagaagatgctcgaccagctgtataaaggagtgcccctgacgcagcggcccgatccccgaaccctcgacgtcgaatggcgttcaggagttgccggccacctcatcctgagcgatgaggacgtaacatccgaggtgcagggactgtggcgtaggctgaatacactccagcactataaagtccctgacggagcaacagtcgctctggtgccgtgtctcacaaaacacgttctcagggagaatcaagactatgtgcctggcgaaagaacacctatgctggaagatgtggacgagggaggcatccgaccatggcatctcgtcaaaccttcagacgagccagagccccccaggcccagaagggggtcactccgaggaggggagagggaaagggctaaagcaatacccgagatttatcttacccgactgctgagcatgaaggggactctgcagaagtttgtagatgatctcttccaagtgatcctgtcgacgtctcgccccgtgcctttggccgttaagtacttctttgacctcctcgacgagcaagctcagcaacacgggatttcagaccaagatactatacacatttggaagactaatagccttcctctccggttctggattaatattatcaaaaacccccagtttgtatttgatgtgcagacaagcgataacatggatgctgtgctattggttattgctcagacgttcatggatgcctgtacgctggctgaccacaagttgggtagggattccccaatcaataagctgctgtacgctagagacatccctcgctataagagaatggtggagaggtactacgctgacatcaggcaaacggtgccagcatcggatcaagaaatgaatagtgtcctggccgaattgtcctggaattatagcggggacctcggcgccagagttgccctgcacgagctgtacaagtacattaacaagtactacgaccagatcattacagctctggaggaagatggtaccgcccagaagatgcaactcggttatcgtctgcaacagatcgctgcagccgttgaaaacaaggtgacagacctctag

SEQ ID NO: 5654 - DNA, 342 bp, Artificial Sequence
  Description of Artificial Sequence: Synthetic coding sequence
atgctggtgttatttctgctagggacagtgtttcttctgtgcccttactggggcgaactgcacgaccccattaaagcgacagaaataatgtgctacgagtgtaaaaaatatcacctcggcctctgctacggagtgatgacctcttgcagcctgaagcataagcagagttgtgcagtggaaaatttttacatcctgacaaggaagggacagagcatgtatcattattccaagctatcatgtatgacctcttgcgaagacattaactttcttggttttaccaagcgagtggagctcatttgttgcgatcactcaaattactgcaatttgcctgagggcgtctag

SEQ ID NO: 5655 - DNA, 6408 bp, Artificial Sequence
  Description of Artificial Sequence: Synthetic coding sequence
atgcccgcgcttggtcctgcccttctgcaggctctctgggctgggtgggtgttaaccttgcagcccctgccacctacagcctttacacctaatggcacatatctgcagcatcttgctagggatcctacgtcaggcacattatatctgggtgctacaaatttcttgttccagctcagtccaggcctgcagcttgaggccaccgtgtctactgggcccgtcctcgatagtcgagactgcctgccaccggtcatgcccgacgagtgcccccaggcgcagccgacgaacaaccccaaccagttacttcttgtatctccaggggctcttgtggtctgtggcagcgtccaccagggggtgtgcgaacagcgcagacttgggcaacttgagcagctgctgctgaggccagaacgtcccggagatacccaatacgtcgccgccaacgatcccgcggtgtccaccgtcggcctcgttgctcagggcttagccggagagccgttgctgttcgtggggcgcggatacacgtcacgcggcgtcggcggcggcattcctccaatcacaaccagagctttgtggccaccagatccacaggccgctttttcttatgaagagaccgccaaattggcagtaggtaggctgagtgaatatagtcatcatttcgtaagcgcctttgcccgcggcgcgagtgcatattttctttttctgcgtcgagacctgcaggcccagtcgagagcgtttagggcctacgtgagtagggtatgcctgagggaccagcactactactcctatgtcgaactgccacttgcctgtgagggcggcaggtatgggttgatccaggcagcggccgtggcaacaagcagggaagtcgcacatggcgaggttctgttcgcggcgttttctagtgctgcccctccaactgtggggaggccccctagcgccgcggctggtgccagcggcgcatccgccctctgtgccttcccactcgatgaggtagatcgcttggccaatagaacccgagacgcatgttacacaagggagggtagagcagaggacgggacagaagtcgcctacattgagtatgacgtgaattccgactgcgctcagcttccagtagacacgctggacgcttacccttgtggctctgatcatacaccctctccaatggccagccgggttcccctggaagccactccaatcttagagtggcccggcatacaactgacagctgtcgcagttacgatggaggacggccacactatagcctttctaggtgactcccagggccaattgcatagagtgtatcttggacccggcagcgacggccatccctactccacacagagcatccagcaaggaagcgccgtgtcccgggacctgacatttgacgggactttcgaacacctgtacgtcatgacccagtctacgctgcttaaggtcccagtggcttcctgcgcccagcatctcgattgtgcatcttgtctagctcaccgggatccatattgtggttggtgtgtgttactgggtagatgttcccggagatctgagtgttctcgcggacagggacctgagcaatggctgtggagtttccagccagagctcggatgtctgcaagtggccgctatgtcgcctgctaacatttcccgcgaggagacaagagaggtattcctcagcgtgccggatctgccgccattatggccgggtgagagctactcttgtcattttggcgaacaccaatcccccgcactcctgacaggtagcggcgtgatgtgtccgtcaccagaccccagcgaagcaccggtgctgccacgcggagccgactatgtgtcagtgagtgtggagctgcgctttggtgccgttgtgattgccaagacaagtctctctttctatgactgtgtagcagtcaccgagctgcgtccaagcgctcagtgccaagcctgcgtctcaagtagatggggatgcaattggtgtgtgtggcagcacttgtgcacgcataaggcaagctgcgacgcgggacctatggtcgcctctcaccagagccctcttgtgagccccgatccccctgctcgtggtggaccttctcccagtcccccgacagcgccaaaggccctggccacccctgcaccagataccctacctgtggaaccaggcgctcctagcaccgcaacggctagtgatatcagtcctggcgcaagtccaagtttactctcaccctgggggccatgggccggcagcggctctatcagcagccctgggtctaccgggtcacccctccatgaagagccaagtccgccgagcccccagaatggaccaggcaccgcagtgcctgcccctactgactttcggccctccgccacacctgaggatctgctagccagccccctgtctccatccgaagtggctgcggtccccccagccgatccaggccctgaagccttgcacccaactgtgccactagatcttccccctgcgaccgtccccgcgaccaccttcccaggcgcgatgggaagcgtgaagcctgccctagactggctgactagggagggcggtgaactgcccgaggccgacgagtggaccgggggcgacgcaccggcttttagcaccagcactctgttgtctggggacggggatagtgctgaactggaggggccacctgcaccattgatccttcctagttctctggactaccagtatgataccccagggttgtgggagcttgaggaagctactttgggcgcatccagttgcccctgcgtggagagtgtgcagggcagcacgctcatgccagtccacgtggaacgcgaaattagactgcttggacgcaatcttcacctctttcaggacggaccaggagataacgagtgtgtcatggagcttgaggggctcgaagtcgtagttgaagccagggtggaatgtgagccaccccctgatacccagtgtcacgtgacgtgtcagcaacaccagctgagctatgaggcacttcagcccgagcttagagtgggtcttttcttaagaagggcaggacgactgagggtcgacagcgccgagggactacacgtcgtgctttacgactgtagcgtgggccacggcgattgctcaaggtgccagaccgccatgccccagtacgggtgcgtgtggtgtgaaggggagaggccacgatgtgtgactcgggaggcttgtggagaagctgaggcagtcgctacccagtgccccgcacccctgattcattcggtcgagcccctgaccggtccagtggatggcggtaccagggtaactattaggggatcaaaccttggacaacacgtccaggacgtgctggggatggtgacagtggccggggtgccgtgcgctgtggacgctcaggagtatgaggtgtcctcttctcttgtgtgtattaccggtgcttctggcgaggaggtcgctggcgctacagcggtggaggtgcccggacggggaaggggcgtctcagaacatgactttgcttaccaggatcctaaagtccactctatctttcccgcccgaggcccccgtgccggagggacacgccttaccctgaatggtagcaagctactgacaggccgactcgaggatatccgtgtcgtagtaggcgaccaaccttgccacctgttgccggaacaacaatccgaacagctccgttgcgaaacttctccccgccctacccccgctactttgccagtggctgtttggtttggtgctaccgagagacggcttcagcgtggacagttcaaatatactttggaccccaacataacaagcgccggccccactaaaagctttctgtccggaggccgcgaaatctgcgtgagaggacagaatttggatgttgtacaaactcctcgcatcagggtgactgtggtcagtagaatgctgcaaccctcgcagggtcttgggcgacggcgccgagtcgtgccagaaacggcatgtagccttggtccctcttgctcttcacagcaatttgaggagccatgccacgtgaacagttcacagctgatcacctgtcggaccccagcactgccaggactgcccgaagacccttgggtgagagtggagtttatcttagataacctcgtcttcgatttcgccacactgaatcctactccgttttcatatgaagctgaccccacactgcagcctttaaatccagaggatccaaccatgccctttagacacaaacctggcagtgtgttcagtgttgaaggggagaacttggacttggctatgagtaaggaagaagtcgttgcaatgatcggggacggcccatgcgtcgtcaaaaccctgacccgccaccacctatactgcgaacctcccgtcgagcagcctctcccccgacaccatgctctcagagaggctcccgactctctcccagaattcacggtccagatgggtaatttgagatttagtctcgggcacgtgcagtatgatggggagtctcccggtgcatttcctgttgccgcacaggtgggactgggtgtcggtacttccctgctggctctgggggttatcattattgtccttatgtataggcgcaaaagcaagcaggccctgcgcgactataagaaagtccagatccagctggaaaatctcgagtccagcgttcgcgataggtgtaagaaggagtttactgacctcatgactgaaatgacagacttgactagcgatctgctcggatccgggatcccatttctcgactataaggtctacgccgagagaatcttctttcctggccaccgagaatcacctctgcaccgggacttgggggtaccagagtccagaagaccaaccgtcgagcaaggtctcggacagttgtccaacctgctcaattctaagctgttcctcaccaagttcatccatacgctcgaaagccagaggacatttagcgcccgggaccgggcctacgtcgcgtccttgttgacagttgcactacatggtaagttagagtattttacagacatcctccgaactttgctcagtgacctcgttgctcagtacgtcgccaagaatccaaaacttatgcttcgacgcaccgaaaccgtcgtggaaaagctgttaaccaattggatgtcaatttgtttatacacctttgtaagagacagtgtgggcgagcctctgtacatgctgttcagaggaatcaagcaccaggtcgataaaggcccagtggacagcgtcacagggaaggcaaaatataccttaaacgacaacaggctgctgagggaggacgttgaataccgtcccctgaccctgaatgccttactggcggtgggccctggagctggggaggcacaaggtgtaccggtgaaggtcttagattgtgacacgatctctcaagcgaaggagaaaatgttagaccagctttataaaggtgtcccactgactcagagaccagatccacgcactctggatgtggaatggcggtcaggggttgctggacatctgatcttgagcgacgaagatgtcacctccgaagtgcaaggtctgtggaggagactgaatacactccagcattacaaagtgcccgacggtgccactgtggctctagtgccttgcctgacgaagcatgtgcttagagagaatcaggattacgtgccaggagaacgcacccccatgttagaggatgtggatgagggtggaattcgtccttggcatctcgtgaaaccaagtgacgaacccgagccacctagacctcgacgcggtagcctgagagggggtgaaagagagcgcgccaaggctatacctgagatttatttaactcggctgttgagcatgaagggcacgctgcaaaaatttgtcgacgatttgttccaggtaatcttgagtaccagccgccccgttccgctcgccgtgaagtactttttcgacctcctggacgagcaggctcagcaacatggaatctccgatcaggatactatccacatctggaaaaccaacagtctgccactgcggttctggattaacattattaaaaatcctcagttcgtgtttgatgtacagacgagtgacaatatggacgccgtccttctggtgatcgcccagacttttatggacgcctgcacactagccgatcacaagctgggacgcgactccccaattaataaactgctgtacgctagggatatcccaagatataaacggatggtagagcgttactacgccgacatcagacagactgtcccagctagcgaccaagaaatgaattcagtcttagcagaactgagctggaattactccggcgatctgggcgctcgtgtagcccttcatgagctgtacaaatacattaacaagtactacgaccagattatcacagctctggaagaagacggcactgcacagaaaatgcagcttggatataggttgcagcagatcgccgctgccgtggagaataaggttaccgatctgtag

SEQ ID NO: 5656 - DNA, 390 bp, Artificial Sequence
  Description of Artificial Sequence: Synthetic coding sequence
atgcgaccactcaaacccggtgctcccctccccgcccttttcttgttagccctagccctgtctccccacggggcacacggtcgcccacgtggcagacgcggagcccgggttactgacaaagagccgaagccactgttgtttctaccagctgccggcgccggaaggactccaagtgggtctcgctcagccgagatatttcctagagactctaacttgaaagacaagtttattaaacacttcaccggacccgtgacgtttagcccagaatgttcaaagcacttccacagactgtactacaatacaagggagtgttcaactcccgcctattacaaacgctgcgccagactcctgacgcgcctcgctgttagtccattgtgttcacagacttag

SEQ ID NO: 5657 - DNA, 252 bp, Artificial Sequence
  Description of Artificial Sequence: Synthetic coding sequence
atgcgcttaagtgtctgccttctgatggtgagccttgctctttgttgctatcaagcccacgcccttgtgtgtccagccgtcgccagtgaaatcacggtgtttctctttctgagcgacgcggctgtgaacttacaagtggccaaactaaatccccctcctgaagccttggccgcaaaactggaggtgaaacattgcaccgaccagatcagcttcaagaaaaggctgtccctgaagaaaagttggtggaaatag

SEQ ID NO: 5658 - DNA, 1455 bp, Artificial Sequence
  Description of Artificial Sequence: Synthetic coding sequence
atgtggtatgtgagtacaaggggtgttgccccaagagtgaattttgagggggctctcttcagcggctacgcccctgatggcggtctgtttatgcccgaggaactcccacagttggatagaggaacactttgtcagtggagcacgctttcctaccccggactcgtgaaagaactgtgcgccctgtttattgggtctgagctcctccctaaagatgagctgaacgatctcattgaccgagctttctcccgcttcagacatcgcgaagtggtgcatctgtctcggttacgcaatggccttaacgtacttgagctatggcacggcgtaacatacgcattcaaagacctgagcttatcttgcacgacccagttcctacaatactttttagagaagagggagaaacacgtgaccgtggtcgtcggcacttctggggacacaggaagtgctgccattgagagcgtgcagggagccaagaacatggacataatagttctacttcccaaagggcattgtacaaagatccaggagctgcagatgactacagtactgaaacagaacgtgcacgtctttggggttgaggggaatagcgacgaactggatgagcccattaagacagtcttcgccgatgtggcctttgttaaaaagcacaacctcatgtcactaaacagtatcaactggtcacgggtcctggtacagatggctcatcacttctttgcctattttcagtgcacccccagtctcgatacccatcctttgcccttagtggaggtggtggtgcccaccggcgccgcgggcaacctggcagccggctacatcgctcagaagataggcctgccaatcagactggttgtggctgtcaaccgcaatgacataatccacaggaccgtgcagcaaggggactttagcctgtctgaggctgtaaagtccaccttggcatccgccatggacattcaggtaccttacaacatggagcgcgtgttttggctgctctccgggtccgattcccaagtgacaagggctttaatggaacagtttgagagaactcagagcgtcaacctccctaaggaactccattcaaaacttagcgaagcggtgacaagcgtaagtgtgagtgatgaggccatcacccaaacaatggggcggtgctgggacgagaaccagtatctgctgtgtccacatagcgctgtggccgtaaactaccactaccagcagattgatagacagcagccaagcacacccaggtgttgcctggcacctgcatcagccgcgaaatttccagaggccgtcttagcagcaggattgacacccgagacacctgcagagattgtggccctcgagcacaaagagacccggtgcacgctgatgagacggggggacaactggatgctgatgctccgggacactattgaagatctgtcacgacagtggcgttcacacgcactgaatacgtcccagtag

SEQ ID NO: 5659 - DNA, 159 bp, Artificial Sequence
  Description of Artificial Sequence: Synthetic coding sequence
atgaaactgtgtgtgaccgtgttgtcactcctggtgttggttgccgccttctgttccctggccctgtctgcgccaagtaataagcctctagaggcttccaagagcgccctgactcctgtgtcaccaggatcgcggagcacctgtatgacttggaattag

SEQ ID NO: 5660 - DNA, 675 bp, Artificial Sequence
  Description of Artificial Sequence: Synthetic coding sequence
atgcgagtgagtggcgttctccgactcttagccctcatcttcgctattgtgactacatggatgttcatccggtcgtatatgtctttctccatgaagaccatcaggcttcctcgctggctggccgcctctccaaccaaggagattcaagtgaagaagtacaaatgcggtctgatcaaaccctgtcccgctaattatttcgctttcaaaatttgtagcggcgctgcaaatgtggtcggccccaccatgtgtttcgaagaccggatgattatgtcacccgttaaaaacaacgtcgggaggggcctgaacatcgctctggtcaatggcaccacaggcgcagtgcttggccagaaggctttcgacatgtactccggtgatgtaatgcatttggtgaaatttctgaaggagatccccgggggggctttagtcctcgtggcctcctatgatgatccgggaaccaaaatgaacgacgaatcaagaaagctttttagtgatctcggtagcagctacgcgaaacaactgggattcagggactcatgggtttttatcggcgccaaggatctgcgtggaaaatctccgttcgagcagtttctcaaaaactcaccggacaccaacaagtatgagggttggcccgagctcttagaaatggagggttgtatgccaccaaaacccttttag

SEQ ID NO: 5661 - DNA, 1404 bp, Artificial Sequence
  Description of Artificial Sequence: Synthetic coding sequence
atgttgatattttggacgataacgctgttcctgctaggcgccgctaaaggaaaagaggtctgctacgaagatcttggttgttttagtgataccgaaccatggggcggtactgccattaggcccctgaaaatcctgccctggagccccgaaaaaataggaacaaggtttctcctgtacactaacgaaaacccgaataatttccagatcttactcctgagtgacccctcgaccatcgaagcctcaaattttcagatggataggaaaacaaggtttatcatacacggattcattgacaaaggtgatgaatcatgggtgacagatatgtgcaagaagctgttcgaagtcgaagaagtgaactgcatctgcgtggactggaaaaagggctcacaggcgacatacacccaggctgccaacaacgtgcgcgtcgttggggcccaagtggctcaaatgctcgatattttacttacagaatactcgtaccctcccagtaaggtgcacctcatcggacactcactgggcgcacatgttgctggggaagctggatctaaaacccccggattgagccgtataaccgggctggaccccgtggaagcctcattcgaaagtactccagaagaggtgcgccttgacccctcagacgccgatttcgtcgacgtgattcacacagacgccgcccctctgataccattccttgggtttggcacgaaccagcaaatgggacacttggacttcttcccgaacggcggggaatcaatgcctgggtgcaagaagaatgccctcagtcagatcgtggatctggacggcatttgggccggtacacgtgatttcgtagcctgtaaccacctccggagctacaagtactatttggaatctattttaaatcctgatggatttgccgcttacccctgtacctcttacaagtcctttgagtccgataagtgcttcccatgccccgatcagggatgcccacagatggggcactacgctgacaagtttgcaggcaggacgagtgaggaacagcagaagttttttctgaacactggagaggcctctaatttcgctcggtggcgctacggcgtgagtatcacactctccggtaggactgcaaccgggcagatcaaggtcgcattatttggaaacaagggcaatacccatcaatattccatttttagggggattctgaagcccggaagcactcactcttatgaatttgacgccaaactggatgtcgggactatcgaaaaagtgaaatttctctggaataataacgtgataaatccaactttgccaaaagtgggagccaccaagattacggttcagaagggggaagagaaaaccgtctacaatttctgctccgaagacacagtgcgggaggacactctgttaactctgacgccttgctag

SEQ ID NO: 5662 - DNA, 237 bp, Artificial Sequence
  Description of Artificial Sequence: Synthetic coding sequence
atggggagtggactgccactggtcctgctcttaacactgctgggatcctcgcatgggacggggcctggtatgacactccagttaaagctgaaggagtcttttctgacaaactcgagttacgaaagcagcttcctggagctgttggagaagctctgtctcctgctgcatctaccctccggcacttcagtcaccctgcaccatgcccgcagccaacatcacgtggtatgcaatacgtag

SEQ ID NO: 5663 - DNA, 291 bp, Artificial Sequence
  Description of Artificial Sequence: Synthetic coding sequence
atggagcacaaggaggtcgtcctcctgttactcctgttcttgaaaagcgggcagggagagcccttggacgattatgtcaacactcagggaccaagcctttttagcgtgactaaaaagcagttaggagcagggagtcgggaagagtgcgcagcaaagtgcgaagaggacaaggagtttacatgccgtgcattccagtaccattcaaaagaacagcagtgtgtcatcatggcggaaaataggaaaagctccatcattatcaggatgcgggacgcagttctgttcgaaaagtag

SEQ ID NO: 5664 - DNA, 1083 bp, Artificial Sequence
  Description of Artificial Sequence: Synthetic coding sequence
atggggttgctgcttctcgtcccactgctactgctccccggttcttacgggttgcctttttataatgggttctactattcaaattcggctaacgatcaaaacttgggtaatgggcacgggaaggacttgctaaacggggtgaaattagtggtggaaacaccagaggaaactctgttcacctatcagggagccagtgtcattctcccgtgtagatatcgctacgagcctgccctcgtttccccccgcagagtgagggttaagtggtggaagctgtcagaaaatggcgctccagaaaaagatgtactcgttgccattggcctgagacatagatctttcggtgactaccaggggagagttcatttacggcaggacaaagagcatgatgtcagcctggagattcaagacttgcggctggaggattatggccggtacagatgcgaggtaatagacggactggaagatgaatcaggactggttgaactcgaactccggggcgtagtcttcccttatcaatccccaaacgggaggtaccaatttaatttccacgaagggcagcaggtatgtgcagaacaggctgcagtggttgcatctttcgagcagttattcagggcctgggaggagggcctggactggtgcaatgcaggctggttgcaggacgcaacagtgcagtacccaatcatgctaccgcggcagccctgcggcggacccggcttggctcccggcgttcgctcatacggacctaggcaccgtagactgcacagatacgatgtgttttgtttcgctaccgccctcaagggccgcgtctactacttagagcatcctgaaaagctaacactgactgaggcccgtgaagcctgccaggaagacgacgccacaatcgccaaggtggggcagctcttcgcggcttggaagttccatggactggacaggtgcgatgctgggtggctggccgacggcagtgtccggtatcctgttgtccacccccatcctaattgtggccccccggaaccgggtgttcgcagcttcggatttcctgatccacagtccagactgtatggcgtctactgttaccgacagcactag

SEQ ID NO: 5665 - DNA, 810 bp, Artificial Sequence
  Description of Artificial Sequence: Synthetic coding sequence
atgattaggaccttactgctgtcaactctggttgctggagcattgtcctgcggggatccgacctaccctccttatgtgacacgtgttgttggtggggaggaagctaggcccaatagctggccttggcaggtcagcttgcagtattcttctaatggcaagtggtaccatacatgcggcgggtcccttatcgctaacagttgggttctgactgcagcccattgcatttccagttctcgcacatatagagtgggcctggggcgtcacaatctgtatgtcgccgagagcggcagtctcgctgtctctgtgagcaagatcgttgtgcataaggattggaactcaaaccagatttccaagggtaatgatattgcgctgctgaagctcgccaaccctgtctcactcactgacaagatccagctcgcatgtctcccacccgccggaacaattttacccaacaactatccttgctacgttaccggttggggtcggctgcaaactaatggggcagtgccagacgtgttacagcagggtcgcttgctcgtcgtagactatgcgacatgcagcagctcagcctggtggggttcaagtgtgaaaacaagcatgatatgtgccgggggagatggtgtcattagctcctgtaacggtgacagtggcggaccactcaattgtcaggcctctgacggacgttggcaggtgcacgggatagtgagttttggcagcaggctggggtgtaactattaccataagccatcagttttcaccagagtgtcaaactacatcgattggatcaatagcgtcatcgcgaataattag

SEQ ID NO: 5666 - DNA, 1122 bp, Artificial Sequence
  Description of Artificial Sequence: Synthetic coding sequence
atgctgccgtggttgttggttttctcggctctgggcattcaagcatggggggactcttcctggaataaaacacaagccaagcaggtctctgagggtctgcagtacttatttgagaacatcagtcagcttaccgaaaagggcctccctactgatgtctctacaacagtgtcacgcaaagcatggggggcagaagcggttggctgctccatacaacttactactcctgtgaatgtgttggtaattcatcacgtgcctggactggaatgtcacgaccagaccgtctgcagtcaaaggcttcgcgagcttcaagcacatcacgtccacaacaattcagggtgtgatgtggcttataacttcctggtgggggacgatggcagggtgtacgagggggtcgggtggaacattcaaggcgtgcacactcaggggtacaataacatcagtcttggtttcgcattcttcggaaccaaaaagggccatagcccctccccagccgctctatccgctatggagaatctcataacatacgccgttcaaaagggccacttgtcttcgtcgtatgtgcagccactgctcggtaagggtgaaaactgcctagccccacggcagaagacctccttgaagaaggcctgtcctggcgtagtgcctagaagcgtatggggagcgcgggagacccattgccctaggatgacactgcctgccaaatatgggatcataattcacacagcaggtcggacttgtaatatcagcgacgagtgccgcctgctggtgcgtgatatacaatccttttatatagaccggcttaaaagctgtgacatcggctataactttctggtaggccaggacggtgccatttatgagggcgtcggatggaatgttcagggcagctccactccaggttatgacgacattgctctgggcatcacttttatgggcactttcaccggcattccaccaaacgcagctgcccttgaagctgcccaggatctgatacagtgcgccatggttaagggctatcttactcctaattacctcctagtgggacactccgacgtggctcgaacactgtccccagggcaggctctttacaacatcatcagcacctggccacacttcaaacactag

SEQ ID NO: 5667 - DNA, 327 bp, Artificial Sequence
  Description of Artificial Sequence: Synthetic coding sequence
atgaggcagcgactgctgccttctgtgaccagtctgctactcgtggccctcttgttccccgggagctcgcaagcacgccacgttaaccacagtgccaccgaggcgctgggcgaactccgcgaacgggcccccggccagggtacaaacggctttcaactgctgcgtcatgctgttaagcgagacttactgcctccgagaacacccccgtaccagggggacgttcccccaggaatccgcaataccatttgccacatgcaacaggggatctgccggctgttcttctgccatagtggtacaggtcagcaacaccggcagaggtgtggctag

SEQ ID NO: 5668 - DNA, 708 bp, Artificial Sequence
  Description of Artificial Sequence: Synthetic coding sequence
atgtctccacccctgcttaagctgggagctgtgctctccactatggcgatgattagcaactggatgtcccaaaccctgccgtcccttgtgggactgaacaccacccggcttagtactccagatacgttgacgcaaatcagcccaaaggaggggtggcaggtgtactcatctgcacaagatccagacggacgatgcatttgtactgtagtcgcacccgaacagaacctctgttctcgggacgcgaagtccagacaattaagacagcttctcgaaaaggtgcagaacatgtcccaaagcattgaggtgctcaatctccgtacccagagagatttccagtatgtactcaagatggaaactcagatgaaggggttaaaggccaaattccggcagatcgaggacgatcggaagactcttatgactaaacactttcaggagctcaaggagaagatggacgaactgctaccattgatacccgttctcgaacaatataaaacggacgccaagttgatcacgcagttcaaagaggagattcgcaacctgagcgccgttctcacaggcatccaggaggagattggcgcctacgactacgaggaactccaccagcgtgtgctctcccttgagacaaggctgagagattgcatgaagaagctgatcgatctgaagaaaaggaaggaagaggagaagaggcagcagaaaggggaagcctag

SEQ ID NO: 5669 - DNA, 606 bp, Artificial Sequence
  Description of Artificial Sequence: Synthetic coding sequence
atgaacttaaattgcccaccttgtgtgacgggtctgagggtgtggtcctcatgtcgctcgaaaccaaactcacgcgcgcgatcttgccgaagctgtaccggagcttctaggacactgccctcccaccatatgagccacgttgaatgcccgagtggcatagtcaacgaggaaaacttcaagcaaatttactcgcaattctttccacagggcgattctagtacttacgcaacattcctttttaatgctttcgacacaaatcacgacggctcagtttcgtttgaggactttgtagctggcctgtccgtcatcctgagaggcacagtggacgaccgactcaattgggcatttaacctgtatgacttgaacaaagacgggtgcatcaccaaagaggaaatgttggacattatgaagtcaatatacgacatgatgggaaagtatacgtatccagccctcagggaggaagccccaagagagcatgtggagtccttcttccaaaagatggatcgaaacaaagacggcgtagttactatcgaggaatttattgaaagctgtcagaaagatgagaatattatgaggtcaatgcaactgttcgacaatgttatatag

SEQ ID NO: 5670 - DNA, 693 bp, Artificial Sequence
  Description of Artificial Sequence: Synthetic coding sequence
atgcggctagcaggcccattgagaatagtggttctggtagtgtcggtaggtgtgacttggatcgtcgtgtcaatcctcctaggaggccccggcagtggatttcccaggatccaacagcttttcacttccccagaatcctctgttacagctgcgcccagggcaaggaagtacaaatgtggcttgcctcagccctgtccagaggagcacctcgcctttagggtggtaagtggtgctgccaatgttattgggcccaaaatctgcctagaagacaaaatgcttatgtcgtcggtgaaggacaacgtgggtcggggcctaaatatagccctcgtcaatggcgtatcgggcgagctcattgaggcccgcgctttcgatatgtgggccggggacgtcaatgacctgctgaaatttatacgtcctctgcatgagggcacgctagtgtttgtggcgagctacgacgaccctgccactaaaatgaacgaagagacccggaaactgttcagtgagttaggctctcggaacgcaaaagaattagcctttagagacagctgggtcttcgtcggtgctaagggagtccagaataaatcgccttttgaacaacatgtgaaaaattctaagcattcgaataaatacgaaggctggcctgaggccctggagatggaaggctgtattccacgaagatctacagccagctag

SEQ ID NO: 5671 - DNA, 684 bp, Artificial Sequence
  Description of Artificial Sequence: Synthetic coding sequence
atgcgggtggccggcgccgccaaattggtcgtggctgttgccgtgttcttacttacgttttacgttatatcccaagtgttcgaaatcaaaatggacgcctccctgggcaacctcttcgcgcggtccgcgttagacaccgccgccaggtctactaaaccccccaggtacaagtgtggcatcagtaaagcatgccctgaaaagcacttcgcgtttaagatggcttcaggagctgctaacgtggttggccccaagatatgtttagaagataatgtcctgatgagcggcgttaaaaataacgttggtagggggatcaacgttgctctagctaacggcaaaacaggtgaggttctggatacaaagtattttgacatgtgggggggagacgtggcccctttcatcgagttcttgaaggcaattcaggacgggactatcgttcttatgggaacctatgatgatggcgccaccaagcttaatgacgaagctcgtcgactcattgccgacctgggctctacctcgattactaatctgggctttagggacaactgggttttttgcgggggcaaagggattaaaactaaatcacctttcgagcagcacataaagaacaacaaggacaccaacaagtatgaagggtggcccgaggtggtcgagatggagggctgtatcccacagaagcaagactag

SEQ ID NO: 5672 - DNA, 1656 bp, Artificial Sequence
  Description of Artificial Sequence: Synthetic coding sequence
atggaagacagcgattcagcagctaagcagttgggactggccgaggcggctgcagccggcggcgaagccgaggagcccgtcctttctagagacgaagattcagaggaagacgcagatagcgaagccgaacgcgagacgcctcgggtaacagccgtcgccgtgatggccgccgagcctggacatatggacatgggtgccgaggccctgcctgggccagatgaagcggctgctgccgccgcctttgctgaggtcactacagttaccgtcgctaatgtgggggccgctgcagacaacgtgttcactaccagcgtggccaatgctgcctccatctcagggcacgtccttagcggaagaactgctttgcaaatcggggacagtcttaacacagagaaggccaccttgattgtcgtgcatactgatggatccatagtcgagacaacaggccttaaaggccctgctgcacctctcactcccggaccgcagagcccgcctaccccgctggcccccggacaagaaaagggcggtacgaagtacaactgggacccttcggtgtatgactctgaactgcccgtgcgctgtcgcaatatctctggtactctctataagaatcggctgggttcaggtgggaggggccggtgtatcaagcagggggagaattggtactctcccacggaattcgaagcaatggccggccgtgcttcctccaaggactggaagcgctcaatccgctatgccggacggcctttacagtgtcttattcaggatggaatcctaaacccacacgctgccagctgtacgtgtgccgcttgttgcgatgacatgaccttgagcgggcccgtccgattgtttgtaccatacaagcgtcgcaaaaaagaaaatgaattgccgaccacccccgttaagaaggacagccctaagaatatcacacttttacctgcaacagccgccacaacgttcaccgtcacaccaagtggtcagatcactacaagcggcgccttgaccttcgatcgagcttccactgtcgaggccactgccgtcatctcagaaagtcctgcccagggagatgtatttgctggggccaccgttcaggaagccagcgtgcagcccccttgtcgggcctcacatcctgagccgcattacccaggctatcaagattcttgccagattgcccctttccctgaggccgcactcccaacaagccacccaaagatcgtcctcacctctctccccgcacttgccgtcccccccccaactccgaccaaagcggcccctcctgcactggtgaatggattggaattgagtgagcctcgaagctggctgtacctggaggagatggtcaactcgctgctgaacacagctcaacagttgaaaacactgttcgaacaggcgaagcacgcctccacataccgagaagccgctactaaccaggcgaagattcatgccgatgccgagcggaaagagcagtcatgcgtgaactgtggccgcgaggctatgagcgagtgcaccggctgtcataaagtcaattactgttcaactttttgccagaggaaagactggaaggaccatcagcatatctgtgggcaatccgctgccgtcacagtacaggccgatgaggttcacgtcgctgagagcgttatggagaaggttactgtttag

SEQ ID NO: 5673 - DNA, 2022 bp, Artificial Sequence
  Description of Artificial Sequence: Synthetic coding sequence
atgaaaccgggcggtttctggctgcacctcacgctgctgggagcctccctgccagctgccctcggatggatggacccaggtacaagtagagggcccgatgtcggcgtcggagaatcacaggctgaagagccaagaagtttcgaggtgacaaggcgagaaggactttcttcccacaatgaactgttggcatcctgcggaaaaaagttctgctcccggggatcccggtgcgtgctgagtctggcccctgaggacagggtgtccgtgactaccgtgacagtagggctgagtaccgtgctgacctgcgcagtgcacggggaccttcggcccccaatcatctggaaaagaaacggactcactctgaatttcctcgatttggaagacatcaacgacttcggggaagatgacagcctctacatcaccaaggtcacaacaatacacatggggaactacacttgccacgcttcagggcatgagcagctgtttcagacccacgtgctacaggtgaacgttccccctgtcatccgtgtctatcccgagagccaagcacaggaacccggagttgccgcctccttgcgctgtcatgcagaaggtattccaatgcctaggatcacctggctgaaaaacggggtggatgtatccactcaaatgagcaagcagctctctctgctcgccaacggatccgagctgcacatctcatcagtcaggtatgaggacactggcgcctatacatgcatcgcaaagaacgaggtgggagttgatgaggatatttccagtcttttcatagaagatagtgccagaaagaccctggccaacatcctgtggcgcgaagaaggcttgtccgtgggaaacatgttttacgttttctcagacgacggcattattgtcattcatccggtggattgcgaaatccagcgccacctgaaaccaacggagaagatatttatgtcctacgaggagatttgcccgcagagagagaagaatgccactcagccttgccagtgggtaagcgcagtgaacgtgcgcaatagatatatttacgtcgcccagcctgctctatcacgcgttcttgttgtagacatccaagcccagaaggtgttgcagtccatcggagtggaccccctgccagccaaactgtcttatgacaagagccatgaccaggtttgggtattatcctggggagacgttcataagtctagaccatcactgcaggtgatcacagaggcttccaccggacaatcccagcacctcatccggactcccttcgcgggagtggacgactttttcatcccaccaaccaatctcattatcaatcatatacgatttgggtttatcttcaataaaagtgacccggctgtccacaaggtggacctcgagacgatgatgcccttaaagacaatcggactgcaccatcatggatgtgtgcctcaggccatggcccacacccatcttggtggctactttttcatccagtgcagacaagatagccctgcctctgccgccagacaactcttagtggacagcgtgacagatagcgtgcttgggccaaacggcgatgtgacgggaaccccccacacttcacctgacggccgctttatcgtctctgccgccgctgacagtccatggttgcacgtgcaggagataacagtccgcggagaaatccagactttgtacgacctgcagattaactctggcataagcgatctggcttttcagcgctcttttacggagtcaaaccagtacaatatatatgcggcattgcatacagaaccggatcttctgttcctggagctcagcaccggaaaagtcggcatgctaaagaaccttaaagagcctcctgctgggcccgctcagccctggggagggacacatcgcatcatgagagactccggactgtttggccagtacttactcacacctgcccgagaatccctctttctgattaatggccgccagaatactctgcggtgcgaggtgtccggtatcaaggggggcactacggtggtctgggtgggagaggtgtag

SEQ ID NO: 5674 - DNA, 2007 bp, Artificial Sequence
  Description of Artificial Sequence: Synthetic coding sequence
atggatctggtgttaaagagatgtcttctgcacctagccgttatcggggctcttctagctgttggagccacaaaagtccctcgtaatcaagactggttgggtgtgtcaaggcagctgcgcacaaaggcctggaatcgccaattgtatcctgagtggactgaggcacagagattagactgctggcgcggcggtcaggtgtcattgaaggtatcaaatgatgggccaacactcattggtgctaacgccagtttctcaattgctctaaatttccctgggagtcagaaagttttgcccgatggccaggtcatctgggttaataatacaattattaatggggatcaggtttggggcggacagccagtctaccctcaagagaccgacgatgcttgtatcttcccagatggagggccctgtccatcgggcagctggagtcagaagagaagttttgtatatgtgtggaaaacctggggccagtactggcaggtgctgggcggacccgttagcggactgtccatcggcacaggaagagctatgctcggaacccatacaatggaggtgactgtatatcaccgccgtgggagcaggtcttacgtacccctagcacattccagttccgcattcactattaccgatcaggtaccgtttagcgtgagcgtgagtcaacttagagccctggacggaggaaacaaacatttcctgcgaaatcaacccctcacctttgctcttcagctgcatgatcccagcggatatctagctgaagcagacttatcatacacttgggacttcggcgattcatcaggcacccttattagtcgtgcgctggtcgtaacgcacacgtacttagagcctgggccagtaactgcgcaggttgttcttcaggcggcaattcctttaacaagctgcggcagctcacccgtgcccgggaccactgacgggcacaggcccaccgccgaggcacctaacacaaccgccgggcaggtccccactacggaggtagtgggaactacccccggccaggcacccacagcggaaccttccgggactacctctgtccaggtacccaccacagaagtgatctccactgcaccggtccagatgcctacagccgagtcaaccggtatgactcccgagaaagtgccagtttcagaggtcatgggcacaaccttagcggagatgtccacacctgaagctacaggcatgacacccgcggaggtgagcattgtggtgctttcagggacgactgctgctcaggtcaccaccacagaatgggtggaaacaaccgcacgcgagctaccgataccggagcctgaaggcccagacgccagctctataatgagcaccgagagcattactggctcccttggtccactgttggacggcaccgccacattgcgactagtgaagcggcaggtgcccctggactgcgtgctttacagatacggctctttttcagtgactttagacattgtgcagggcattgagagcgctgagattctccaggccgttccatcaggtgagggcgatgcgttcgagctgaccgttagttgtcagggcggactgcccaaggaggcctgtatggagatcagctcccctggttgccagccccctgcccagaggctatgtcagcctgtgctcccctctccagcctgtcagcttgtcctgcatcaaattcttaagggcgggagtgggacatattgtctgaacgtgtctttggccgacacaaactctcttgccgtggtatcaacacagctcatcatgccagtccctggcattctcctgacaggacaggaggcaggactgggtcaggtaccccttattgttgggattctgttggttctgatggcagtagtgctggctagtttaatctatcggaggagactaatgaagcaggatttttctgtgccacagctgccccattcctcctcccattggctaaggcttcctaggattttttgttcttgccctatcggcgaaaacagtccccttctttctggccagcaggtgtag

SEQ ID NO: 5675 - DNA, 1746 bp, Artificial Sequence
  Description of Artificial Sequence: Synthetic coding sequence
atgcagcaggatggtctgggagtgggtactaggaacggctcaggcaaagggcgcagcgttcacccaagctggccatggtgcgctccacgtccactcagatatttcgggagagatgcgcgggccaggcgtgctcagactgccgccatggcgcttttggcaggggggctcagcagggggttaggaagccacccagctgctgccggcagagacgccgttgtatttgtgtggcttcttctctccacgtggtgcacagcgccagcaagagctatccaggttactgtgtccaatccttaccatgttgttatcctgtttcagcccgtcactctgccatgtacctatcaaatgacaagcacgcctacccagcctattgtgatatggaagtacaaatctttctgtagggaccgaatagccgacgccttttcacccgcctctgtagacaatcagttaaatgcccaattggccgcagggaacccaggatataatccgtacgtcgaatgtcaggactcggtaaggactgttcgcgtggtggccaccaaacagggtaatgctgtgacactcggagactactaccagggtaggaggatcacaataaccggaaacgctgatttgacatttgaccagacggcgtggggtgactcgggagtttactactgcagcgtagtttcagcccaggacctccagggcaataacgaggcttatgctgaactaatcgttctggtttatgcggccgggaaagccgctactagcggggttccgtctatctatgcaccttctacgtacgcccacttaagtccagccaaaacaccaccaccccccgccatgatccctatgggaccagcgtataatggttatcccgggggctaccctggagatgtggatcgcagtagctccgcgggcggccaggggtcttatgtaccacttcttcgagacaccgatagttcagttgcgagcgaggttagaagtggctatagaatacaggcatcccagcaagacgattctatgagggtgctctactatatggagaaggagcttgccaattttgacccgtctagaccgggccccccatccggccgtgtggaacgggcgatgagtgaagtgacgtcccttcacgaagatgattggagaagtagacctagtaggggcccggctttaacacccatccgagatgaagagtggggagggcactcgcccaggtctccaagaggatgggatcaggagccagcgcgggaacaggctgggggcgggtggcgcgcgagacggccccgtgccagaagtgtagatgcactggatgatctgactcctcccagcacggctgagtccgggtccaggtctccaacctctaatggaggtcggtctcgagcttatatgcctcctcggtccaggtctagggacgacctgtacgatcaggacgactcacgggactttccacgatccagggatccacactacgatgactttcgctcccgcgagcggccccccgccgatcctcgcagccatcatcaccgcacaagggacccaagggacaatggttccaggtcaggtgatcttccatacgacggacgtcttttagaagaggccgttcggaaaaaggggtccgaggagcgtcggcggcctcacaaagaagaagaggaggaagcctactatcctccagccccacctccatactccgagactgatagccaggcatcgagagaaagacggctgaaaaagaatttagcgttatcaagggagagcctggtggtgtag

SEQ ID NO: 5676 - DNA, 1959 bp, Artificial Sequence
  Description of Artificial Sequence: Synthetic coding sequence
atgccccctccactgcctctgcttctcctgaccgtgctagtcgtggcagctgcccgccctggttgcgaatttgaaaggaaccccgccggggagtgccaccgcccacccgcagccgacagtgcgacctgcgtggatctacagctaaggacctgctcagacgccgcttacaaccacaccacatttcccaacctgctgcagcatcgtagctgggaggtggtcgaagccagtagtgagtatatcctacttagcgttctgcaccaactgcttgaggggcagtgtaacccagatctgcgacttctcggatgcgctgtcctggcccctcggtgtgaggggggatgggtgcggagaccctgcaggcatatttgtgaggggctccgcgaggtctgccagcccgccttcgacgcaatagacatggcctggccatacttcctagattgccatcgctatttcactcgggaggatgaaggatgctacgatcctcttgagaagttacggggcggcctggaagccgacgaggcattgccctccggtcttcccccgacatttattaggttctctcaccattcctacgcacagatggtacgtgtcttaagacggaccgctagcaggtgtgcgcatgtggcccggacatactccattgggcgctcttttgatggaagggaactcctagtcatcgagtttagctctaggccgggtcaacacgaactcatggaacccgaggtgaagctcatcggtaatattcatggaaatgaggtggccggtagagagatgctgatctatttggcccagtatctgtgctcagaatacctgctcggaaaccccaggatccagagattgctcaatactaccagaatccatctcctcccctcaatgaacccagatgggtatgaggtagctgcagctgagggagcgggctataacggctggacatccggccgacaaaatgcccagaacctagatctgaatagaaatttccccgacctgaccagtgaatattaccggctcgccgaaacgagaggagctagatcggatcatatccccatccctcagcactattggtggggcaaggttgcgccagaaacgaaagctatcatgaagtggatgcagacaatcccttttgtgttgagcgcgtctttgcatgggggagatctcgttgtgagctatccctttgacttctccaagcatcctcaggaggagaaaatgttctctccaacccctgatgagaagatgttcaaactgctgtcccgtgcttatgccgatgtacatcccatgatgatggaccgaagtgagaatcgatgtggagggaacttcttgaagagagggagtatcattaatggggccgattggtattccttcacaggtggaatgagcgacttcaattatctgcatactaactgctttgaaatcaccgtggaactcggatgtgtcaagtttccaccagaggaggcattgtatatcttatggcagcacaataaagaatcattgctcaatttcgtggaaaccgtccatcgcgggattaagggggtagtgactgacaagtttggaaagcccgtgaagaacgcacgcatttcagtcaagggcatccgccacgatatcactaccgctccagacggagactattggcggctgctgccacccggtatacatattgtgattgcacaagccccgggctatgctaaggtcatcaagaaagtgattatacctgcaagaatgaaaagagctggccgtgtggatttcatcctgcagcccctcggcatgggccctaaaaatttcatccatggactgcggcgcacaggccctcacgaccctttgggcggcgcttcctccctgggcgaagcaaccgaacccgatccactaagggctaggcggcagccatccgcggatgggagtaagccgtggtggtggagctattttactagcctgtccactcaccgccctaggtggctccttaagtactag

SEQ ID NO: 5677 - DNA, 279 bp, Artificial Sequence
  Description of Artificial Sequence: Synthetic coding sequence
atgaagctatgtgttaccgtgttgagcctccttgtccttgtggccgccttttgcagtctggctctgtccgccccaatgggatcagatcccccaaccgcctgttgtttcagttatacagccaggaaactccctagaaacttcgtggtggattattatgaaacttcttctctgtgcagccagcctgccgtcgtcgggtttttgggtcggaagggcaaacaggtctgcgcagacccgtcagaatcatgggtacaagaatacgtgtacgaccttgaactgtag

SEQ ID NO: 5678 - DNA, 249 bp, Artificial Sequence
  Description of Artificial Sequence: Synthetic coding sequence
atgagacagcgattgctaccctcagtcacttccctcctgctagtggcgctgctgttccctgggagtagtcaggctcgccatgtgaatcattccgccacggaagctcttggagaactgagagaacgtgctcccggacaggggacgaacggatttcagttactgcgacacgccgtgaaacgagatctgctgccaccccgcacgcctccataccagggcacggggcaacaacacaggcagagatgcgggtag

SEQ ID NO: 5679 - DNA, 411 bp, Artificial Sequence
  Description of Artificial Sequence: Synthetic coding sequence
atggacaacgtgcagcccaagataaagcacagacctttctgcttcagcgtgaagggtcacgtcaaaatgctgaggctggccttgaccgtgacatcaatgaccttctttatcatcgcccaggcccctgagccctacatagtcatcaccgggtttgaagttaccgtgatcctgtttttcatcctcctatatgtactaagactcgatcggctcatgaagtggctgttttggccgttgttggacatcatcaattcgttagtcactacggtgtttatgctcatcgttagtgttctggcactcattccagagaccaccaccctcaccgtcgggggcggagtctttgcgctagttactgctgtgtgctgtctggcagatggcgcactgatctaccggaagcttctcttccttagatag

SEQ ID NO: 5680 - DNA, 1068 bp, Artificial Sequence
  Description of Artificial Sequence: Synthetic coding sequence
atgcagctcacgacctgcctgagagagaccctctttaccggcgcctcacagaaaaccagcctctggtggctgggcattgcaagtttcggggtgccggaaaagcttggttgcgccaacctgcctctcaacagccgacagaaagagctgtgtaagaggaagccctaccttctgccctctattcgcgagggcgctcggctgggtatacaagagtgcggctcacagtttcgacatgaaaggtggaattgcatgatcactgcagccgcgaccaccgccccgatgggtgcctcgccccttttcggctacgagctctcaagtgggacaaaagaaaccgcctttatatatgccgtgatggcagccggactggttcacagtgtcaccagaagctgcagtgccggcaacatgaccgaatgcagctgcgacacaaccctgcagaatggggggtccgctagtgagggatggcattggggaggttgctctgatgatgttcagtacggaatgtggttcagcaggaagttcctagacttccctattggtaacactaccggcaaggagaacaaggtgctgttggcaatgaacctgcataacaatgaggcggggcggcaggctgtcgccaaactgatgagcgtcgactgtaggtgtcatggtgtctctgggagttgcgctgttaaaacctgctggaagaccatgagcagcttcgagaaaatcggccacctgctcaaggacaaatacgaaaatagtattcagatctccgataagaccaagcggaagatgagacggcgcgaaaaggatcaaaggaagatacctattcacaaggacgaccttctctacgtgaataagtccccaaattactgtgtggaggacaaaaaactgggtattccaggcacccagggcagggagtgcaaccgaacatcggaaggggccgacggctgcaatcttctctgttgcggacgcgggtacaacactcacgtggtcagacatgtcgaacggtgtgagtgcaagtttatatggtgctgctacgtccggtgccggcgatgcgaatccatgaccgatgtccatacctgcaagtag

SEQ ID NO: 5681 - DNA, 2916 bp, Artificial Sequence
  Description of Artificial Sequence: Synthetic coding sequence
atgcttcggcgcccggctccagcgttggctccggcggccagactgttgctagctgggctgctgtgtggcggaggcgtctgggccgccagagttaacaagcacaaaccctggcttgaacccacataccatggtatagtgacagagaatgataatacagttctactggatccacccctaatagccctggacaaggacgctcccctaaggtttgctggcgaaatatgtgggtttaaaatccatgggcagaatgtgccctttgacgctgtcgtggtggacaagtctaccggtgaaggggtgatcagatccaaggaaaagcttgattgtgagttacagaaagattactcctttaccatccaggcgtatgattgcggcaaagggccagatggcacaaatgtcaagaaaagtcataaagcgacagtacacattcaggtaaatgacgtgaatgaatacgcaccagtgttcaaagaaaaaagctacaaggcaaccgttatagaggggaagcaatacgattctatcctgagagtagaggccgtcgacgccgactgttcccctcagttctcccagatttgttcctacgagatcatcacccccgacgtgcccttcacagtagacaaggatggatacatcaagaatacagaaaagctgaactatgggaaggaacatcagtataagctgaccgtaactgcttacgactgcggcaagaagcgggccactgaggacgtgttggtgaagatttctatcaagcctacttgtaccccgggctggcaaggttggaacaaccgcattgaatatgagcccggtaccggggcccttgcagttttccccaatatccacctcgaaacctgcgacgaaccagtcgctagcgtacaagctacggtagagctcgaaactagccacatcgggaaaggatgcgaccgcgacacctacagcgaaaagtctcttcatagattgtgtggagctgccgccgggacggctgaactgctgccatctccctcagggtcccttaattggactatgggcctgccgaccgataacgggcacgactccgatcaggtattcgagtttaatggaactcaggccgtgcgaatccccgatggggtggtttccgtttcacccaaagagcctttcactatctcagtttggatgagacacggccctttcggacgcaagaaagaaaccatcctgtgctcttctgataagaccgatatgaacagacaccattactctctgtacgtccacggatgccggctcatttttctttttcggcaggaccccagcgaagagaaaaaatatcggcccgcggaattccattggaagctgaatcaggtgtgtgacgaggaatggcatcactacgtcctcaacgtagagttcccgtccgtgaccctctacgtggatggaacttcccacgaaccgttctctgtgacagaggactacccactgcacccttccaagattgagacacagttagtagtcggagcctgttggcaggagtttagcggcgttgagaacgacaacgaaactgagcctgtgacggtagctagtgctggaggagacctgcacatgactcagttcttccgtggtaatcttgccggcctgacattgaggtctggaaagctggccgataagaaagtgatcgattgcctgtatacatgcaaagaaggtctagatctgcaggttctggaagattccggtcgcggagtacagattcaggcccatccctcgcagttggtactcactttggaaggagaggatctgggggagctggacaaagccatgcagcacatctcctacctcaattccaggcagtttccgacgccgggtatacgtagattgaagatcacctcaactataaagtgcttcaacgaagccacttgtataagtgtgcccccagtggacggatacgttatggtcttacaacccgaggagcccaagatttccctctctggagtacatcactttgcccgcgcagcttcagagttcgaatcctctgaaggtgtgtttttgttccccgaactgcgcatcatttcgacgataaccagagaagttgagccagagggcgacggggccgaagatccgacggtacaagagtctcttgtgagcgaagagatcgtgcacgatctggatacatgcgaagtaacggtggagggagaagaacttaaccatgagcaggagtccctggaggtcgacatggcgagactgcagcagaagggtatagaggtgtcctcatctgaactggggatgacctttactggcgtggacactatggcatcatacgaggaggtgctgcatctgctcagatatcggaattggcatgcgcgaagcctgctggacagaaagttcaagctgatttgctccgagctgaatggacgctacatcagtaatgaatttaaggttgaggtgaacgtgatacatacagctaatcctatggaacatgccaaccacatggcggcccagccccaattcgtgcacccggaacatcggtcttttgtcgacctctctgggcacaatctcgcgaaccctcaccccttcgccgtcgtgccgtctaccgcaacagtggtaattgtggtgtgcgtgagttttttggtgttcatgattattctgggagtattccgcatcagggccgcccacagacgtacaatgcgtgatcaagataccggcaaagagaacgaaatggactgggatgatagcgcactcactatcactgttaatcccatggaaacctacgaggaccagcattcttccgaggaagaggaggaagaggaggaagaggaagagagcgaagatggtgaagaggaggatgatatcaccagcgctgaatcagagtcttcggaggaggaagagggggaacagggggaccctcaaaatgccacgcgacagcagcagctagagtgggatgacagtaccctgagctattag

SEQ ID NO: 5682 - DNA, 564 bp, Artificial Sequence
  Description of Artificial Sequence: Synthetic coding sequence
atggtcgctgcaaccgtcgctgcagcatggctgctgctgtgggctgcggcttgtgcgcagcaggagcaagacttctatgatttcaaggccgtgaacatacgcggtaagttagtgagtctggagaagtatagaggaagcgtgagtcttgtagtgaatgtggcctctgaatgtgggtttactgatcagcactacagggcactgcagcagctgcagagagacctgggtcctcatcactttaatgttctcgcttttccatgcaaccaatttggacagcaagagcctgattccaataaggagattgaatcctttgccaggaggacctatagcgtgtcattcccaatgttcagtaagatcgcggttaccggtaccggagctcatcctgcttttaaatacctagctcagacttccggcaaagagccgacatggaacttctggaagtacctggtggctccagacggcaaggtggtcggagcttgggatccaacggtgtccgtcgaagaggttagaccccaaataacagctctggttcgcaaacttatcctgctgaagcgggaggatctttag

SEQ ID NO: 5683 - DNA, 303 bp, Artificial Sequence
  Description of Artificial Sequence: Synthetic coding sequence
atgtggggtttccttgttttgaaggcccggtggttggtgacgccagtacggactctggccacagaggcgggccagaagccttccttaagagggctactcgacgtgggcaacatccagcatagggctgccagagcacgcggactgacgcgaggcgttatcagagtgagccctcaagagcgaagccagcagaaccagtccgccccaaaaggccctacacccagcactcgacctaagccccggacccttggcccccaggcccacagcctggctttacaatccgtcgacctgctctttcgcccatag

SEQ ID NO: 5684 - DNA, 2352 bp, Artificial Sequence
  Description of Artificial Sequence: Synthetic coding sequence
atgcgatggcagtgcggaactaggttcagagggctgaggccggcggtagctccctggactgccctgttagctcttgggctgccgggctgggtgctagcagttagcgccacggcagctgccgtggtgcctgagcaacatgcctcagtggccggacagcacccactcgactggctgctgaccgaccgtgggccctttcatagggctcaggaatatgcagattttatggaaaggtaccggcagggcttcacgacacgatatagaatctacagagagttcgccaggtggaaagtgaacaacctggccctcgaacggaaggacttcttctctttgccccttccactggcacctgagttcattagaaatattcggctgctagggcggcggccaaatctacaacaggttacagagaatctgatcaaaaaatatggcacccactttctcctctccgctacgctgggaggcgaggaatcactcactatttttgttgacaaacaaaaactgggaagaaaaaccgagaccactgggggcgcaagcattatcggaggaagcggtaactccacagccgtaagcttggagacgctccaccagcttgccgctagttattttattgacagagaaagcacactgcgccgcttacaccacatccagatcgccacaggggctataaaagtgacagaaacgcgcaccggcccacttggttgtagtaactatgacaacctggactccgtctctagcgttctcgtacagtctcccgagaataaggtgcaattgcttggcttgcaggttctgctccccgagtacctgcgcgagagatttgtggctgctgcattgtcatacattacttgttcctcagaaggggagctggtatgcaaggaaaatgactgttggtgtaaatgctcgcccacgtttcccgaatgtaactgccccgacgcggatatccaagcaatggaggactctctattgcagattcaggattcctgggctacccacaatcggcagttcgaggagtccgaggaattccaggcactgttgaagcgattgccggatgatagatttctgaattccacagcgatttcgcagttttgggcgatggataccagcctgcagcaccggtaccaacagcttggggcaggccttaaggtactcttcaaaaaaacccataggattttacgcaggctcttcaatctatgtaagagatgccacagacagcctagattccgccttcccaaagagagatctctgagctattggtggaatcgcatccagtcgttgctgtattgtggtgaatctacttttcccggaaccttccttgagcagagtcacagctgcacatgcccatatgatcagtcttcctgccagggtccaatcccttgcgccctgggtgagggcccagcatgcgcccactgtgccccagataatagtacacgatgtggatcctgtaatccagggtatgtgctcgctcagggactctgtcggcccgaggtcgccgaatctctggaaaattttctcggactggagaccgacctccaggatttagaactaaagtacctgttacagaaacaggattcccgcattgaggtgcatagtattttcatcagcaacgatatgagactgggaagctggtttgatcctagttggcgcaaacgcatgcttctaactttgaaatctaacaaatataagccaggcctggtacacgtgatgttggccctctcactgcagatctgtctgactaagaactccaccctagaaccagtgatggcgatatacgtgaacccattcggcgggtctcattccgaatcatggttcatgccagtgaatgagggtagctttcctgattgggagaggacaaacgtggacgctgccgcacagtgtcagaattggaccatcacactggggaacagatggaagactttctttgaaacggttcacgtttacctgcgtagccggattaagagcctggatgactcctcgaacgagaccatctactacgaacctcttgaaatgacagacccaagcaagaatcttggatatatgaagattaatacgttgcaggtctttggctattccctcccattcgatcctgacgccattcgcgacttaatactacagctggactatccatatacccaagggagtcaggactcggcccttttacagcttattgaactacgcgacagggtgaaccagctcagcccaccgggcaaagtgaggctagatttgttctcttgccttctgcggcaccgcctgaagctggccaacaacgaagtcgggcgtatccaaagtagcctgcgagctttcaattcaaagctaccaaatccggtggaatatgagaccggtaaactgtgttcctag

SEQ ID NO: 5685 - DNA, 2016 bp, Artificial Sequence
  Description of Artificial Sequence: Synthetic coding sequence
atggctcagttgtttctgcccctcctagccgcactggttttggcccaggccccggccgcgctggcggatgtactggagggcgattcttcagaagacagagcctttcgggtccggatagctggtgatgccccacttcagggcgtgctcgggggagccttgaccatcccctgccatgttcattatctgcggccccctccatcccgccgggctgtgctaggttcccctcgcgtgaagtggacatttctaagccgcggtagggaggcggaagtgcttgttgcaagaggagtgcgggtcaaggttaacgaggcatatagatttagagttgccctccctgcttaccccgcctctctgactgatgtttctctcgctctgtctgagctgcggcctaacgatagtggtatctatcgatgcgaggttcagcatgggatcgacgacagcagcgatgccgtggaggtaaaagtgaagggcgtggtgtttctgtacagagaaggatctgcgaggtatgcatttagcttttccggcgcccaggaggcatgcgctcggataggcgcacatatagctacaccagaacaactttacgctgcatacctcggcggttatgagcaatgcgacgccggatggctgtcagaccaaacggttcgctacccaatacagaccccacgcgaagcatgttatggcgatatggatggctttcccggcgtgaggaactatggcgtagtcgaccccgatgatctctatgacgtctattgctacgctgaggatctgaacggagagctgtttctgggtgatccgcccgagaaactgacattggaggaggctagggcttactgtcaagagcgcggcgccgagattgcaacaacaggacaactttacgcggcttgggatggcggcttggaccactgttctccgggttggctggctgacggaagtgttaggtacccaattgtcacaccctcacagaggtgtggaggcggcttgccaggcgtgaagaccttatttctgtttccaaatcagactggatttcccaacaaacacagtcggttcaacgtgtactgtttcagagacagtgcacagccttccgcaattcctgaagctagcaaccctgcttcaaaccccgccagcgacgggctagaagcgattgttacggttacagagacactggaggaactgcagctgcctcaggaggcgaccgagtcagaatctaggggcgcgatttatagcatccccattatggaagatggcgggggtggctcttccactccggaagaccctgctgaagcacctcgaacactgctggagttcgagacacagtctatggttccacctaccgggttttcggaagaggagggtaaggccctggaagaagaggaaaaatatgaagatgaggaagagaaggaggaggaggaggaagaggaagaggtggaggacgaagccctgtgggcctggccatccgagctgagctcacctgggccagaggccagcttacctacggagccagcggcacaggaggagtccctgagccaagcaccggcaagggctgtacttcaaccaggcgcatcccccctaccggacggcgaaagtgaagcctcccgccccccccgtgtgcacggaccccctaccgagacactccctacgccacgggagcgaaacctcgcatccccctctccctccactttggtagaagctcgcgaagtcggggaggcaaccggggggcctgagcttagcggagtgccgcgcggggagtctgaggagaccgggagcagcgagggggcaccaagtttgcttcccgccactagagcccctgaaggcacgcgtgaacttgaagctcctagtgaggacaacagtggtagaactgcacccgcaggcacgtccgtccaagcccagcccgtgctgcctacagactctgctagccgtggtggggtggctgtggtaccggcctccgggaacagcgctcaaggctcaactgcactgtcaatcctgctgctgttctttccactgcaattgtgggtcacgtag

SEQ ID NO: 5686 - DNA, 375 bp, Artificial Sequence
  Description of Artificial Sequence: Synthetic coding sequence
atgtataaactggcctcatgttgcctcctgtttatagggtttctaaaccctttgttgtccctgccgctgctggactcacgagagatcagctttcagctgagtgctccccatgaggacgcacggctgacgcctgaagaacttgaacgggctagcttattacagattctgcctgagatgttaggggctgaacgtggcgatatcctcagaaaggcggactctagcacgaacattttcaacccacgcggaaacttgaggaagttccaggatttctccgggcaggacccaaacattctgctgtctcatctcttagctcggatttggaaaccgtataagaaaagagagacacccgactgtttttggaaatactgcgtttag

SEQ ID NO: 5687 - DNA, 1326 bp, Artificial Sequence
  Description of Artificial Sequence: Synthetic coding sequence
atggagtttgaattcgaccgactaagggcatttcaggcgatgcaggtgcactgtaataacatgcacaccctgggggcaaggctgcccggaggggtggaatgccgtttccgcaggggccctgccatggcgtgggagggggaaccaatgcgccataacctcggtgggaacttaggcgatccacgggcccgagccgtgtcagtgcccctgggtggccgggtggcgcgttttctgcagtgccggtttttgttcgccggcccatggctgctgtttagtgagataagttttatctctgatgtggtaaataatagttctccagccctgggcggcacctttccacccgcgccctggtggcctcccggtccccctcctactaacttctcttctctggaactggaaccgagggggcagcagccagtcgctaaggctgaaggatccccaaccgccattttaattggatgcttggtagctattatcctcctgctgctgttgatcatcgctctcatgctgtggcgtctccattggcgtcggttgctgagcaaagtccttgagagtcacccccgcacaagatcgccaggcctggtagggattcgacctacaccgcttccggtgtcccctatggctctgagatgttgttcaccaattcaaccaacggctagcttctggccactgacccctgtcccactcgaggcacgagctccacctcacccgccggggcccaaccctcctactcccagaggcgtgacaggaggcaacacctatgcagtgcctgctctaccccctggcgcagtaggtgatggtcccccccgggtggacttcccaagatctcggcttcggtttaaggagaaactgggcgagggccagttcggggaggtccacctatgtgaggttgattcaccccaggatctggtctcccttgacttcccactgaatgtaaggaagggccatccgctactggtcgctgttaagatcctgcggccggacgccactaagaacgctcgcaacgacttcctgaaggaggtgaaaatcatgtctagactcaaggatcctaacataattcggttgttgggggtgtgtgtgcaggatgaccctctgtgcatgattacagactatatggaaaatggggaccttaaccagttcctatctgcccaccaactggaagataaggccgcagagggcgccccaggcgatgggcaggctgctcagggccccacaatctcttacccaatgcttctccatgtggctgcccagatcgcttccgggatgcgatatcttgccaccctcaacttcgtgcatttctggggtgagcggcaccggtttcttcactag

SEQ ID NO: 5688 - DNA, 1950 bp, Artificial Sequence
  Description of Artificial Sequence: Synthetic coding sequence
atgcagcaggacggcttaggggtcggaacacgtaatggcagtggtaaaggaaggagcgtgcatcctagttggccgtggtgcgcacctcggcccctgagatatttcgggcgcgacgcccgagctaggcgcgcacagacggccgcgatggctctgctagcaggaggattgagccgcggtctcggatctcacccggctgcagctggcagggacgcggtcgttttcgtgtggctccttctctccacctggtgtaccgctcctgctcgcgctattcaagtcacagtaagtaacccatatcacgtcgtgattctatttcagcctgtgaccttaccttgtacttaccagatgacatcaacacccacccagccgatcgtgatctggaaatacaagagtttctgccgagacagaatcgcagacgctttttcccctgcctcagtcgataatcaactcaacgcacaactggccgctggtaaccccgggtacaatccttacgtggaatgccaggattcagttcgcactgttcgcgtggtggcaactaagcagggtaatgcggtgactcttggcgactattaccaaggaagaaggattacgattacaggcaatgccgacctgacctttgatcagaccgcctggggggattctggcgtgtactattgctcggtagtgagtgcccaagacctacaggggaacaatgaggcatacgcagagctcattgttctgggtcgaacatccggggtggcggagctcttgccaggattccaggcagggcccatcgaggactggctgttcgtagtcgtggtttgtcttgccgccttccttatctttttgctgctgggaatctgctggtgtcagtgttgtccccatacgtgctgttgttacgttcgatgcccatgctgccctgacaaatgttgctgtccggaggccttgtatgcggccgggaaggcggcaacttcaggcgtgccttctatttatgcacctagcacgtatgcacatctgagcccggctaaaaccccccctcctcctgctatgattccaatggggcccgcatataacggatatcctggcggctatccaggcgacgtggatcgctcgtcctcagctgggggtcaaggctcttacgtcccactgctccgggacaccgattcttctgtcgcatccgaggtgaggagcggctaccggatccaagctagtcagcaggatgactcaatgagagtgttgtactatatggagaaggaactggccaacttcgaccccagcagacccggaccaccatcagggagagtggaacgggccatgtccgaggtcacatcactgcacgaagacgattggcggtcccgcccatcacggggtccagccctcacacccatccgcgacgaagagtgggggggacactcaccacggagccctagaggttgggatcaggagcccgcaagggagcaagctgggggtggatggcgcgccagacgcccacgggctaggagcgtagacgctctggatgacttaacccctccatcaactgctgagtccggctcacggtcaccaacttccaacggcgggaggtccagggcttatatgccacccagatccaggtccagggacgacctatacgaccaagatgactcccgggacttcccgaggtcgcgagacccacactatgacgactttagatcccgcgaaagacccccagcagacccaaggtctcatcatcaccggacaagagaccccagagataacgggtcaagaagtggagatctgccatatgatggccggcttctggaggaagccgtgaggaagaaggggtctgaggagcggcgccgtccgcataaggaggaggaggaggaagcctactatcctcctgcgccccccccttacagtgaaaccgattcgcaggcatcaagggaaaggaggttgaagaaaaacctggcactgagccgggagtcactggttgtctag

SEQ ID NO: 5689 - DNA, 402 bp, Artificial Sequence
  Description of Artificial Sequence: Synthetic coding sequence
atgtcggaaagggttgagaggaactggtctaccggaggatggctgcttgccctctgcctggcttggctgtggactcacctgacactggcagcactgcagccacccacagcaacagtcctggtacaacagggcacctgtgaggttatagcggcccatagatgttgcaatcggaaccgcatcgaggagcggtcacaaacagtgaagtgtagttgtttcagcgggcaggtggctggcaccaccagagccaaacctagctgtgttgatgcaagtatcgtcctgcagaggtggtggtgccagatggaaccatgcctccccggtgaggaatgcaaagtcctgccagacctgtctggatggtcttgctcttcagggcacaaggtgaagacaacaaaagttacaaggtag

SEQ ID NO: 5690 - DNA, 699 bp, Artificial Sequence
  Description of Artificial Sequence: Synthetic coding sequence
atggtggccgcaaatactcgggccccagaggacacgcgcgctccggccggacccaagccatcttcgtgcgagtgggcagtgtgctgggcaccagctagatgtagaattagcgccaccgcttgcggtaatagctgggatcgacctgccggccggacacagctgctgtggacgcccgcggcccctaccgccatggctgaggtaggacccggccacacccccgcacacccaagtcaaggggctgtgcccccatcccgtgctgcagcagagccgcatttgaagccttccccttcagaactgcagaccgccggtcctgccgccaccataccagctcgcttatgtacacgcaaacccagacttgtttatacccagtgttggtatgtcaaagagccaaaacaccctgagattgtgaccccgtgggggacggcagccaggcatagctggcgccagcatcaaatgctcagtgcgtccgaaaggagatgtctccccagggatgtcgaacagaagttgggaccagagcatactggcccctgcttagatgagcaaggacgtgaggctgaactggcaaggagcggcccttctgctgctggcccagtgcgtcttaaaccaggactggtgcctgggctgttcctgttgagttgcactacttctccttcaacgtgcctgcctgtgggccaggagggcgaaaggggaatgctgtag

SEQ ID NO: 5691 - DNA, 711 bp, Artificial Sequence
  Description of Artificial Sequence: Synthetic coding sequence
atgtgcgtcacctaccacaacggaactgggtactgcaagtgcccggagggcttcctcggagagtattgtcagcatagggacccatgcgagaagaatcgctgccagaatggaggcacctgtgttgctcaggcgatgctaggaaaagctacctgccgctgtgcctctgggtttacaggagaggattgtcagtactcaacctcccacccttgcttcgtgagtcgcccgtgtttaaacgggggtacgtgccacatgctcagccgggacacttacgagtgtacctgtcaggtcggctttacaggaaaggaatgccaatggactgatgcgtgtttatcacacccctgtgccaacgggtccacatgcaccactgtggccaaccagttctcctgcaaatgcctgaccgggtttactggacaaaaatgcgaaactgatgtcaatgagtgcgacatccccgggcattgtcagcatggcggtacttgcttgaacctgccaggatcttatcaatgccaatgtcttcaggggtttaccggccaatactgcgacagcctatacgttccatgtgcaccctccccttgtgtgaacggagggacatgtaggcagaccggtgactttacctttgaatgcaattgccttcccgaaaccgtccgacgaggcacagaattgtgggaacgtgaccgcgaggtgtggaatggtaaggaacacgacgaaaactag

SEQ ID NO: 5692 - DNA, 204 bp, Artificial Sequence
  Description of Artificial Sequence: Synthetic coding sequence
atggacaatgtgcaaccgaaaatcaagcaccggcccttctgcttcagcgtgaagggacacgttaagatgctccgattggtgtttgccctggttactgctgtttgctgcctggccgatggggctctgatctacaggaagctgctatttaacccttccggtccctaccaaaagaaaccggtgcacgagaagaaggaagttctatag

SEQ ID NO: 5693 - DNA, 75 bp, Artificial Sequence
  Description of Artificial Sequence: Synthetic coding sequence
atgcttgtggacggcccctccgagagacccgcactgtgctttctcctactcgccgttgccatgtcctttttttag

SEQ ID NO: 5694 - DNA, 3345 bp, Artificial Sequence
  Description of Artificial Sequence: Synthetic coding sequence
atgctagctagctctagtcggatccgtgccgcatggacgcgggccctgttgttaccgctactcttggcgggtcccgtgggttgtctgagtagacaggaactgtttcccttcggtcccggccagggggatctggagctggaggatggggacgactttgtgtcgccagccctggagctgtccggggcactgcggttctatgacagatctgatatcgacgcagtttatgtgacaactaacggcattatcgccacaagtgagccccctgctaaagaatctcatcccggtttattcccccccacttttggagcagtggcgccctttcttgctgacctggacactacggatgggctggggaaggtgtattacagagaagatctctctccatccattactcaaagggcggcagagtgtgtccatcgaggcttccccgaaatcagtttccagccaagctcagcagtggtcgtcacctgggaatcagtggctccctaccaaggcccatctcgggatcccgatcagaaggggaaaagaaacacctttcaggcagtgttggcatcctctgattcaagttcctacgcgatctttctctatcctgaggacggactgcagttccacacgaccttttcaaaaaaagagaacaatcaggtgccagcagtagtggcattctctcagggtagtgtagggtttctctggaagtccaacggtgcttacaatatcttcgctaatgatcgggagagcgtcgaaaatctggctaagagcagcaattctggccagcagggtgtctgggtgttcgaaatcggatcccctgcaaccacaaacggcgtggtgccagcagacgtgatcctgggcaccgaggacggcgcagagtacgacgatgaggatgaagattatgatttggcaactaccaggctcggcctggaagatgttgggacaacccctttcagttacaaagcgttacgacgggggggggccgatacttactctgttccttctgtgcttagcccgcgccgtgccgccaccgaacgtcctctcggcccgcccacggagaggactagatcttttcagctcgctgtggaaaccttccatcagcaacatcctcaggtcattgatgtggacgaagtagaggaaactggagtcgtttttagttataacactgattcccggcagacttgcgctaataaccgtcatcagtgcagtgtccatgcagagtgcagagattacgctaccgggttctgctgctcatgcgtggctggctatacaggtaacggtcgccaatgcgtggcagagggctccccccagcgcgtgaacggaaaagttaagggtaggatattcgtgggtagcagtcaagtgcccatcgttttcgagaacactgatctgcacagctacgtggtcatgaatcacggccggagctacactgccatctccactatccctgaaaccgtggggtactctctgctgccgctggcccccgtaggagggatcattggctggatgtttgcagtggagcaggacggcttcaaaaatgggttcagtatcacggggggagagttcactcgacaggccgaggtaaccttcgtgggacatccgggtaacctggtgatcaagcaaagattcagtggaatcgatgaacacgggcacctgaccattgacactgaattggaggggcgcgttccgcagattccttttggaagctcagtccacatcgagccctacactgagctgtaccattactcaacgtctgtcattacatcaagctctacccgggagtacacagtgactgagcctgagcgtgatggtgcgagtccaagtagaatctatacatatcaatggaggcagacgatcacatttcaagaatgcgtgcatgacgattcccggcccgctctgccgtcgactcagcagctctctgtggacagcgtatttgtcctatataatcaggaggagaagatcctcaggtatgccctgagtaatagcataggaccagtgcgggaaggatctcccgacgcgctccaaaacccttgctatatcgggactcatgggtgcgataccaacgccgcgtgcagaccgggcccccgcactcagtttacgtgtgaatgttccattggcttccgtggtgacggcaggacctgttatgaagtggagaagacgcggtgccagcatgagagggagcatatcttgggtgccgcaggagctacagatccccaaagacctattcccccaggactctttgtccctgaatgtgacgcacatgggcactacgcacctacacaatgtcatggctcaaccggatactgttggtgtgtagacagagacggcagggaagtagaagggacaagaacccgtccggggatgacaccaccctgcctctccacggtggccccccctatccaccaagggcccgctgttccaacagcagtgatccccctgccacctggtacgcacctgctattcgcccagacagggaagattgaacggttgccactcgaggggaacacgatgcggaaaactgaggctaaggcatttttgcacgtgcctgcaaaggttatcattggactggcttttgactgtgtggacaaaatggtctattggaccgacatcacggaaccatctatcgggcgcgcttcattgcacggtggcgagcctaccaccattatccgacaggacctgggcagtcccgagggtatagccgtggaccatctgggtcgcaatattttctggaccgattccaatttggaccgcattgaggtggctaagctggacggcacccagcggcgagtgttgtttgagaccgatctagttaatcccaggggcattgttactgactcagtaagagggaacctgtactggaccgactggaaccgcgacaaccctaaaatcgagacttcctacatggacggcaccaaccgtagaatcttggtgcaagacgacttaggactccccaatggactgactttcgacgcattctctagtcaactgtgttgggtggatgccggcactaatcgagcagagtgtctgaacccctcccagccatcccggagaaaggcgttggagggcttacagtatccattcgcagtcaccagctacgggaagaatttatatttcactgattggaagatgaatagcgtggtggcactggatctggccatttccaaggagaccgacgccttccaaccccacaagcagacacggctctatggcataactaccgcccttagccagtgccctcaaggtcacaactactgctccgttaacaacggtggctgcacccacctgtgtcttgcgactcccgggagcagaacctgccggtgtcctgataacacattgggagtggattgcattgagcagaagtag

SEQ ID NO: 5695 - DNA, 2172 bp, Artificial Sequence
  Description of Artificial Sequence: Synthetic coding sequence
atggggtcccggtgcgccctggctctcgctgttcttagcgccttgttatgtcaggtgtggtcgagcggcgtctttgagctaaaactgcaagagtttgtaaacaaaaagggattgctgggaaacagaaactgttgtcgtggaggggctggtccacctccatgtgcatgccgtacattctttagggtctgccttaagcactaccaagctagtgtttcccccgaacctccctgtacttacgggagtgcggtgacaccagtcttgggggtggactccttctccctacccgatggcgggggtgctgacagcgcattctccaaccctattaggtttccctttggctttacttggcccgggacttttagtctgatcatcgaggccctgcacactgattctccggatgatctggctactgaaaacccagagagactgatttcaaggctggcaacccagcggcacctgacagtcggcgaggaatggtcccaggacctgcattcctcaggccgcaccgaccttaaatactcctatagatttgtgtgcgacgagcattactatggtgaaggctgttcagtcttctgccgccccagagatgatgcgtttggacactttacatgtggcgagaggggagaaaaggtttgcaaccctggttggaaaggcccttactgcaccgaacctatttgcttacctggttgtgacgagcagcatggtttctgtgacaagccaggagagtgcaaatgcagagtagggtggcaggggagatactgcgatgagtgtattcggtatccgggttgtctgcacggaacatgtcagcagccgtggcagtgcaactgtcaagaaggatggggaggccttttttgtaatcaggatttgaattactgtactcatcacaagccatgcaaaaacggcgcaacctgcacaaatacaggtcagggatcctacacttgctcttgcaggccaggatacaccggggctacctgtgaactaggtatcgatgagtgcgaccctagcccttgtaagaatgggggctcttgcactgatctcgagaactcatactcatgtacatgcccacccggcttctacgggaaaatttgcgaactctcggcaatgacatgcgccgatggcccatgttttaatggaggccgctgcagcgactctcccgatggcggctactcgtgtcggtgtcccgtggggtatagtgggttcaactgtgaaaaaaaaattgactactgctcatcttctccttgcagtaatggagccaaatgtgtggacctaggggatgcctatctctgcaggtgtcaggcggggttttccggaagacactgcgatgacaacgtggacgattgcgctagttctccatgtgctaacgggggcacgtgtcgcgacggagtgaacgacttttcctgcacgtgccctccgggctataccgggcgtaactgtagtgctccagtgtcacgctgtgagcatgctccatgccacaatggcgcaacgtgtcacgaaagaggacatcgatacgtctgcgagtgtgctagaggctacgggggacccaactgccaatttctactgccagagcttcctcccggcccagccgtggtagacctaacagaaaagttggaggggcaagggggccctttcccatgggtggctgtttgtgccggggtgattctggttctcatgctgttacttggatgtgctgctgttgttgtgtgcgtcagactccgtttgcaaaagcataggccacctgccgatccatgcaggggggagactgaaaccatgaacaatctcgctaattgtcagagagaaaaagacatttccgtatccatcatcggagctacccagataaaaaacacaaacaagaaggctgactttcacggagaccattccgctgacaaaaatggattcaaagctagatacccagccgtggactacaacctggtccaggacctaaaaggtgatgatactgccgtgcgtgatgctcactccaagcgggataccaaatgtcagccccaaggctctagcggcgaagagaaaggcacccctaccacactaagaggtggcgaggcgtccgagcgcaaacgcccagacagcggctgcagcaccagcaaggacactaaataccagtctgtgtatgtcatatccgaggaaaaggatgaatgtgtgatcgccaccgaagtgtag

SEQ ID NO: 5696 - DNA, 981 bp, Artificial Sequence
  Description of Artificial Sequence: Synthetic coding sequence
atggccgctcctgcttccgttatgggtccactgggaccaagcgctctgggactcttacttctgctgctagtcgtggccccaccccgggtggccgcgctcgtccatcgacagcccgaaaatcaaggcatctcactgactggcagtgtcgcctgcggacgacccagcatggaggggaaaatcttggggggagtgcccgcccccgaacgtaaatggccgtggcaggtgtctgtccattacgcagggctccatgtgtgtggggggtctatcctgaacgagtattgggtcctgtccgcagcccattgcttccaccgcgataagaacatcaaaatctacgacatgtacgttggactggttaatctgcgagttgctggtaatcatacacagtggtatgaggtgaaccgggtgattctccatccaacgtacgaaatgtatcatccgattggaggagacgttgcattggtgcaactgaagacaagaatcgttttctcagagtccgtacttccagtgtgtctagccacgccagaagttaacctaacatccgctaactgttgggcaactgggtggggtctggtgtcaaagcagggagaaacctcagatgaactacaagagatgcaactgcccctgatcctcgaaccgtggtgtcacctgctgtatggtcacatgtcttatattatgccagatatgctgtgtgctggggatatactcaacgccaaaaccgtgtgtgagggcgacagcggaggccccttagtgtgtgagttcaacaggagttggctgcagatcggaatcgtgtcttggggccggggttgttctaatcctctgtaccctggggtctacgcgtccgtctcgtactttagtaagtggatttgcgataatatagagattactcccactccggcacagcctgcccccgctctcagccccgcactgggtccgacgttaagcgtcctgatggcaatgctggctggttggagcgtgttgtag

SEQ ID NO: 5697 - DNA, 1596 bp, Artificial Sequence
  Description of Artificial Sequence: Synthetic coding sequence
atgtctctggccgcctactgcgtcatttgttgccggcgcattggaacatccacctcgccgccaaagtctggcacacattggcgggatattagaaatattattaagttcacagggtctctgattctgggcggatctctcttcctgacctatgaggttctcgcactgaaaaaagcggtgactctcgacacccaggttgtggaaagggaaaagatgaaatcttatatctacgtgcatacagtcagcctagacaagggcgagaaccatggaattgcctggcaggcccggaaagaattgcataaagcggtacggaaggtgctcgcaacaagtgccaaaatactgcgaaacccttttgcagacccattttccaccgtggacatcgaggaccacgagtgcgcggtctggctattgttgaggaagtctaagtctgacgacaaaacgacacgccttgaagccgttagagagatgagtgagacgcaccactggcacgactatcagtaccgcattatcgcccaggcttgcgaccctaaaaccctgatcggactggcgaggagcgaagagagcgacctgcgtttttttctgcttccacctccattgcctagtctgaaggaagacagttccaccgaggaagagctgaggcagctgctggccagtctgccccagaccgagctcgacgagtgcatccagtatttcacatccctggctctgtcagagtcctcacagtctctcgcagcccagaagggggggttgtggtgcttcggcggcaacggcttgccttacgctgaaagcttcggcgaagtgccaagtgccaccgtcgagatgttttgcttggaagccattgttaagcattctgagatctcaacccactgtgataaaatcgaggcaaatggcggactgcagctgctgcagcgactctatcggctgcacaaagactgccctaaagttcagagaaatattatgcgagtgattggaaacatggcactcaacgaacaccttcactccagcattgtcaggtccggctgggtgagtatcatggccgaagcaatgaagtcgccgcatatcatggaaagctcccatgcggcaagaatcttggcgaacttagacagggagactgtgcaggagaaataccaggatggcgtgtatgtgttgcaccctcaatatcgaacatctcagcctatcaaagcagatgtgctcttcatccacggcctgatgggggcggctttcaaaacatggagacagcaggactcagaacaggcagtgatcgagaagcccatggaggatgaggacagatatacaacctgttggcccaaaacttggttggccaaagactgtccggccctgcgcatcatttccgtggaatacgacacatccctgagcgactggcgtgccaggtgtcccatggagcgccgctctttattgagcatatcctctgggattgttgaaggtctggagtccccactgcatagcgaggctaccaactttctggggtcttccgaactgttagttttgggaataggccagtggttcggatatcatatagcatgggaagtatttctgtcaaagagatgctgctggaaaccactgaggtctcaaaaatag

SEQ ID NO: 5698 - DNA, 1596 bp, Artificial Sequence
  Description of Artificial Sequence: Synthetic coding sequence
atgtccctcgcggcttactgtgtaatctgttgccgtcggattgggacgtctacatcccctccaaagagtggcacccactggagggacatcagaaatataattaaattcactggttcccttatcctgggagggtcactctttctgacctatgaggtgctggccctcaaaaaggccgtcactctggatacccaggtcgtggagagagagaaaatgaagtcatatatatacgtacataccgtgtcattggataagggtgagaaccacggcattgcctggcaggcacgaaaggagctacataaagcggtccgcaaagtgctggcaacgagcgctaagatcctacgaaaccctttcgcagatcctttttccacagtcgacatcgaggatcacgagtgcgcagtgtggctgctcctcaggaagtccaagagcgatgacaagacaacaagactggaggctgtgcgggagatgagtgaaactcaccactggcatgattatcagtatcggattatagcccaggcatgcgatccgaagacactaattgggcttgctaggtcggaagaaagcgacctacgatttttcttattgcctccccccctgccgtctctgaaagaagactcttcaactgaagaggaactccgacagctgctcgcatctcttccccagaccgagctggatgaatgcatccagtactttacatcgctcgccttaagcgagtcctcgcaaagccttgctgcccagaaaggcgggctgtggtgtttcggcgggaacggactgccatacgctgagtctttcggagaagtgcccagtgctacagtggaaatgttctgtctcgaagcaattgttaaacattctgaaatctccacacactgtgataagattgaggcgaatggtggtctgcaattgttgcagagactctatcggctacacaaagattgcccaaaagttcagaggaatattatgcgggttattggaaacatggccctgaacgaacatctgcacagcagtattgtgaggtctgggtgggtctccatcatggccgaggcaatgaagtcccctcacatcatggaatcttctcatgctgctaggattctcgcaaaccttgatagagagacggtacaggagaagtatcaggatggcgtttacgttctacatccccagtaccgaacaagccagccaattaaggcggacgtgctgttcatccatggactgatgggtgccgcttttaagacttggcgtcagcaagatagcgagcaggcggtgattgagaagccaatggaggatgaggacagatacaccacctgctggcctaagacatggcttgctaaggactgccccgccttgcgcatcattagcgtcgagtacgacactagcctgtcagattggagagccaggtgtcctatggaacgtagaagcttgctgagtatttcttccggcattgtggaaggattagaatcacctctgcatagcgaagccactaattttctcgggtcctcggaactactggtcctagggattggtcagtggtttggatatcacatcgcgtgggaagtgttcctgtccaagagatgttgttggaagcccttgcggagccagaaatag

SEQ ID NO: 5699 - DNA, 1965 bp, Artificial Sequence
  Description of Artificial Sequence: Synthetic coding sequence
atgagcctggcggcttactgcgtgatctgttgtcgacggatcgggacctctacgtcgccacccaaatccggaacacattggagggacatcaggaacattattaagtttaccggttctctgattctgggtggctccctgttcctgacttatgaggtcctcgcactcaaaaaagcagtgacacttgatacccaggtggtagagcgggagaagatgaagtcctatatctacgtgcacacagtgtctctggacaaaggcgagaatcatggtattgcttggcaagcgagaaaagaactccataaagcagtgcgcaaagtgctggccacctctgccaagattttgcggaaccccttcgcggaccccttttccactgtggacattgaggatcacgagtgtgctgtctggcttctcctgcgcaaaagcaagagtgacgataagactacgagactggaagcggtccgcgagatgtccgaaactcaccattggcatgattatcagtatcggatcatcgctcaggcttgtgaccctaagaccctgattgggctggcccgcagcgaagagagcgacctgcggttttttcttttgccaccccctctcccatccttaaaagaggattcatcaaccgaggaggaactgaggcagctcctcgctagcttgccacagacggagctcgatgagtgcatccaatacttcactagcctcgccctctcagagagctctcagtcactcgccgcccagaaaggcggactatggtgcttcggcgggaacggacttccctatgctgaaagcttcggggaggtgccttccgccactgttgaaatgttctgtttggaggcgattgtcaagcactctgagatctcgactcattgcgacaagatcgaggctaatggcgggctccaattgctccaaagactctaccggctgcataaagattgccctaaggttcagcgcaacattatgcgcgtgatcggcaatatggccctgaatgaacacctgcactcttccatagtgagatccggatgggtctccatcatggccgaagccatgaagagtccgcacataatggaatcctcccatgctgctcgcatcctggccaatttggacagagaaaccgtgcaggaaaaataccaggatggcgtatatgtgctgcatcctcagtatagaacatctcagccaataaaagcagacgtgttgtttattcatgggctgatgggggcggcttttaaaacttggcgacagcaagatagcgaacaggctgtgattgagaagcctatggaagacgaggaccgatacacaacatgctggcctaaaacgtggctggccaaggattgtcccgcgctcagaattatatcagtagaatatgatacatctctcagcgactggcgggcccgatgtcccatggagcggaagtcaatagctttccgcagcaatgaactactgcgtaagcttagggccgccggagtgggggatagaccagtagtttggatctcacactctatgggcgggttgctggtgaaaaaaatgctcctagaagccagtacaaagcccgaaatgagcaccgtaataaataacacaagaggtattatcttctattccgtcccccatcacggtagcagactggcagaatactccgttaacattcgctacttgctttttccatcactagaggtcaaagaactcagcaaggactctcctgccctaaagaccttgcaggacgatttcctggaattcgctaaagataagaattttcaagtgctgaatttcgtcgaaactctgcccacctatatcgggtccatgatcaagctccacgtggtgccagtagagtccgcagacctgggcattggagatttgatccctgtagacgtgaatcacttgaatatctgtaaacccaaaaagaaggatgcctttctgtaccaacggacattacagttcatccgcgaggccctggccaaggaccttgaaaattag

SEQ ID NO: 5700 - DNA, 1509 bp, Artificial Sequence
  Description of Artificial Sequence: Synthetic coding sequence
atggcacagcgctgtgtgtgcgttctcgcactggtagctatgctactccttgtgtttcctacggtatcgaggtccatggggcctcgcagcggggaacatcagagggccagccgcattccctctcaattttccaaggaagagcgggtcgcaatgaaggaggccctcaaaggcgctattcagatcccaaccgtaaccttcagcagcgagaagagtaacactactgccctggccgagtttggtaaatatatccacaaagtattcccaacagtggtcagcacttccttcattcagcatgaagtcgtggaggagtattcacacctgttcaccattcaagggtcagacccctctctacagccgtatcttctgatggctcattttgacgtcgttccggctcctgaggaaggttgggaggtcccccctttctctggtctcgaacgcgatggtatcatctacgggaggggcaccctagacgacaagaactccgtgatggcactgctacaggctctcgagctgttactgattagaaaatacatcccgcgccgtagctttttcatatctctgggacacgatgaggaatcctccgggaccggggctcagagaatctccgccctccttcagagcagaggagtacaactggcctttatcgtcgatgagggaggtttcatcctcgatgacttcatccctaactttaagaagcccatcgccttgattgctgtgtctgaaaagggtagcatgaacctcatgttacaagtaaacatgacctcaggccacagttccgctccaccaaaggagacctcgatcgggattttggccgcagctgtttcccggttggagcagactccaatgcccataatattcgggtcggggactgttgtgaccgtactgcagcagctggctaacgaattcccgtttcctgtgaatataattctgagtaacccttggctctttgagcctcttatctctagattcatggagcgcaatcctctcacgaacgccattatcagaacaactacagccctgacgattttcaaggctggggttaaattcaatgttatcccccccgttgctcaggcaaccgttaatttccgtatacacccaggtcagactgttcaggaggtgctggaattgacgaagaatattgtcgcagataatagggtacagttccacgtgctgtccgcctttgaccccctgcccgtttcaccgtcagacgataaggcgctgggctatcagctcctcagacagaccgtgcagtccgttttccctgaagtgaacattacagccccagttacgtcaataggcaatacagattctcgatttttcacaaatctcaccacagggatctatagattctaccccatctacatccagccagaagatttcaaacgcatacacggcgttaacgagaagatcagtgtccaggcctacgaaactcaggtgaagtttatctttgaactgattcagaacgctgacactgaccaggagcccgtctcccatttgcacaaactctag

SEQ ID NO: 5701 - DNA, 999 bp, Artificial Sequence
  Description of Artificial Sequence: Synthetic coding sequence
atgagactcctggcatttctgtctctactggctctggtgctccaggaaacagggaccgcatccttgccacggaaggaaagaaaacgacgcgaggagcagatgccccgcgaaggcgattcatttgaagtcctccccctccgtaacgacgtactcaacccggataactatggagaagtaatcgacctgtcaaactatgaagaactgacagactacggggaccagctgcccgaagtcaaagtgacttcgcttgctcctgcaaccagtattagtccggctaagtccactacggcaccgggtactccatctagtaatcccacaatgacaagacccacgacagcgggactcctgctgtcttcccaaccaaatcacggcctccctacttgtttggtctgcgtctgtttggggagctcagtctactgtgatgatatcgatctggaggacatcccacctttgcccaggcgaacagcgtatctctacgctcggtttaaccgcatttcccggatccgcgctgaggattttaagggcctgactaagctcaagcggatcgacctgtcaaataatttaatatcgtccatcgacaatgatgcgttccggcttctccatgcactgcaggacctgatcctgcccgagaaccagctagaggctctgccagtgctaccatcagggatcgagttcctggacgttcggctgaacagactgcaatcatctggtattcagcctgccgccttccgggctatggaaaagcttcagttcctgtacctcagtgataacctgctggattccattccaggccccctaccattaagtcttcggagcgttcatctgcagaataatctgatcgagacaatgcagagagatgtattttgcgatcctgaggagcacaaacacactaggcgtcagctagaggacataaggctggacggaaacccaattaacctttcactattcccaagtgcctacttctgcctacctaggttaccaatcggtagattcacttag

SEQ ID NO: 5702 - DNA, 1401 bp, Artificial Sequence
  Description of Artificial Sequence: Synthetic coding sequence
atggtgcggtcagtggcctgggccggctttatggtgttactcatgatcccatggggtagcgcagccaagcttgtgtgctacttcactaactgggcccagtatcgccagggggaggctcgcttccttcccaaagacctggatcccagcttgtgtacgcatctgatctatgctttcgcggggatgaccaaccaccagctctcaaccacagagtggaatgacgaaacactctatcaggagttcaatgggctcaagaaaatgaatcccaagctgaaaacattgctggcaatcggcggatggaattttgggacacagaagtttaccgatatggtcgccaccgcaaacaatagacaaacatttgtgaatagtgccatacggtttttgagaaagtactccttcgacggcctagacctcgactgggaatatccgggaagtcagggctcacccgcggtcgataaagagcgattcaccacattggtgcaggacttggccaatgccttccagcaggaggcacagacatccggaaaagagcgcctgctgctgagtgccgctgtacccgcaggacagacatacgtcgacgcggggtacgaagtggataaaattgcacagaaccttgatttcgtcaacttaatggcttacgacttccacggatcatgggagaaagtcacaggccacaatagtccgctgtacaagcggcaagaagagtctggggcggcagcatcccttaacgtggacgccgccgttcagcaatggctgcaaaagggaacccctgctagcaagctaattcttggcatgcccacctatggacgttcttttacactggctagtagctcggatacgagggtcggtgcccctgctacaggttccgggactcctggccctttcacgaaggaggggggcatgctagcatattatgaagtatgttcctggaaaggcgcaacaaaacaaaggattcaagatcaaaaagttccttatattttcagggacaatcagtgggtcggcttcgatgatgtcgaaagtttcaagaccaaggttagttacctcaagcagaaaggtttaggcggcgctatggtgtgggcccttgatttggacgacttcgccggcttttcctgcaaccagggacggtatcccctgatccaaaccctaaggcaggagctctctctcccctacctgccaagtggcaccccggagctggaggtgcccaaacctggccagccatcagagccagaacacgggcctagtccgggtcaggataccttttgccaggggaaggccgatgggttgtacccgaacccacgggagaggagttccttttactcttgtgccgctggccggctgtttcagcagtcctgtcctacggggttagtgtttagtaattcgtgtaagtgttgtacttggaattag

SEQ ID NO: 5703 - DNA, 1596 bp, Artificial Sequence
  Description of Artificial Sequence: Synthetic coding sequence
atgagactgtgtctcggccggccccaccctaggggacacagccgggtgggcaagagtgagagaggccgaggcgcacgcgggttagccagacagcgaacgcttgaggacgaggaagagcaggaacgtgaaagaaggcgacgacaccggaatctttccagcaccacggatgacgaggctcccaggctctcccagaacggtgaccgccaggcttccgccagtgaacggctcccatcagtggaagaagctgaagttcctaaacctctaccacctgctagcaaggatgaggatgaggatattcagagtatactgcggaccagacaggaaagacggcaaagacggcaggtagtggaggctgctcaagctccaatacaggagaggcttgaggctgaagagggtcggaactcgttgagcccagtccaagctacccagaaacccctggtaagtaagaaggaattagaaatcccaccgcggcgcagactatcacgggaacagaggggcccctgggccttagaggaagagagccttgtaggccgggagccggaggagcgcaagaagggcgtgcctgagaagtcccctgttctcgagaaaagctcaatgcctaaaaagaccgcacccgagaaatccctcgtgagtgataagacctccatttcagagaaggtccttgccagcgaaaagacaagcctgagtgagaagattgccgtgagtgagaaacggaactcaagtgaaaagaagagtgtgctcgagaagacaagtgtatctgagaaaagtttagcacctggaatggctctgggttccggtaggcggttagtctcggagaaggcatcaatcttcgaaaaagcactagcctctgagaaaagtccaactgccgacgccaagcctgcccccaaaagggcaaccgccagtgagcagccacttgctcaggagccaccagcctctggtggttctcctgcaacaacaaaggaacagagaggtagagctcttccagggaaaaatctccccagtctggccaagcagggcgcatctgacccccccacagtggcctcgcggctgccacctgtcaccctgcaggtcaagatcccaagtaaggaggaagaagctgatatgagcagcccgacccaacggacctactcatcttctcttaagcgcagctctcccaggactatcagctttcgaatgaagcccaaaaaagagaattcagaaactactctcaccagatccgcatccatgaagttgccagacaacacagtgaagctgggtgagaagctggaacggtatcacacagcaattagaaggagcgagtcagttaagagtcgggggctcccctgcacggaactattcgtggctccggtaggagtggcgtcaaagaggcacctgtttgaaaaagaacttgcaggacaaagccgcgctgagcctgcttctagcaggaaggaaaacctgcgcctgtccggcgtcgtgaccagccgcctcaacctttggatcagccgcacacaggaatctggcgaccaggatccccaagaggctcagaaggcctccagtgccaccgagcgcacccagtggggccagaagagcgatagttcactcgatgccgaagtctag

SEQ ID NO: 5704 - DNA, 1782 bp, Artificial Sequence
  Description of Artificial Sequence: Synthetic coding sequence
atgaaagccgacttgaagcagcatcatcatcactggtccatcttttcctatataaggctgcgtctgccctcaatgctgcttctgttcagcgttatcttgattagctgggtgtcgaccgtcggcggagaggggaccctttgcgacttcccaaaaattcatcatggatttctgtacgacgaggaggactacaaccccttctctcaagtgccaactggggaagtgttctattactcgtgtgagtataattttgtctccccaagcaaatcattttggacaaggatcacctgtacagaggaaggctggagccccactccgaaatgtctgaggatgtgttccttcccctttgtaaaaaacggccatagtgaatcttcaggccttatccacctggaaggtgatacagttcagatcatatgcaacaccggctacagcctgcagaacaatgaaaaaaatatatcatgtgttgagcgagggtggagcactcctcctatctgcagctttaccaagggtgaatgccatgtcccaatacttgaggccaacgtggatgcccagcccaagaaggagtcctacaaagtcggagatgtactgaagttctcctgtagaaaaaatctgatcagggtgggctccgactccgtacagtgttatcagttcggatggtctcccaacttcccaacctgcaaaggacaagtccggagctgtgggccgccacctcagctgagcaacggcgaggtaaaggagattcggaaggaagaatatggccacaacgaggtggttgaatatgactgtaaccctaacttcattattaacggccctaaaaaaatccagtgtgttgacggggagtggaccactctgcccacatgtgtagagcaggtgaagacctgcgggtacattcctgaactggaatatgggtacgtccagccatctgtgcccccctaccagcacggcgtcagtgtggaggtcaattgccggaatgagtacgccatgatcggcaacaatatgattacctgcattaacggcatatggacggagttaccgatgtgtgtggctacccatcagttgaaaagatgcaagattgcgggtgtaaatatcaagacactcctgaaactatccggcaaggagttcaaccacaattcgagaatcagatatcgctgttcagacatattccgttacagacatagcgtatgtatcaatggcaaatggaatcccgaggtcgattgtactgaaaagagagagcagttctgccctcctcctcctcagatccctaacgcgcagaacatgactaccaccgtgaattaccaggatggtgaaaaagtcgcagtgctgtgcaaggagaactatttactgccagaagcaaaagagattgtgtgtaaagacggcagatggcagagccttcccaggtgtgttgagtctacagcctattgtggtccccctccttctataaacaatggagacacaacaagcttcccattatctgtctaccctcccggatcgaccgtgacctacaggtgtcagtctttctacaaactgcaggggtccgtgaccgttacctgccgcaataaacaatggtccgagccaccacggtgtctggacccatgtgtcgtgtctgaagaaaacatgaataaaaacaacatccagctcaagtggcgtaatgatgggaagctgtacgctaagaccggagacgccgttgaatttcagtgtaagtttccacacaaagctatgattagcagccctcccttccgggccatttgccaggagggaaagttcgaataccctatttgtgagtag

SEQ ID NO: 5705 - DNA, 2301 bp, Artificial Sequence
  Description of Artificial Sequence: Synthetic coding sequence
atgatctggaggtctagagcaggtgccgaacttttctctttgatggcactctgggagtggatcgccctgtcattgcattgctgggtgctcgctgtagccgcggtctcggaccagcacgcgaccagcccgtttgattggttgctcagcgacaaaggcccattccacagaagtcaggagtacacagactttgtagaccgatccagacaaggatttagcacgaggtacaagatctaccgagagttcgggcgttggaaagtaaataatctagccgtcgagcggcgtaacttcctaggtagccccctgcctttagccccagaattcttccggaacatccgattgctggggagaagacctacgctgcagcagattaccgaaaatctcatcaagaagtatgggacacacttcctgctatcggccacattaggcggtgaggagtcactgactatcttcgtcgacaagagaaaactgagcaagcgcgctgaaggatctgatagcactacgaactcttcttcggtcaccttagaaaccctccaccagctcgccgcctcctacttcatcgacagagactcaaccttgagaaggctgcaccatattcagattgcaagtaccgctatcaaggtgaccgagacccgcaccggccccctcgggtgcagcaactatgacaatctggattcagtgtcgtcagtccttgttcagtcccccgaaaataaaattcaactccagggactgcaggtcctcctccctgattatttacaggaaaggttcgtccaagcagcacttagttacattgcttgtaattcagagggcgagtttatttgtaaggagaacgactgctggtgccactgtgggcctaagttcccggagtgcaactgtccgagcatggatatacaggccatggaggagaatctgctgagaattacagaaacatggaaagcatataactccgatttcgaagagtccgatgagtttaaactgttcatgaagcggcttccaatgaattacttcctaaatacctccaccattatgcacttgtggaccatggacagcaattttcagaggaggtatgaacagctcgagaatagtatgaagcaactgtttcttaaagcccagaagattgtgcacaagctgttttcactctcaaaaagatgtcacaagcaacccctaatctccttgccccggcagcgaacctccacatactggttgacacggatccagagctttttgtactgtaatgagaacggactgcttggcagcttctctgaggagacgcacagctgtacatgccctaacgaccaggtggtctgtactgctttcctgccttgtactgttggagatgcatctgcgtgcttgacttgcgctccagataataggaccagatgcggaacctgcaacacaggctatatgctaagtcagggattatgcaagccagaagtggccgaatccacagaccattatattggctttgagactgatctccaggacctggaaatgaagtacttgttacagaagacagacaggcggatcgaagttcacgccatctttatatctaacgatatgcgcttaaactcatggttcgatccatcctggcgaaagaggatgctccttacacttaagtcaaacaaatacaaaagcagtctggtgcacatgatcctggggttgtctttacagatctgcctcaccaaaaattctactcttgagcctgttctcgccgtgtacgttaaccctttcggagggtcccacagcgagtcctggttcatgcccgttaatgagaacagcttccccgattgggaaagaactaagctggatctccctctccagtgctacaactggaccttaacacttggcaataagtggaaaaccttttttgagacggtgcacatatacctgcgaagtcggatcaagtctaacggtcccaatgggaacgagtccatctactatgagccacttgagttcattgacccctccagaaacctcggatacatgaagattaataacatccaggtgttcggttacagcatgcattttgatcctgaggcaatccgagacctgattctgcagctggattatccctacacccagggctcgcaagattctgcgctactccaactgctcgagataagggaccgagtcaataagctgagccccccgggtcaacgcagactagacttgttttcatgtctgttgcgacacagattaaaactgtctacttctgaagtagtccgcatacagagcgcactgcaggcgtttaacgcaaagctgccgaatacgatggattacgacaccacgaagctctgctcttag

SEQ ID NO: 5706 - DNA, 1815 bp, Artificial Sequence
  Description of Artificial Sequence: Synthetic coding sequence
atgcggcggtgcaattctgggagtggccctcctccatcgttgctgctgctgctgctctggctcctcgccgtgcccggggccaatgctgcgccgagatcggccctgtacagcccgtccgatccactgacccttctgcaggctgacacggtgcggggcgctgtcctgggaagccggtcagcttgggccgttgaattttttgcctcctggtgcggtcattgtatcgccttcgcacctacgtggaaggccctagcagaggacgtcaaagcttggaggccggccctttaccttgcagcactcgactgcgcagaggaaacaaattccgcggtttgccgtgactttaatatccctgggttccccacagtcagattctttaaggctttcactaagaacggatcaggggccgtgtttcctgtagctggagccgacgtccagacactgagggagcgcctgattgacgccctcgaaagccaccatgacacctggccgcccgcgtgtccccccctggagcccgccaaactggaggagatcgacgggtttttcgcccgaaataatgaggaataccttgctctcattttcgaaaagggcggctcttacctcggacgtgaagtcgccttggacttgtcacaacataagggagtggccgtccgtcgagttctgaacaccgaagccaatgtcgtacgaaaattcggcgtcaccgactttcccagttgctacctgctgttccggaacgggtccgtgtcacgggtcccggtgctgatggagagtaggagtttctatacagcctacctgcagcgcctgtccggcctaacgcgagaagcagcccaaactacggtagctcccaccacagccaataagatagcaccgacagtgtggaaattggctgaccgctcaaaaatatacatggcagaccttgagagcgccctgcattacattctgaggatcgaggtcgggagatttcctgttttagaaggccagcgattggtggccctcaagaagttcgtagctgtcctggccaaatacttccccgggaggccgctagttcagaatttcctccattcggtcaacgagtggctaaagcggcagaagaggaacaaaataccgtacagtttttttaagaccgcacttgatgataggaaggagggtgcggtgttagccaaaaaagtcaattggattggttgtcaagggtcagaaccgcacttccggggattcccatgctcactgtgggtgcttttccactttttgaccgtacaggctgcccgtcagaatgtggaccactctcaggaggctgccaaagcaaaagaagtgcttccagccattcggggctacgtgcactacttttttggttgcagagattgcgcctcccacttcgagcagatggctgcggcttcaatgcatagggtagggagtcccaatgctgccgtgctctggctttggagtagtcacaaccgcgtgaatgcaagactggccggtgcccccagtgaggacccccagtttcctaaggtgcaatggccgccccgggagttatgttcggcttgtcataatgaaagacttgacgtgcctgtgtgggatgtggaagctactctcaactttctcaaggcgcactttagtccgtcaaatataatcctagactttccagctgctggctccgcagcgcggagggacgtccagaatgtggccgcagcgcccgaactggctatgggcgccctagaattggagagccgcaacagcacactggatcctggaaagcccgaaatgatgaaatctcccaccaacactactccccacgttcctgccgaggggcccgaactgatttag

SEQ ID NO: 5707 - DNA, 2244 bp, Artificial Sequence
  Description of Artificial Sequence: Synthetic coding sequence
atgcggcgctgcaactcaggttccggacctcctccaagccttctgctactgctgctgtggctactggcagtcccgggagccaacgcagccccgagatccgctctgtactctccatccgacccccttactcttctgcaggcagacaccgtcaggggagcagtactgggctccaggagcgcctgggccgtggagtttttcgctagctggtgtggccattgcattgcatttgcccctacttggaaagcgctggctgaagatgtgaaagcatggcgaccggctttgtaccttgctgccttagactgtgccgaggagacaaatagtgctgtttgcagagacttcaatattccaggcttccccaccgtacgattttttaaagcctttacaaagaacggctccggcgctgtgtttccagtggctggtgcagacgtgcaaacattgagggagcggctgattgacgctctcgagtcccaccatgatacctggccccccgcatgtcctcccttagagcctgcaaaactcgaagaaatcgatggtttctttgcacggaataacgaggaatatttggcactgatttttgagaaaggaggctcttacctgggcagggaggtggcactcgatctgagccagcacaagggggtggcagtcagacgggtactaaacaccgaagctaacgtggtccgcaaatttggcgtgaccgatttccccagctgctatcttctgttccgtaacgggtctgtaagccgggtgccggtcttgatggaatcccgatcgttctatacagcgtatctccagcgactctctgggctgacgcgcgaggccgcccaaaccaccgttgcgcccacgactgctaataagatcgctcccacagtgtggaagttggcggatcggtcaaaaatttatatggccgatctggagagtgccctccactacatactccgaatcgaggtcggtcggtttcccgttttagaggggcagcgcttggtcgctctgaagaagttcgtggctgtccttgcgaaatatttcccggggcggccattagtgcagaattttctccattcagttaatgaatggctgaagcgccagaaacggaacaaaatcccttattcattttttaaaactgccttggatgatcgtaaagaaggagctgtcctcgctaagaaggttaactggattggttgtcagggatcagaaccccacttccgcggctttccctgtagcttgtgggtgttgtttcatttcctcacggtgcaagcagcaaggcagaacgtggatcactcccaggaagccgcaaaggccaaagaagtgctgccagcaattcgcggatacgtgcattatttttttggctgccgagactgtgcctcccactttgagcagatggcagctgcttccatgcacagggtcggcagccctaacgcggctgtgctgtggctgtggtcctcccacaatagagtgaacgctagactggccggggccccaagcgaagatccccaattccccaaggtgcaatggcctccacgggaattgtgctcggcctgccataatgagcgcctggacgttccagtgtgggatgtggaggctacactcaatttcttgaaggcccacttcagcccttcaaatataatcctagatttccccgccgcaggatccgccgcaagacgggacgttcagaacgtggcagcagcccccgaacttgccatgggagcattggaactggaaagcaggaattccacactggacccaggcaagcccgagatgatgaaatcacccacgaacaccactccccacgtccctgccgaaggacccgaggcgagccgacccccaaaactgcaccccggacttcgagcagcgccagggcaggagccccccgaacatatggcagagttgcagcgaaatgagcaggaacaaccgctgggccagtggcacctatccaaacgcgatacaggagcagcactcctggccgaaagccgggctgagaagaatcgtctttggggcccattagaggtgcggcgcgtggggcggtcgtcaaagcagttagtagatattccagaagggcagctcgaggctagagccggccggggacggggacaatggctgcaagtgttgggtggcggcttttcatatctcgacatctccttgtgtgtcggcctgtattctctttcgttcatgggcctcctcgccatgtacacatactttcaggcaaagattcgggctcttaaaggacacgccggacacccagccgcctag

SEQ ID NO: 5708 - DNA, 1476 bp, Artificial Sequence
  Description of Artificial Sequence: Synthetic coding sequence
atgaaaaccttcacgtggacgctgggggtactgtttttcctgctggttgataccggacattgtagagggggccaattcaagattaaaaaaattaaccagcgcagataccccagggccaccgacggtaaggaggaggcaaaaaagtgtgcctatactttcctggttcccgaacaaaggataacagggcctatttgtgtgaacacaaaagggcaggacgcatctacaataaaagacatgatcaccaggatggacctggaaaacctgaaggatgtcttatcaaggcaaaagagggagattgatgtcctgcagttggtcgtggacgtggacggcaatatcgtgaacgaggttaagctgctcagaaaagagtctcgcaacatgaattccagggttacccaactgtacatgcagctcctgcatgaaatcatccggaagagggacaacagcctggagttatcacagctagaaaataagatcctgaatgtgaccaccgagatgctgaagatggcaacccgctaccgtgagttagaggttaagtacgcttcactcaccgatctggtgaacaatcagtctgtaatgatcactctgcttgaggagcaatgtctcaggatcttttcaagacaggatacccatgtttcccctccactggttcaggttgtgcctcagcatatccctaactcccaacagtacaccccgggcctgcttggcggtaacgaaattcaaagagacccaggataccctcgtgatctgatgccacctcccgatctcgccacaagtcccactaaaagtcccttcaaaatccccccggtcacattcatcaacgaaggtccctttaaggactgccaacaggcaaaagaggctggtcactctgtgagcggcatctacatgattaagcccgagaattcaaacgggccaatgcagctctggtgtgagaatagtttggatcctgggggttggacagtcattcagaagagaacggacggaagcgtcaacttctttcggaactgggagaattataagaagggctttggtaacattgatggagagtattggctgggcctagaaaacatctatatgctcagcaatcaggataattacaaattactcatcgaactggaagattggtccgataagaaggtttacgcagagtacagtagctttcggctggaacctgaaagcgagttctacaggctccgtttgggaacataccagggcaacgctggcgactcaatgatgtggcacaatggaaagcagtttacgacgctcgaccgcgataaggatatgtatgccggcaattgtgcacactttcataagggcgggtggtggtataatgcatgcgcccacagtaatctcaacggagtctggtatcggggggggcactatcgctctaagcaccaagatggaattttctgggcagagtatagaggaggaagctatagcctgagggctgtgcagatgatgattaagcctattgattag

SEQ ID NO: 5709 - DNA, 2484 bp, Artificial Sequence
  Description of Artificial Sequence: Synthetic coding sequence
atgatgtgtttaaagatcctcagaatcagcctcgccatcttagccgggtgggccctctgtagcgccaattcggagttggggtggacgcggaagaagtcgctggtggagcgtgagcatttaaaccaggttctgctcgaaggggaaagatgctggctcggggctaaagtacgtcggcctcgcgctagccctcagcaccacttattcggagtgtatcccagccgagctggcaattaccttcggccttatcctgtgggagaacaggaaatccaccacacaggacgatcaaagccggacaccgaggggaatgccgtgagtttggtaccccccgatcttacagagaacccagctgggctcagaggagcggtggaggaacctgcagcaccttgggtgggggattcgcccattggccaatctgaactgctgggtgacgacgatgcttacctgggtaaccagagatcaaaggagtctctgggcgaggccggaatacagaagggctctgccatggccgccacaacaacaacggccatattcaccaccctgaacgaacccaagcctgagacacagcggaggggctgggctaagtctcggcaacggcgacaggtctggaagaggcgcgctgaggatggtcaaggggacagtggtattagtagtcatttccagccctggccgaaacactctctgaaacatagagtgaaaaagagtcctccggaggaaagcaatcagaacggcggcgaggggagttaccgagaggccgaaactttcaacagccaggtcgggttgcccattctgtacttctcaggacgaagagagagactgctgctgaggcccgaagtcctggcggaaatcccccgcgaggcttttacagtggaagcatgggttaaaccagaagggggacaaaataacccggcgatcatagcaggtgtgtttgacaactgctcacatactgtttctgacaagggctgggctcttggaatccgttctgggaaggacaaggggaagcgcgacgcccgctttttcttttcgctgtgtaccgatagagtaaagaaagccaccatcctgatcagccatagtcggtaccagccggggacttggacccacgtagctgctacatatgacggaagacacatggcattatacgtggacggaacccaggtcgcgtcatccctggatcagtccgggccgctgaacagccctttcatggccagttgtaggagcctgctgctgggaggtgacagctcagaagatggacactacttcaggggccacttagggactctggttttctggtccactgcgttgcctcaatcacatttccagcattcatcccagcactccagtggtgaggaagaagccaccgaccttgtgttgacagcgagttttgagcctgtgaacactgagtgggtccctttccgcgatgaaaaatatcctcggcttgaagttctccaaggctttgagccagagccggaaatcctgtccccgttgcagcctccattgtgtggacagaccgtctgcgacaacgtggagctgatcagccagtacaacggatactggccccttaggggcgagaaagtaatccgttaccaggtggtgaacatttgtgacgacgaaggactaaacccgattgtgtcagaggaacagatacggctacagcatgaagccttgaatgaggcgtttagtaggtataacatcagttggcagctgagtgtgcaccaggtgcataactcaacccttcgtcatagggtggttctcgtgaactgtgagcctagcaaaatagggaatgaccactgtgaccctgaatgcgaacatccattaaccggctacgacgggggtgactgcaggctccagggcaggtgctactcctggaaccgccgcgacggactatgccacgtggagtgtaataatatgctgaacgacttcgatgacggtgactgctgtgacccccaggtagccgacgtgcgcaaaacatgtttcgacccagattctcccaaacgagcgtatatgagcgtgaaagagctcaaagaagctctccagctgaattcaacacatttcttgaatatctacttcgcctcgtctgtcagagaagatcttgcaggggcggcaacatggccctgggataaagacgcagttacccatttgggcgggatcgtgttaagcccagcctactatggaatgccggggcataccgacaccatgatccatgaggtgggccacgtccttgggctttatcacgtatttaagggagtctctgagagagagtcatgcaacgacccttgtaaggagaccgtgcctagcatggaaactggggatttatgtgcggacacagcgcctaccccaaagtccgagctatgccgcgaaccagagcctacatccgatacctgcgggttcaccaggttccctggtgcccctttcactaactacatgagctatactggcataaccaccgtgctattctgtttcctcctccgcatccatggggggctgtag

SEQ ID NO: 5710 - DNA, 5376 bp, Artificial Sequence
  Description of Artificial Sequence: Synthetic coding sequence
atgatgtgcctgaagatcctcagaatttcgctggcaattttggcaggatgggcattatgcagcgccaattcggagctgggatggacccgaaaaaaatctctggtggagagagagcatttgaaccaggtgcttctcgaaggcgagagatgttggcttggagccaaggtccgtcgcccaagggctagcccacagcatcatctgttcggcgtgtacccaagccgtgccggcaactatctgaggccgtacccagtgggggagcaggagattcaccatacaggccggtccaaacccgatactgagggcaatgccgtctccctggttccgccagaccttaccgagaatcccgctggcctccgcggcgccgtcgaggagccagctgccccctgggtgggggatagtccgattggccagtccgaactacttggcgacgatgacgcttacctgggcaaccagcggtctaaggagtctctcggggaagcaggaattcagaaaggctccgcaatggctgcaaccacaactacagccatttttactactttgaatgaacctaagccagaaactcagcgccgcgggtgggctaaaagccgacagcgcagacaggtctggaagcgccgagccgaagatggccagggagactccggtatttcctcacattttcagccctggcctaagcacagcttgaagcacagggtcaagaaatctcctcctgaggaatcaaatcaaaatggaggggaagggtcttaccgtgaggcagaaacttttaactctcaggttggtctccccattctgtatttctctggcagaagagagagactgctcctccgccctgaggtcttggccgagattccccgggaggcctttactgtggaagcctgggtcaaacccgagggtggccagaataacccggccattatcgcaggtgtatttgataattgctctcacaccgtgagcgacaaggggtgggcgctgggcattagatccggcaaagacaaagggaaacgcgatgctcgatttttctttagtttatgcaccgaccgggtgaagaaggccaccatcttgatttcccattcgcggtatcaaccggggacatggactcatgttgccgccacctatgatggccgccacatggcactgtacgtcgacgggacccaggtagcatcatcactcgaccagtctggccccctcaatagtccctttatggcttcctgtaggtcacttttgttgggaggagactctagcgaggatggccactacttccgaggacacctgggtacgttagtcttttggtctaccgcactcccacagagccatttccagcattcaagccagcacagctctggggaagaggaggccactgacttagtcttgaccgcctcatttgagcccgtgaatactgagtgggttcccttcagggacgaaaaatatccacgactcgaagtcctccaggggtttgaaccagaaccggaaattctcagtcctttgcaaccgcctctttgcggccagaccgtatgtgacaatgtagagctgatttcccagtacaacggctattggccactccgtggggagaaggtcattagataccaggtggtgaacatttgtgatgatgagggattgaacccaatcgtctccgaggaacagataagactgcagcatgaggctctcaatgaagcattctccagatataacatatcatggcagctgagcgtgcaccaagttcataactccaccctgaggcacagggtagtgctagtaaactgtgagccaagcaagatcggcaacgatcactgtgacccggagtgtgaacacccactgacggggtacgacggtggagactgtcgccttcagggtcggtgttacagctggaacagaagggacggtctgtgtcatgttgagtgcaataacatgctgaacgatttcgacgacggtgactgctgtgatccccaagtggcagatgtccgaaaaacttgtttcgatcctgatagccccaagcgtgcatacatgtccgttaaggaactgaaggaagccctgcaactgaactcaacacatttcctgaatatttatttcgctagcagtgtgcgggaagacctcgccggagctgctacatggccttgggacaaggacgcggtgactcacttaggcggtatcgtcctcagcccggcctactacggaatgcccggccacactgacaccatgatacacgaagtcggtcacgtgctgggcctataccacgtgtttaagggcgtaagtgagagagagtcttgcaacgatccatgtaaggagacggtgccatcaatggaaaccggcgacctctgtgctgatactgcccctacccccaagagtgagctttgtcgcgagcctgagcctacatcggacacatgtggttttacgagattcccaggggctccattcaccaattacatgagctacaccgatgataactgtacagataacttcacacccaatcaggtggcgcgcatgcactgctaccttgatcttgtctatcagcagtggactgaaagcaggaaaccgacccctatcccgatcccacccatggtgatcggtcagaccaacaaatctcttaccattcattggcttcctcccattagcggagtcgtatacgacagagcgagcggctctctgtgtggggcctgtaccgaagatggcaccttccgacaatatgtgcacacggcttcaagcaggagggtctgcgactccagcgggtactggacgccagaggaggcggtgggaccacctgacgtggatcaaccttgtgaaccttcactgcaggcttggtctcccgaggtgcatctatatcatatgaacatgacagtgccgtgcccgactgagggatgttcactggaactactgttccaacacccagtgcaggccgacactctgactttatgggtcacaagcttctttatggaatccagtcaggtgctcttcgacacagagatattgttagagaacaaagagtcagttcatctgggacctctagacaccttctgcgatatccccctgacgatcaagttacacgtggatgggaaagtttctggggtcaaagtgtacacctttgacgagcgcatcgaaatcgacgctgcgctgcttactagtcagccccattcacctctttgcagtggttgccgccccgtgcgataccaggtgctccgggacccgcccttcgcaagcggcctccccgtggtggttacacactctcacagaaaattcaccgatgtcgaggtcacccccggtcagatgtatcaatatcaggtgctggccgaggccggaggggaacttggtgaagctagtccaccccttaaccatattcacggtgcaccatattgcggagatggcaaggtgagcgagcgcctgggagaggaatgtgatgacggcgacctggtctccggagatgggtgcagtaaggtgtgtgagcttgaagaaggcttcaattgtgtgggagagccatctctgtgctacatgtatgaaggtgacggtatatgcgaaccatttgagagaaaaacatcaatcgtcgactgtgggatttacacaccaaaggggtatcttgaccaatgggcgactcgggcttactcaagccatgaagacaaaaaaaagtgcccagtctcattagtgactggcgagccacacagtctaatttgcacaagctaccatcccgatctgccaaaccaccgtcctctgaccgggtggttcccctgcgtggcaagcgagaatgaaactcaagacgaccgcagcgaacagccagagggctcgttaaaaaaggaagacgaagtgtggctgaaggtatgtttcaatcggcctggcgaggcccgtgccattttcatcttcctgacaaccgacggccttgttcctggcgaacatcaacagcctaccgtgaccctgtatctcacagatgtgcggggatcaaatcactccctgggaacatacggcctttcatgtcagcacaatccactgatcatcaacgtgactcaccatcaaaacgtcttgtttcaccacaccacaagcgtgctgcttaattttagttctccgcgcgtggggatcagcgcagtcgctctgaggacttcttctaggattggtttgtcagcgccaagcaattgcatctcagaggacgaaggccagaaccaccagggccagtcgtgcattcatcggccgtgcgggaaacaggactcttgcccctcccttctgctcgatcacgcagacgtcgtcaattgtaccagcattggtcccggactgatgaagtgcgcaatcacttgtcaacgcggtttcgcacttcaggctagtagtgggcagtacatccgcccaatgcagaaggaaatactgctcacatgctccagcgggcactgggaccaaaatgtatcttgtctccctgttgattgtggggtccccgacccatctcttgttaattacgctaacttctcgtgcagcgaagggaccaaatttctgaaacggtgtagtatctcttgtgtccctcctgccaagctacagggattatccccctggctgacatgtctggaggatggtttatggtctttgcccgaggtatactgcaagctggagtgtgatgccccaccgattatactgaatgctaacttgctcttaccacattgtctacaggataaccacgacgtcgggacgatctgtaagtatgaatgcaagcccggctattacgtggcagaatctgccgaggggaaggtgcgcaataaactgttgaaaattcaatgccttgaaggggggatctgggagcagggttcctgcattcctgtcgtatgcgagccccccccgccagtcttcgagggcatgtatgagtgtacaaacgggttctctttagacagccagtgcgttcttaattgcaaccaggagagagagaagctgccaatactttgtaccaaagaggggctatggacccaggaattcaaactatgtgaaaacttacagggggaatgtccccctccccccagcgaactgaattccgttgaatataagtgtgagcaaggttatgggatcggggcagtctgctcaccactgtgcgtcatacctccgtccgacccagtgatgcttcctgagaacataaccgctgatacacttgagcattggatggagccagtcaaggtccagagcatagtgtgcaccggccgccggcaatggcatcccgaccctgttcttgtgcactgtatccaatcttgcgagccattccaggctgacggatggtgcgacaccatcaataaccgtgcttactgtcattacgatggtggggactgttgttcttctactttatcctcaaaaaaggtaatccccttcgcagcagactgcgacctggatgaatgtacttgcagggaccctaaagctgaggaaaatcagtag

SEQ ID NO: 5711 - DNA, 702 bp, Artificial Sequence
  Description of Artificial Sequence: Synthetic coding sequence
atgaaagaccctcttgcaaaagacgagaggatctacgtcactaactattattatgggaacacactcgtcgaatttcgtaatctcgagaatttcaaacagggccgatggagcaactcctacaagttaccgtactcttggattggaacaggacacgtcgtgtataatggcgcattttactacaatagggctttcacccgcaacattattaaatatgatctaaagcagcggtacgtggccgcttgggccatgcttcacgacgtggcctacgaagaggcaactccatggagatggcaggggcattctgacgtggatttcgccgtcgacgagaacggactctggttgatttatccagcactagacgacgaaggctttagccaagaagtgatcgtcctgtcaaaactgaatgcagctgatctcagcacacagaaggagaccacatggagaaccgggctgcggagaaatttctacgggaattgttttgtcatttgcggagtgctgtatgcggtggactcctataaccagagaaacgctaacatttcctatgcctttgatacgcacaccaatacccagatcgtccctcgtctgctgttcgaaaatgaatatagttacactacccagatcgactataatcccaaagaccgcttactttatgcgtgggacaacgggcaccaagtaacctatcacgtgatcttcgcctattag

SEQ ID NO: 5712 - DNA, 579 bp, Artificial Sequence
  Description of Artificial Sequence: Synthetic coding sequence
atgttgaaaaagattagtgtgggagttgcaggggaccttaacaccgtgaccatgaaactcggctgtgtgctaatggcctgggcactatacctctccttgggggttctttgggttgcccaaatgctcttggcggccagctttgagactctccagtgtgagggccccgtgtgcacggaggagtcttcttgtcatacagaagacgatttaacggatgctcgagaggccggatttcaggtcaaagcttacaccttctctgagccgttccacctgatagtttcatacggggcaagctcttccgccgctccccctaccctgaatcctgcaccgcagaagagcgcagctcccggaacagcacccgaggaggctcctgggcccctaccgcccccccccacaccctccagcgaagatcctggcttcagcagccccttgggtatgcccgacccccacctttatcatcagatgggtcttctactgaagcacatgcaagatgtgagagttttattaggtcacttgttgatggagctgagggaattgtcaggccaccgtaaacctgggacgacaaaggcaactgccgagtag

SEQ ID NO: 5713 - DNA, 459 bp, Artificial Sequence
  Description of Artificial Sequence: Synthetic coding sequence
atgctgctggctgcctccttcgaaactttgcagtgcgaaggccccgtgtgtacagaggagtcttcctgtcacaccgaggacgacctgaccgacgcccgggaggcagggttccaggtaaaggcttacacgttttccgaaccgttccacttgatcgtgtcttacggagcatccagctccgctgcgccccctacattgaaccctgcccctcagaagtcagcagccccaggcacagcaccagaagaagcacccggccctctgcctccacctcccactccgtcaagcgaggatccaggattcagttctccactcggaatgcctgatccacatctgtatcaccaaatggggctgctcttgaagcatatgcaggacgtaagggtgcttctcggccatctcctgatggaactgcgcgaactgagtggccaccggaagccaggcaccacgaaagctactgccgaatag

SEQ ID NO: 5714 - DNA, 1098 bp, Artificial Sequence
  Description of Artificial Sequence: Synthetic coding sequence
atgaaactgggttgcgtgcttatggcatgggctctttacctgtctttgggggttctgtgggtggctcagatgctgctagcagctggctgtcacgctgcagctagctttgagacactccaatgtgagggtcccgtctgtactgaggagtcctcttgccacacagaagacgacctcacggatgctcgcgaagccggcttccaggtgaaggcatatacgttttccgaacccttccacctcatcgtatcctatgattggctgatcctgcaaggcccggccaagcccgtgtttgaaggagacctgttggtgctccgctgccaggcttggcaggattggccgctgacacaggtaaccttctatcgcgacggctctgcattggggccacccggccctaaccgagaattttcaattacagttgtccagaaggcggacagcgggcattaccattgcagtggcatcttccagagccctggacccgggatccccgaaacggccagcgtcgtcgcaatcaccgtccaggaactgtttcccgcacccatattgagggcagtcccaagcgccgagccacaagccggatcaccaatgaccctcagttgtcagaccaagctgccactccagcgctccgccgctaggctcctgttctctttctacaaggatgggcgcatcgtgcaatcccgcggactgagcagcgaattccagataccaacagcatcagaggaccatagcggcagctactggtgcgaagcggccaccgaggataaccaagtatggaaacagtctccccaactagagatccgcgtgcaaggagctagcagctcagccgccccacccacgcttaaccccgccccacagaaaagtgctgcccctggaactgccccagaggaggcaccgggacctctccctccgcccccaacaccctctagtgaagaccctggtttttccagtccgctcggaatgcccgatccccacctgtaccatcagatgggtctccttctgaagcacatgcaggatgttagagtcctgctgggccatcttttgatggaactcagggagctgtccgggcaccgaaaacccggtaccacaaaggccaccgcagagtag

SEQ ID NO: 5715 - DNA, 711 bp, Artificial Sequence
  Description of Artificial Sequence: Synthetic coding sequence
atgctaaaaaaaatcagcgtgggcgtagccggagatctgaacaccgtgacaatgaagctgggatgtgtcctgatggcctgggcactttacctgagcttaggagtcctctgggtggcgcagatgttgcttgagttgtttcccgcccccatcctgcgtgcagtgccctccgccgagccacaggcgggctcccctatgacactgtcttgccagactaaactccctctccagcgatcagccgcgagactactgttctctttctataaggacgggaggatcgtccaaagcagaggcctgtctagcgaatttcagatccccacagcctccgaggatcatagcggcagctattggtgcgaggcggccacggaggacaaccaggtatggaaacagtctcctcagctggaaatacgcgtacagggtgcaagtagcagtgcggccccgcctaccttgaatcccgctcctcagaagagcgctgcccccggcacagccccagaggaggctcctggcccccttccccctccccctactccaagttccgaggaccctggatttagtagcccactggggatgccagaccctcatttgtatcaccaaatgggacttctgctgaagcatatgcaagatgtcagagtgctgctgggccatctgctgatggaactgcgggaactgtcaggacaccgcaagcctggaactacaaaagcaaccgccgaatag

SEQ ID NO: 5716 - DNA, 1149 bp, Artificial Sequence
  Description of Artificial Sequence: Synthetic coding sequence
atgctcaagaaaatatccgtgggcgtcgcaggagatttgaacacggtcacaatgaaacttggatgtgtgctcatggcatgggctctgtatctgtcactgggggtcctctgggtcgcccagatgctgctggccgcagggtgccacgccgccgccagttttgagaccttacagtgtgaaggacctgtctgcaccgaagagagttcttgccacacagaagatgacttaacagacgcgcgagaggccggattccaggttaaggcttacacattctccgaaccctttcaccttatcgtgtcctacgattggttaatactgcagggccccgccaaacctgtgtttgagggtgatcttctggtcctgcgctgccaggcatggcaggattggccgttaacccaagttacattctatcgtgatgggagcgcactgggccctcccggtccaaatagagagttctccatcacggtcgttcagaaagccgacagtggtcattaccattgtagcgggattttccagtcaccagggcccggtattccggagacggcaagcgtggtagctataaccgtccaggaactctttcctgcacctattctccgggccgtaccatccgccgaaccccaggccgggtcaccgatgacccttagttgccagacgaagctgccgctgcagcgttctgcagcccgtttgctgtttagtttctataaagacgggagaatcgtacagtccaggggattgtccagcgagtttcagataccaaccgcctccgaggatcactccgggtcctattggtgtgaagccgcgacagaggacaatcaggtgtggaaacagtcccctcagctagagatacgggtgcagggggcatcctcaagtgctgctcccccgaccttgaaccccgcgccccaaaaatcggcagcgccaggcacggccccagaagaggctccagggccactgcctccgccgcctaccccatcaagtgaagatccaggatttagtagccctctagggatgccagacccccacttgtatcatcagatgggcttactgctcaaacacatgcaggatgtacgcgtacttttggggcacctgctgatggagctacgggaactctctggacatcggaagccaggtaccactaaagcaacagctgaatag

SEQ ID NO: 5717 - DNA, 738 bp, Artificial Sequence
  Description of Artificial Sequence: Synthetic coding sequence
atgtcaagacttcgagccttgctgggtctgggattgttggtggcaggaagtcgagtcccgcgcatcaaaagtcaaactatagcatgccgctcagggcctacctggtggggccctcagagactcaactctgggggacgttgggactctgaggtgatggcgtccactgtggtaaagtatctcagtcaggaggaagcccaggccgtcgatcaggagctgtttaacgaataccagttttccgtcgaccagttaatggagctggcgggcctgagttgtgccaccgccatagcgaaggcttacccacctaccagcatgtcccgcagcccgccgaccgtcctggtgatatgtggtccaggcaacaacgggggcgatggattggtatgcgcaaggcaccttaaactatttggttacgagcccactatctactatccaaaaaggccaaacaaacccctgttcactgcccttgtcacccagtgtcagaaaatggatatcccctttttgggagagatgcccgcggagcctatgaccattgacgagttatacgagttggttgttgatgccatttttggatttagttttaaaggcgatgtgcgagaaccatttcattcgattctgagcgttctgaaaggccttacggtacccatcgcctctattgacataccatcaggcgccgggattcagaaagtcggctggggacgcctgggtccatatcccccagactcttgtccccaccaggtatag

SEQ ID NO: 5718 - DNA, 783 bp, Artificial Sequence
  Description of Artificial Sequence: Synthetic coding sequence
atgagccgactccgcgcacttttgggacttggactcctcgtcgctggaagtagagtacccaggattaaaagccagactatagcttgcaggtctggccccacgtggtgggggcctcagaggttaaattcagggggcagatgggattccgaggtaatggccagtacagtcgtaaaatacctgagtcaggaagaggcgcaagcagtggatcaggagctttttaacgagtatcagttctctgtagaccagctgatggagctagctggtctttcctgcgccaccgcaatcgccaaggcctatccccctacttctatgtctagatcaccccccactgtgctggtcatctgcggtcccggcaacaacggcggcgatggccttgtctgtgctcggcacttgaagctgttcgggtacgagcccacaatctactacccaaagaggcccaacaagcctcttttcactgcactggtcactcaatgccagaaaatggatatcccttttttgggcgagatgccagccgagctacaggggaggtgttccggcaccgtaccccaacacccagagtgccccgaaggcacccactgcgcccattgccagcataggcattccctccgaatgggtaggggtgaggggaaatgctggagagacccagcaagactggctcacatcccccactcaccacaaaaaatctgtaacccagtctatagaagcctccccctgcctggtggctccttttgtgctacctgttctggagaagaagtgccggctgaacccgcgaccctcccctag

SEQ ID NO: 5719 - DNA, 867 bp, Artificial Sequence
  Description of Artificial Sequence: Synthetic coding sequence
atgtcacgacttcgcgcgctcctggggcttgggctactagtggcaggatccagggtgccccgcattaagtcccagactatcgcctgtcgttcgggcccgacctggtggggccctcaacggctgaactccggaggtagatgggattccgaagtgatggcttccacagtggtgaagtacctgtcccaagaagaggcccaagcggtcgaccaggagctattcaacgaataccagttctccgtggaccagttaatggagctggcagggctttcctgcgctacagcgatcgccaaggcctacccccccacctctatgagccggtcccctcccacagtgttggtaatttgcggaccaggcaacaatggcggggacggacttgtctgcgctcggcaccttaagctcttcggatatgaaccaacaatatactacccaaagagacctaataagccactcttcacagctctggtcacacaatgccaaaaaatggacatcccttttctgggtgaaatgccggccgaaccgatgaccatcgacgagctctatgagctcgtggtggacgcaattttcggtttctcattcaagggcgatgtcagggaaccgttccatagcattctctccgtcttaaagggactgaccgtacctatagctagtatcgacatacccagcggatgggatgtcgaaaaaggtaacgcaggggggattcagccagaccttttaatatctctgaccgcaccaaagaagtcagctacgcagttcacaggacggtaccactatttaggcgggcggtttgttccaccagcactcgaaaaaaagtatcagttgaatctgccgccctacccagacactgaatgcgtgtaccggcttcaatag

SEQ ID NO: 5720 - DNA, 879 bp, Artificial Sequence
  Description of Artificial Sequence: Synthetic coding sequence
atgcacttgagactgattagctggctgtttattatcctgaatttcatggagtatattggctcccagaatgcctccagaggtcgtcggcagcggaggatgcacccgaacgtgtcccaaggttgccagggtggctgcgctacatgttccgactacaacggatgtctttcctgcaaacctcgactgtttttcgccttagaaagaatcggcatgaagcagattggcgtctgcctcagctcatgtcccagcggatactacgggactagatatcctgacattaataagtgcactaagtgcaaggcggactgtgacacttgctttaacaaaaatttctgcactaaatgcaaaagtgggttttatcttcatctgggcaaatgcctcgacaactgccccgaaggcttagaggcaaataatcacacgatggaatgcgtgagcatcgttcattgcgaggtcagtgaatggaatccatggagcccctgcaccaaaaaagggaaaacttgcggcttcaaacgcgggaccgaaactcgcgtgcgggagattatccagcatccttccgccaaaggtaacctttgtccccccaccaacgagactcgcaaatgtaccgtccagcgaaagaagtgccagaaaggcgaacgcgggaagaaaggacgcgaacggaagcggaagaagccaaataaaggcgagagtaaagaggccatccctgatagcaaatctctcgagagctccaaagagatccctgagcagagagagaacaaacagcaacagaagaaaaggaaggtgcaagacaagcaaaagtccggcatagaagttaccctcgccgaaggcttaacttcagtgtcacaaagaacccaacctactccttgtcgtcgccgctatctgtag

SEQ ID NO: 5721 - DNA, 2871 bp, Artificial Sequence
  Description of Artificial Sequence: Synthetic coding sequence
atggaaacccaggagctgcgaggagccctggctctgctcctcctatgtttttttactagcgcttcgcaggacttgcaggtgatcgatctcctgactgtaggcgagagtcggcagatggtggccgttgccgagaagatcagaaccgcgctgctgaccgccggggatatctatctcttgtctaccttcagactgccccccaagcagggcggcgtactcttcgggctgtactcccggcaggataacacaaggtggctggaggctagcgtggtggggaaaatcaacaaggtcctcgttaggtatcagagagaagacgggaaagtccacgccgttaacctacagcaggccggcttagccgacggacgcacgcacacagtgttattgagattgcgaggtcccagtaggcctagtcccgctctgcacctgtatgtggactgcaaacttggagatcagcatgccggccttccagctctggctccaattcctcctgccgaggttgatggtctcgaaatccggaccgggcagaaagcctacctgcgcatgcaaggctttgtcgaaagcatgaaaattatcctgggaggtagtatggctcgggtcggggcactcagcgaatgcccgtttcagggcgatgagagcatccactccgcggtcacaaatgccctgcattctatcctcggcgagcagaccaaagcactagtcactcagctaacactattcaatcaaatactggttgagttgcgagatgacattagagatcaagtcaaagaaatgagccttattagaaatactattatggagtgccaagtctgtggctttcatgagcaacggtctcattgctcaccgaatccatgttttcgcggcgtcgactgcatggaggtctacgaataccccggttatcgatgcggcccctgtcctccaggcctgcaaggaaatggtacgcattgtagtgatatcaatgagtgtgcccacgccgacccatgcttccctgggtcttcatgtatcaataccatgcctgggttccactgtgaagcgtgcccccgcggctacaagggcacccaggtcagtggtgtaggaattgattacgcaagggcctccaaacaggtctgtaacgatattgatgagtgtaacgacggaaataatggaggctgtgaccctaactctatttgcactaatactgtcggcagtttcaagtgcggcccatgccggctcggcttcctggggaatcagagtcagggctgcttacccgcaaggacatgtcactctcctgcgcattctccctgtcatattcacgcgcattgtcttttcgagcgcaatggagctgttagttgtcagtgcaacgtgggctgggctggtaatggcaacgtgtgtggaacagacaccgacatcgacgggtaccctgatcaggcactgccttgtatggataacaataagcactgcaagcaggataactgtctgttaacgccaaacagcggacaggaggatgctgataacgacggagtaggagatcagtgcgacgacgatgcggatggcgatgggattaaaaatgtcgaagacaactgtagactcttccctaacaaagatcagcaaaacagcgacactgactctttcggcgatgcatgcgataactgccctaacgtccctaataatgatcagaaggataccgatggtaacggcgagggcgacgcttgcgacaacgatgttgacggagacggaatacctaatggactggacaattgccccaaagtacctaaccccctgcagaccgaccgggacgaagatggagtgggcgatgcctgcgactcttgtccagagatgtccaacccaacacagaccgacgctgacagcgaccttgttggcgacgtgtgcgatactaatgaggacagcgatggagatgggcatcaggacacaaaagacaactgtccccaattacccaattctagccagttggactcagataacgatggattaggtgacgagtgtgacggggatgacgataacgacggtatcccagattatgtcccgcctgggccagataactgcagactggtccctaaccctaatcagaaagacagcgacggcaatggcgttggggacgtctgtgaggacgattttgataatgacgctgtcgttgatccgctcgatgtgtgccctgagtcggctgaagtgacactgaccgacttccgcgcctaccagactgtagtactcgatcccgagggtgacgcacagatcgaccctaattgggtcgtcttgaatcagggaatggagattgtgcaaaccatgaattctgacccaggcctcgccgttgggtatactgcgtttaacggcgtagattttgagggaactttccacgtgaataccgtcacagacgacgattatgctggttttttattttcctaccaggattctggacgcttctacgttgtcatgtggaagcagaccgagcaaacttactggcaggcaaccccatttagggcagttgctcagcctggtttacagctgaaagcagtgacttcagtgtcagggccgggcgaacacctccggaatgcgctctggcataccggacacacccctgaccaggtgcggctcctgtggacagaccctcgcaacgtgggctggagggacaagacaagctaccgttggcagctgctgcatcgtccccaggtcgggtacattcgcgtaaaactctacgagggcccacagctggtagcagacagcggcgtcattattgacacatccatgagagggggtcgtctgggcgtcttctgtttctctcaagagaatattatctggtccaatctccagtatcgatgtaacgacaccgtgcccgaagacttcgagccctttagacggcaacttttgcaaggcagagtgtag

SEQ ID NO: 5722 - DNA, 1110 bp, Artificial Sequence
  Description of Artificial Sequence: Synthetic coding sequence
atgctgccctggcttcttgtattcagtgcactcggcatccaggcctggggggattcaagctggaataagacacaggcaaagcaggttagtgagggcctccaatacttgtttgagaatatttcgcagttgaccgagaaagatgtatctaccaccgtgtctcgaaaggcctggggcgccgaggccgtcggctgtagcattcagctgacaactccagttaatgtgctcgtcatccatcacgtccccggattggaatgccatgaccagacagtgtgtagccagcgcctccgagaattgcaggctcatcacgtacataataattcgggttgcgatgtggcatacaactttctggtcggtgacgacggacgggtgtacgaaggggtgggttggaatatccagggcgtccacactcaagggtacaacaacatttctctgggtttcgctttcttcggcaccaagaaggggcacagtccctcgccggcggctctgagtgccatggagaacctcatcacctacgccgtccagaaagggcacctgagtagctcatatgtccagcctctgctggggaaaggcgagaattgtctggcgcccagacagaaaacatcactcaagaaagcctgtccgggtgtggtgcccaggagtgtctggggggctagggaaacccactgtcctaggatgacacttccagcaaaatacggcatcataatacacacagctggacgcacttgtaacattagcgacgagtgtcggttactggtgagagacattcaatctttctacattgatcggctcaagtcctgcgacatcggctataatttcctcgtgggtcaggacggagcaatttacgagggcgtgggctggaacgtacagggctcttctacgcctgggtacgatgacattgcgctaggtattactttcatggggactttcaccggtatcccgcctaacgcagctgccctggaagccgcacaggatctgattcagtgtgccatggtcaagggatatttaaccccaaactacctgctggtgggccacagtgatgttgctcgcactctgtcacccgggcaggcactgtataacattatcagcacatggccccactttaaacattag

SEQ ID NO: 5723 - DNA, 675 bp, Artificial Sequence
  Description of Artificial Sequence: Synthetic coding sequence
atggaaaaaattcctttcgttcttggcggaaacttacaggggggcgaactggtggtagcctatccctacgacttggtgcggagcccctggaaaacccaggaacacacacccactccggatgaccatgtcttcagatggctcgcttactcctacgcttcgactcatcgcctcatgacagacgcaaggcggcgggtgtgccatacggaggacttccagaaagaagaaggtaccgtgaacggggccagctggcacaccgtcgccggatcacttaatgatttcagttatctgcacactaattgcttcgagctgtcgatctatgtcggatgcgataaatatccacatgagtcgcaactccccgaagagtgggaaaataaccgcgagagcctgatcgttttcatggagcaggtccaccgcgggatcaagggcctggtgagagattcacacgggaaggggattccgaatgcaatcatttctgtggaaggaatcaatcatgatattaggacaggccgggtcagtttgcagaagttgagcctggcctgccgtcgggtacggtgcgcatttgccctgagctctagcagtacaatgattgtgagacctccgcagccctacggtacagtgcctcactcatctccggatccggtgactacaaagatctctcctttgcgcaacttctag

SEQ ID NO: 5724 - DNA, 285 bp, Artificial Sequence
  Description of Artificial Sequence: Synthetic coding sequence
atgcctgtcatcgctggtggaatacttgcagctctcttgctgctaatcgtggtggtgctttgcttgtactttaagatccacaacgcactgaaagcggctaaggagcctgaggcggtagctgtcaagaatcacaaccccgacaaggtgtggtgggcgaaaaatagccaggcaaagaccatcgctactgaaagctgtcccgccctgcaatgctgcgagggctacaggatgtgcgcctcatttgattctctccccccttgctgctgcgacattaatgaagggctgtag

SEQ ID NO: 5725 - DNA, 285 bp, Artificial Sequence
  Description of Artificial Sequence: Synthetic coding sequence
atgcccgtaattgccggcggtatactggctgccttgctattgctgatcgttgtggttctatgcctgtatttcaagattcataatgctctgaaggctgccaaagagcctgaagctgtggccgtgaagaaccataatcctgataaggtctggtgggctaagaacagtcaggccaagaccatcgccactgagagttgccccgctttacagtgctgcgaagggtataggatgtgcgcgtcctttgacagcctacccccctgttgctgtgatataaacgaagggctttag

SEQ ID NO: 5726 - DNA, 1026 bp, Artificial Sequence
  Description of Artificial Sequence: Synthetic coding sequence
atggtcccagctgcgggggccctgctttgggtcttgttactgaacctgggaccaagggctgccggggcacagggcctaacccagacaccaaccgagatgcaacgcgtctcactgagattcggcgggccaatgacccggtcctaccgctccacagccagaacgggtctgcctagaaaaacaaggatcattctggaggatgaaaacgacgccatggccgacgcagatcgccttgccggacctgctgccgcggagctgctggcagctactgtgagtaccggctttagtcgcagcagcgcaattaatgaagaggacggcagctcggaagaaggtgtggtaataaatgccggaaaggattcgactagcagagagttgcctagtgcaacacccaacacagcaggcagttctagcactagatttatagccaatagccaggaaccggagattagattgacctcctccctgccgcggtctccaggcaggtcaaccgaggacctacctggctcacaggctacactttcccagtggtccacacctggtagcacacccagcaggtggccttctccaagccccacagctatgccgtcaccagaagacctgcgcctggtgctgatgccctggggaccttggcactgccactgtaaatcaggtaccatgagtaggtcacgctctggaaagctccatggactaagtggccgcctgcgcgtgggtgcactgtctcagttacgaacagagcacaagccgtgtacttaccagcaatgtccatgcaacaggctgagagaagaatgcccgcttgacacctcactttgtaccgatacaaactgcgctagccaatccactacctccacgcgtacaaccactacccctttccctaccatccatctgcgcagcagccctagcctgccccctgcatctccatgtccagccctagccttttggaagagagtgaggattggtctagaggacatttggaattccctatccagtgtgttcaccgagatgcaacctattgacagaaatcagcggtag

SEQ ID NO: 5727 - DNA, 366 bp, Artificial Sequence
  Description of Artificial Sequence: Synthetic coding sequence
atggacgtgttattcgtcgccattttcgcggtgccgttgattctgggccaggagtatgaggatgaggagcgattaggcgaagacgaatactatcaggtggtgtactattacactgtaacacctagttacgatgattttagcgccgacttcacaatcgattatagcatttttgagagtgaggaccgactcaaccgactggataaggatatcactgaggctattgagacgacaatatcactggaaaccgcgagggcagatcaccccaagcccgtgactgtcaagcctgtaacaaccgaacccgtcgaagaggggtgttacgatagtctcgatggcagtctcgcgagaggtaattggaagattaagtag

SEQ ID NO: 5728 - DNA, 396 bp, Artificial Sequence
  Description of Artificial Sequence: Synthetic coding sequence
atggacgttctgtttgttgccatcttcgcggtaccacttatcctcggccaggagtacgaggatgaggaacgactgggagaagacgagtactaccaagttgtctattattacactgtgaccccatcgtatgatgattttagtgctgatttcaccatagactatagcatcttcgaatccgaggaccgcctgaatcgcctggacaaggacatcacggaagctatagagactacgattagtctggagacagcacgagccgaccatcccaagccagttaccgtcaagccggtgacgacagagcccagtccagacttgaacgatgccgtgtcatccctgcgctcccctattcctctcctgctgtcatgcgcgttcgtgcaggtgggcatgtattttatgtag

SEQ ID NO: 5729 - DNA, 396 bp, Artificial Sequence
  Description of Artificial Sequence: Synthetic coding sequence
atggacgtgctgtttgtcgcaatcttcgcggtgcctttaatcctgggacaggaatacgaggacgaagaacgattgggcgaggatgaatactatcaggttgtctactactacaccgtcacaccatcatatgatgatttctccgccgattttaccattgattactccatttttgagagcgaagaccgactcaatcggttggataaggatatcaccgaggccattgaaacgacaatcagcctggagaccgctagagccgaccacccaaagccagtcacagtcaagcctgtaactactgagcccagccccgacctgaacgacgcagtatcttctctccgcagtcctatccccctgcttctgagctgcgcttttgtgcaggtcggcatgtatttcatgtag

SEQ ID NO: 5730 - DNA, 312 bp, Artificial Sequence
  Description of Artificial Sequence: Synthetic coding sequence
atgtccggacggggaaagggaggcaagggactggggaaaggaggagcaaagaggcaccggaaggtcctccgtgacaacattcagggaatcactaagcccgccattcgcagactggcccggcgcggaggcgtcaaacgaatctcaggtctcatatatgaggaaactaggggggtcctgaaggtctttttggaaaatgtcatccgtgatgcagtcacatatacagaacatgccaagcgcaagaccgtcaccgccatggatgtcgtctatgccctgaaacgtcaggggagaacactgtatggatttgggggctag

SEQ ID NO: 5731 - DNA, 312 bp, Artificial Sequence
  Description of Artificial Sequence: Synthetic coding sequence
atgtccggccggggaaaaggcggcaaaggactggggaaaggtggggccaagaggcatagaaaagtactccgggacaacatccaggggattacgaagcctgccatcagaaggttggcaaggcgtgggggcgtgaagcgcattagcggcctcatctatgaggagacgcggggggtgctcaaggtgtttcttgaaaatgtgataagagacgcagtgacgtacacggagcacgcgaaacggaaaacagtcaccgccatggatgtagtttacgcactcaaaagacagggtagaacgctctacggattcggaggctag

SEQ ID NO: 5732 - DNA, 1404 bp, Artificial Sequence
  Description of Artificial Sequence: Synthetic coding sequence
atgctgggtatttggatcgtcgcctttctgtttttcggtaccagcaggggcaaggaggtctgttacgaaaggctgggttgttttaaggatgggcttccatggacacgaacgttttccaccgagcttgtgggactgccatggtctccggagaagattaatacgcgcttcttgttgtatacgattcataatccaaacgcctaccaagagatctcagctgtgaacagctctaccatccaggcgagctacttcggcaccgataagattacccggattaacattgccggatggaagaccgacgggaagtggcagcgagatatgtgcaatgtcttactccagctggaggatatcaattgtattaacttagactggattaatggaagtagagagtatattcacgccgtgaacaatttgcgtgtggtcggtgccgaagttgcgtattttatcgacgtactcatgaaaaagttcgaatattcccccagtaaggtacatctaatcgggcatagcctgggagcccatctggctggagaggctggatctaggatccctggcctgggaaggattacagggctggaccccgcgggcccatttttccacaatacacctaaggaggtgaggcttgatcctagcgacgcaaatttcgtggacgtgattcacacaaacgccgccaggatcctgtttgagctcggggtggggaccatcgacgcttgtggacaccttgacttctaccccaatggaggcaaacatatgccgggatgcgaggatttaattaccccattgcttaagtttaacttcaacgcttacaaaaaagaaatggcctcattttttgactgcaaccacgcccgaagctatcaattctacgccgagtccatcctgaatccggatgccttcatcgcgtatccctgtcggtcgtataccagctttaaagccggcaactgctttttctgttctaaagaagggtgcccgactatgggccacttcgctgaccgtttccacttcaaaaacatgaaaaccaatggaagccactattttctcaacactggttctctttccccttttgcccggtggaggcataagctgtcggtcaaactgtcaggcagcgaagtgactcaaggaacagttttcctgagagtgggaggcgccgtccgtaagacaggtgaatttgctatcgtctcgggcaaactggaacccgggatgacatacacaaaacttatcgacgctgatgttaacgtaggtaatatcactagtgtgcagttcatttggaagaaacatctgttcgaagacagccagaataagttaggggccgaaatggtgatcaatacaagcggaaaatacggctataaaagcacattctgcagtcaggatatcatggggcctaacatcttacagaacctgaaaccttgttag

SEQ ID NO: 5733 - DNA, 1287 bp, Artificial Sequence
  Description of Artificial Sequence: Synthetic coding sequence
atgattaccggagtgttcagcatgcgactgtggacccctgtcggagtcttgacctctcttgcatactgcctccaccagagaagagtggcactggctgagctgcaggaagcagatgggcaatgccccgtggacagaagtctgctcaaattgaaaatggtgcaagtggtgtttcgccacggggcccggtccccactgaaacctctgcctctggaggaacaggtagagtggaatccacagttgctggaagttcccccacagacccaattcgactatacagtcaccaatctcgcgggcggaccaaagccttactctccctacgatagccaatatcatgagacaacactcaaaggcggcatgtttgctggacaactaacaaaggtcggcatgcagcaaatgttcgcgctcggagagaggttgagaaagaattacgtcgaggacatcccatttctgtctcctacctttaacccgcaagaggtatttatcagaagcaccaatatttttcgaaacctggaaagcacacggtgtctcttggcaggcctttttcagtgtcagaaggagggtcctataattatacatactgatgaggcagatagcgaggtcctgtaccccaactaccagagctgttggtcactcaggcaaagaacccgcggccgcaggcagactgcgtctctgcagcctgggatttccgaagaccttaaaaaggtgaaagacagaatgggcattgactcctccgacaaagtggacttcttcattctcctcgacaacgttgcggccgaacaggcgcacaatctgcccagttgtcccatgctgaagcgctttgcccggatgatagagcagcgtgccgtggacactagtctgtatatcctacccaaggaggaccgggagtccttgcagatggccgtgggcccctttctacacatcctcgagtccaacttgctaaaagccgtagactctgctacagcgcccgataaaatccggaaactgtatctttacgctgcccatgacgtcaccttcatcccgttgttaatgacattggggatcttcgaccataagtggccacctttcgctgtggacttaacaatggaactgtaccagcatcttgaaagcaaagagtggttcgtgcagctttactatcacggaaaagaacaagttccccgaggttgtcctgacgggctatgccccctcgacatgttcctgaacgcaatgagcgtctataccttgagtcccgagaaataccacgccctgtgtagccagacccaggtaatggaggtgggtaacgaggagtag

SEQ ID NO: 5734 - DNA, 711 bp, Artificial Sequence
  Description of Artificial Sequence: Synthetic coding sequence
atgtgtgtgacataccacaacggaaccggctactgtaaatgtcctgaggggtttctgggggaatactgtcagcatagagacccttgtgagaaaaataggtgtcagaacggcggcacttgcgtggcccaggccatgttaggaaaggctacatgcagatgcgcaagcggattcacaggcgaggactgtcagtattccacgtcccatccctgcttcgtgtctcgcccatgtctgaacgggggcacctgccatatgctcagtcgggatacatatgaatgcacctgccaggtgggattcacaggaaaagagtgccagtggaccgatgcctgcctttctcatccttgcgccaacgggagcacttgcacaacagttgcaaaccagtttagctgtaaatgtctcacgggatttaccggtcagaaatgtgaaaccgatgtgaatgaatgtgacattccaggacactgtcagcacggcggcacctgcctgaacctgcctggctcctatcagtgtcagtgtctccagggattcactggacagtattgtgactcactttacgttccttgcgccccctcaccctgcgtgaacggcggaacctgtaggcagacgggcgacttcacatttgagtgcaactgtctccccgagaccgtcagacgcgggacagagctatgggagcgagatcgggaggtgtggaacggtaaagagcacgacgagaattag

SEQ ID NO: 5735 - DNA, 990 bp, Artificial Sequence
  Description of Artificial Sequence: Synthetic coding sequence
atggtgaccaaagcattcgtgcttttagctatctttgcagaggcgtccgcaaagagctgtgcaccaaataaggctgatgttatcctggttttctgttaccccaagaccatcattaccaagattccagagtgcccgtacggctgggaagtgcaccagttagccttaggcggtctgtgttataatggtgtgcatgaaggagggtattaccagtttgtgatcccagatctctcccccaaaaataagtcatactgcggaacacagtctgaatacaagccccctatctatcacttttattcacacatcgtctccaatgataccacggtgattgtcaaaaatcagcccgttaattacagttttagctgcacataccactccacgtatcttgtgaaccaggcagcatttgaccagcgtgttgccacagtccacgtcaaaaatggtagcatgggaaccttcgagagccaattgagtcttaacttctacaccaacgcgaagttcagcatcaaaaaggaggccccttttgtcctggaagcctcagagatcgggtcagacctgtttgccggggttgaagcaaagggcctcagtatccgtttcaaagttgttcttaactcttgctgggccaccccctccgccgacttcatgtatccccttcagtggcagctcatcaacaaggggtgccccactgatgagaccgtgttagtccacgagaacggtcgcgatcaccgtgctactttccaattcaatgccttccggtttcagaatatcccaaaactatccaaggtctggcttcactgcgagacatttatttgcgatagcgagaagctctcatgtcccgttacttgcgataagaggaagcgcctgctgagggaccagactgggggtgtcctagtggtggagctgtcattgaggtcccggggcttctccagcctctacagcttcagtgacgtccttcaccatctcatcatgatgctcgggatatgtgccgtgctgtag

SEQ ID NO: 5736 - DNA, 1161 bp, Artificial Sequence
  Description of Artificial Sequence: Synthetic coding sequence
atggcacagtggcactgcagtcagcgcacgcaggccggcggacacggcgtgggagaaagacttgctcagtgccaggatcagtcatctcggcacgcagcagagctacgagacttcaaaaacaaaatgctgccccttttggaagtagcggaaaaggaaagggaggctctgcgtactgaagctgacacaatctccggaagggtcgatcggctcgagcgggaagtggactatcttgagactcaaaaccctgcacttccctgtgtagagtttgacgaaaaagtcaccggaggaccgggcacgaaaggcaaaggccgtcgcaatgaaaaatacgatatggtgactgattgcgggtacactatcagccaggttagatccatgaagatcctgaagcgcttcggaggaccagccggcctgtggacaaaagacccccttggacagacagagaagatttacgtgttagacggtacccagaatgacacggcttttgtctttccacgtctgagggactttacacttgctatggctgccagaaaggcttctcgagtgcgggtgccattcccgtgggttggtacggggcagctcgtgtatgggggatttttatattttgctcggcgccctccagggagaccaggggggggcggggaaatggaaaacactctgcaactcatcaagtttcacctcgcgaatcgaactgtggtggactcctctgtgttccctgccgaaggattaattcctccgtacgggttgactgccgacacatacatcgatttagccgcggatgaggaggggctttgggctgtgtacgctaccagggaagacgataggcacctgtgcctcgccaagttggacccccagacccttgacaccgagcaacagtgggatactccctgcccccgggaaaacgccgaggctgctttcgtgatttgtggtaccctttatgttgtgtataacaccagaccagcatctcgcgcccgaatccagtgctcgtttgacgcatccgggactttgacacccgagagggccgccctgccctactttcctcgtcgatatggagcccatgcatcgctccgatataacccacgggagcgtcagctctacgcttgggacgatggatatcaaatagtgtacaagttagagatgaggaagaaggaagaggaagtgtag

SEQ ID NO: 5737 - DNA, 510 bp, Artificial Sequence
  Description of Artificial Sequence: Synthetic coding sequence
atgtccgaaagggttgagcgcaattggagtacaggaggctggctgctcgccctctgtctggcttggctctggacccatctgaccctagccgccctgcagccccccaccgccactgtactggtgcaacagggcacgtgtgaagtgattgccgcccaccgttgttgcaacagaaaccgcatcgaggagaggtctcagacggtgaaatgtagctgcttttctggccaggtggcagggaccacgcgcgctaaacctagctgtgttgacgaccttcttctagctgcacattgcgcgcggagagatccccgcgcagcccttagactcctgctgccccagccaccatctagttgccgggacggtggcgtgaggtggtcccccgcttgcaggggtaggtccgtgcggtgcagccgcacctgccgtgacggcgctgccgcggtagatactaaaagcaagcctccaaggagtcacgattccagttgggggtctcggccgggccaggaaaggctggattag

SEQ ID NO: 5738 - DNA, 693 bp, Artificial Sequence
  Description of Artificial Sequence: Synthetic coding sequence
atgagactggccggaccactgaggattgtggtcctagtggtgagcgtgggagtcacatggatagtggtgtcaattcttctgggggggccaggttccgggtttcctaggatccagcaactgtttacctccccggagtcctctgtcactgctgcgccgagggctagaaaatataaatgcgggctgcctcagccctgcccagaggagcaccttgcgtttcgcgttgtgtctggtgccgccaacgtaatcggtcccaaaatttgtcttgaagacaaaatgctaatgagctctgtaaaagacaacgtgggtagaggcctgaacattgccctggtgaacggcgtttctggagaattaatagaagctcgcgcctttgatatgtgggctggagacgtcaatgacctcctgaagttcatacgcccgctacacgagggtactctggtattcgtcgcatcctacgacgaccccgccacgaaaatgaacgaagagacacgtaaattattctcagagctcggaagccggaacgctaaagagcttgcctttagggactcttgggtgttcgttggtgctaagggagtgcagaataaaagcccctttgagcagcacgtgaagaactccaaacacagcaataaatacgaaggctggcccgaagccctcgagatggagggatgtatccctaggcgctccacggcttcctag

SEQ ID NO: 5739 - DNA, 1176 bp, Artificial Sequence
  Description of Artificial Sequence: Synthetic coding sequence
atgttgagacctggcggcgccgaagaggctgcacaactccccctgcgacgagcgtcagcacccgtgcccgtccccagtccggcagcccccgacggcagtagggctagcgcgcgccttgggctcgcttgcctgcttctcttattgctcttgacgcttcccgcgcgcgtcgacacttcatggtggtacatcggggccctgggcgctcgggttatttgcgacaatatcccagggcttgttagtagacagcggcaactgtgtcagaggtatcctgacatcatgcgcagtgtaggcgagggtgcgagggagtggatcagggaatgccaacaccagtttaggcatcacagatggaactgtacaacactggatcgggatcataccgtatttggaagagtaatgttacggtcgtcccgggaggccgccttcgtatatgcaatctcatctgccggcgtggtccacgcaatcacacgcgcatgcagccagggcgaactgagcgtgtgctcctgcgatccctacacacgcggcaggcatcacgaccaaagaggtgacttcgactggggaggatgctccgataacatccactacggtgtgaggttcgccaaggcatttgtggacgcgaaggagaagcgccttaaagatgctagggctctgatgaatcttcacaataatcgatgtggccgaaccgctgtccggaggttccttaagcttgagtgtaagtgtcacggcgtaagtggcagctgtacactgcggacctgctggcgtgccttgtctgactttagacgcaccggcgactatttgaggcgcaggtatgatggagcagtacaagttatggcgacccaggacggagccaactttacagccgctagacaaggatatagacgggcgaccagaaccgatctagtctactttgacaattctcctgactactgcgtactcgataaagcagccggctcgttaggaacggcgggcagagtgtgttcaaaaacctccaaaggcactgatggatgcgagattatgtgctgtggcaggggatacgatactacacgcgtaactagagtgacacagtgtgaatgcaagttccactggtgctgtgctgtcagatgcaaggaatgccgtaacactgttgatgtacatacctgcaaagcccccaagaaagcggaatggctggatcagacatag

SEQ ID NO: 5740 - DNA, 1119 bp, Artificial Sequence
  Description of Artificial Sequence: Synthetic coding sequence
atgcttgacggccttggagtggtcgctatcagcatcttcggtattcagcttaagacagaaggctctctccggacagccgtccccggcattccaacgcaatcagcatttaacaagtgcctgcagaggtatatcggcgctctcggagctcgtgtcatatgcgataatatcccaggacttgtcagcagacaaaggcagctgtgccagagataccccgatattatgaggtcagtcggcgaaggcgcacgagagtggattcgcgagtgccagcatcagttccggcaccatagatggaattgcaccacactcgacagagatcacaccgtgtttgggcgggtcatgctaaggagctcacgtgaagctgcctttgtgtatgctatttctagcgccggagtggtccatgccataactagggcatgctcacaaggggaactcagcgtgtgttcatgcgacccatacacccgaggacggcaccacgaccagcgtggggattttgactgggggggctgttccgataacattcactatggcgtcaggttcgcaaaagcattcgtggacgcaaaggaaaagagactgaaagatgcaagagctctgatgaacctccacaacaatcgttgcggacggactgctgtccgcagattcttaaaactggagtgcaaatgtcatggtgtgtccgggtcgtgcactctacggacatgctggagggcactctcagatttccgcaggacaggtgattatctgagacgtaggtatgatggagcagttcaagtaatggcgacccaggacggagccaattttactgctgcccgccagggataccgacgcgctaccagaacagacctggtctatttcgataattcgccagattactgtgtcttggacaaggcggctgggagtctcggcaccgcagggagagtctgcagtaagacctccaaagggaccgacggctgtgaaatcatgtgttgcggccgaggatacgataccacccgggtgaccagagtaacccaatgcgagtgcaagttccattggtgttgtgcggtaagatgcaaggagtgccgaaacacagtcgacgttcatacatgtaaggcccctaagaaggccgaatggctggatcaaacttag

SEQ ID NO: 5741 - DNA, 1242 bp, Artificial Sequence
  Description of Artificial Sequence: Synthetic coding sequence
atggagaatatgctgctgtggctgatctttttcacgcccggctggacactgatcgatggctccgaaatggagtgggacttcatgtggcaccttcggaaagttccaagaatagtttctgaaagaacgttccatttaacatctccagcctttgaagctgacgctaagatgatggtgaatacggtgtgcggaatagagtgtcagaaagagcttccgacaccaagcctgtcagagctggaagattacctaagttacgaaacagtgtttgagaacggaaccagaacacttacccgagtgaaggtgcaagacctagtactggaacctactcagaatatcaccacaaagggcgtatctgtgagaagaaagcggcaggtctatgggaccgattctcggttttccatcctggacaagcgcttccttactaattttccattctccacagcagtaaaattgagtaccggatgttccggcatattgattagccctcaacatgtattgacagccgcacattgcgtccatgacggaaaagattatgtcaagggatccaaaaaactccgcgtgggactattgaaaatgagaaacaagagtggcggaaagaaacggcgtggctctaaaagaagcagacgcgaagccagcgggggagatcagagagagggaactagagagcatctgcgggaaagagcaaagggcgggagacggcggaaaaaaagtggtcgcgggcagcggatcgctgagggaagaccaagcttccagtggacaagagtgaagaacacccacatacccaaagggtgggccaggggcgggatgggcgatgccacactggattacgactacgccctgctggagcttaagcgcgcacataagaaaaaatatatggaactggggattagtcccaccattaaaaaaatgccggggggcatgattcactttagtggcttcgataacgatagagccgaccagctggtttatcgcttttgctctgtatctgatgaatctaacgatctcctttaccagtactgtgacgccgagtcaggttcaactggatcgggtgtttatcttaggctgaaggatccagataaaaaaaattggaagaggaagatcatcgccgtgtactcaggtcatcaatgggtggatgtgcacggtgtgcagaaggattacaatgtggccgtcaggattacacctctaaaatacgctcagatttgcctgtggatacatggaaatgatgcgaattgcgcatatggctag

SEQ ID NO: 5742 - DNA, 1143 bp, Artificial Sequence
  Description of Artificial Sequence: Synthetic coding sequence
atgggcgcaacaaccatggaccagaagagtctttgggctgggtccgcctacaagctggtgtgttacttcaccaattggtctcaggatcggcaggaaccaggcaagtttacaccagagaatatcgatccatttctatgctcacacctaatttactcattcgcctccatagaaaataacaaggtaataattaaggacaaatcagaagtgatgctatatcagacaattaactctctgaagactaagaacccgaaactgaaaatcttgctaagtattggcggatatctctttggcagcaaaggatttcaccccatggtcgattcatcaacctccagattagaatttattaactccattatccttttcttgcgaaaccacaacttcgatggactggatgtctcctggatatatccagatcagaaggagaatactcattttaccgtactgattcatgagctggctgaggcattccagaaagacttcacgaagtccaccaaggaaagactcctgttgaccgccggcgtttccgccggccgacagatgatcgacaatagctatcaggtggagaagctcgcaaaggaccttgacttcattaacctgctgtccttcgacttccacggtagctgggagaaacctctgattacaggacacaactcacccctctccaaggggtggcaagaccgaggtccatccagttactataacgtcgagtatgcagttggatactggattcacaagggaatgcccagcgagaaggtggtcatgggcattcctacttatggccactctttcactctggccagtgccgaaacaacagtcggagctcctgcctccggccctggagcagcaggccctatcacagaatcctctggttttctagcatattacgagatttgtcaattcctgaaaggcgcgaaaatcacccggttacaggatcagcaggtcccctacgcagtcaaagggaaccagtgggtggggtatgacgacgttaaaagtatggagacaaaggttcaatttctgaaaaatctaaatctgggcggcgcaatgatttggtccatagatatggacgacttcactgggaagtcttgcaaccagggaccttacccactggttcaggctgtcaaacggtccctcggctctctgtag

SEQ ID NO: 5743 - DNA, 1173 bp, Artificial Sequence
  Description of Artificial Sequence: Synthetic coding sequence
atgggcgccactactatggaccaaaagtcgctgtgggccggagtggtggtgttactcttacttcagggcgggagcgcctataagcttgtatgttattttactaactggagccaagatagacaagaacccgggaaatttacaccggagaatatcgaccccttcctttgttcacacctaatatacagtttcgctagcatcgagaacaacaaagttattatcaaggacaaatccgaagtcatgttgtaccagacgataaattctttaaagaccaaaaaccccaagctcaagattctcctatctatcggaggttacctgttcggatccaaaggttttcaccccatggtggattcatctacatcacgtctggaattcataaatagtatcatcttgttccttagaaaccacaactttgatggcctggatgtgtcatggatatacccggatcagaaggaaaatacacatttcaccgtgctgattcatgagctggctgaggcctttcagaaggacttcaccaagtctacaaaggaaagactcctgcttacagccggcgtatctgctggccgccagatgatagacaactcctatcaagtggagaagttggctaaagacctcgacttcatcaacctactgtcattcgactttcatggctcatgggagaaaccactaataacgggacataactcaccattgagcaagggttggcaggatagggggccttcctcctattacaatgttgaatatgcagttggctattggatccacaaagggatgcctagcgagaaggtggtcatgggcatcccaacctatggccatagttttaccctagcgtcggccgaaacgaccgttggggcgcccgcgagcggcccaggcgctgctggacctattactgagagtagtggcttcctcgcctactatgagatctgccaattcctcaagggggccaaaatcacgaggctgcaggatcagcaggtgccctatgcagtgaagggcaaccaatgggtgggctatgacgatgtgaagtcgatggagactaaggtgcagtttctcaaaaatcttaatctgggtggggccatgatctggtctatcgatatggatgacttcaccggaaagtcgtgcaatcaagggccctatcctctggttcaggcggtgaagaggagtttgggcagcctgtag

SEQ ID NO: 5744 - DNA, 2202 bp, Artificial Sequence
  Description of Artificial Sequence: Synthetic coding sequence
atggccggggggcgagaaacatgcctaccactcattggatttattctgatctgtctgaaaatggtcgcgtcagccaaaagtgcccccgagatcccaaccattgatcaggcttatagcaaattgagcaactctatcactgtggagtgggccacggtgcctggtgcaacctcttacctgctcaccgccgaggatggggacacggtgatcgagacaactgtcgccaacagtcctggaaccgtaacggggctcaaggccgcaacatggtacgagattactattcggtcaattagcgcagcaggccgcagccaggcctcaccaccaaagcaggcgaaaacagtactcgcagcgcccatcctagaagtcagcagtccttcctctgactctattctggttcagtgggaggctgtttacatggcgattgcattctcagtctccattatgagggcaaatggtctcggcagtatatggaaagaaaacacaaccaacacaagcttgacattcacttccctggaagccggtaccctgtacacaatcaaggcatatgcctggaatgccaaccgtattcccggcgacgattccacctgcaatcagagaacctcacctagagcaccagctaacatccaagtaagcttcgactcaggcgcattaaaggccagttttagctgggctagagccgagggggccttcaactacactgtgatggctttaagcgattcttcagaattgacctgttctactacattctcttcttgtacgatcagttcccttcaatgtggaacggaatacttaataagcgtcctcgcgtctaacgatgccgggtctagtaagtctagtagcgcaatgactttgaagactgtggcctgcgcccctggcagggtcactatccaggaggacccacctggacacctgtcggtggcttggagttccgtggacttaggcgattactatgtggtcttcgttaaaagcgacgatggcctcgaggtgcattgcaacactagccttacccagtgcaatttcttgtccgagtgtggatttacgtactttatttcagtcttcgtgtacaacaaagctggacagtcccccttaggcgatatttttaattatacaaccgctccttgttgcccctccgacatcaatccagtgctggtcagcagcgatcgggtggagattgtttggtcccccgtgcgcggtgccgagctgtatgaaaccaaagccgtggacggttacaatatggtggagtgtaatgacaccacgcccgcatgtaccctgtccgccctggaatgtgacacaaagtataatatcacagtttacagctttaatgaggtgagaggctcaaacatgtcttgtacaccgcagttcatcactacagcaccttgtagcccagaaataaaaaatgtctcccgtgacgccttctctatgattaatgtgcattggcgcagcaccaatgacgacgcaacttacactgttacggcccaaggcgaaaaaggtttgtaccagtgcagcagtacaggcgaatcttgtacgatgcgcggcttgccttgtggctccgtcttttccgtaaccgcagtggctgagacgcaggcaggtaggtcattacctagctactctgtgcccctggagacagtgccatgttgtcctactgggctgacagtgacccaaataacccaatccgtgattaacgtgagctggaccattgggcgcgtcgctcagactcatgtcgccgtattagaaagtcataccggtcagagtaagtgtcacacccatcagaaccactgcctcttgggctgtatcacctgtggtatcaactatactgtaactctcaaggcgatatccgccaccggcttaactgccgattgctcatatcaaagctattttagcggcgcttgttgtccattgggtgtcaagttatacaggctgggtcccaatggcattcgtatctattggcaggcaagtcggggtagcgcaaactatagcactgatctctacggctctaaaggcatattcacctgtacgccatccgcaggtctcagcttctgcgacgttaccgagattccctgtggagatgtgtacaccgtgatggtgtcccctgtcgctaagacaggactgaagctcaccttttgcccaaagaagatctacagtgtaacatgcagtggatccaccctaggaatggttatttatcgcggaaaaagaaacgaagagtag

SEQ ID NO: 5745 - DNA, 555 bp, Artificial Sequence
  Description of Artificial Sequence: Synthetic coding sequence
atgagagggcagggccggaaggagtccctcagtgattccagagacctggacggctcctacgaccaactgacagacagcgtggatgatgagtttgagctaagcacagtatgtcaccgacctgaaggactcgagcagctccaagagcagacgaagttcacgcgcaaggaactgcaggtcctgtatcgcggtttcaaaaacgagtgcccgagtgggatcgtgaatgaggagaacttcaagcagatttatagtcagttcttcccccagggagacagcagcacgtatgccactttccttttcaatgcgttcgataccaatcatgatggttctgtgagcttcgaggagatgttagatattatgaaatcaatctatgatatgatgggcaagtacacctaccccgcactcagggaggaagcacctcgggagcacgtggaatcttttttccaaaaaatggacagaaacaaggatggtgtggtcaccatcgaggaattcatcgaaagttgccagaaagacgagaatataatgagaagcatgcagctgtttgacaacgtgatatag

SEQ ID NO: 5746 - DNA, 759 bp, Artificial Sequence
  Description of Artificial Sequence: Synthetic coding sequence
atgcggggtcaggggcgcaaggagtctctatctgattcccgtgatctggacggatcctatgaccaactaacgggccatccaccagggccaacaaagaaggctctgaagcagcgattcctaaaactgttgccctgctgcggtccacaggcactgcccagcgtgagcgagtccaacgtggacgacgagttcgagctatcaactgtctgccaccgacccgaaggtctggagcaacttcaagagcagacaaagttcacacgcaaggagctccaggtcctatacaggggctttaagaacgaatgcccttctggaatcgtgaacgaagaaaattttaaacagatttacagtcaatttttcccccagggggactcatctacctatgcgacatttctctttaatgcctttgatactaaccatgatggcagtgttagctttgaggacttcgtggccggactaagcgtgatccttagggggaccgttgatgaccgcctgaattgggcttttaacctgtacgacctgaacaaggacgggtgcatcaccaaagaagagatgctagatatcatgaaatccatctatgatatgatgggcaaatacacatatccggcactgagggaggaggcacctcgcgagcatgtcgagtcattcttccagaagatggaccgcaacaaagatggggtagtgacgattgaggaatttattgagtcttgtcagaaagatgagaacattatgaggagcatgcagctgttcgacaacgtcatctag

SEQ ID NO: 5747 - DNA, 1377 bp, Artificial Sequence
  Description of Artificial Sequence: Synthetic coding sequence
atgcaggccaccagtaatctgttgaacctcctgctgttgagtttgttcgccgggctcgaccctagtaagacgcaaatttcacccaaagagggatggcaggtgtattcatccgctcaggaccccgatggtcggtgcatctgcacagttgtggctcctgaacagaacctgtgtagccgagatgcgaagtcaaggcaactccggcagttgctcgagaaggtgcagaatatgtcacagagcatagaagtgctgaatctacgaacccagcgcgactttcagtacgtgttaaagatggagacacagatgaagggtctcaaagcaaagttccgtcagatagaagatgacaggaagaccttgatgactaagcactttcaagagcttaaggagaagatggacgagcttctgcctctcatacctgtcttggagcagtacaagacggacgccaagctcattacacagttcaaagaagagattagaaacctttctgccgtgctcactggcatccaagaggaaatcggcgcctatgactacgaagaactgcatcagcgcgttctgagcttggaaactcgcctgcgagactgcatgaaaaaactaacgtgtgggaagctaatgaagattacgggtcctgtcactgttaagacatctgggacccgattcggcgcctggatgaccgacccactagctagtgaaaaaaacaatagagtgtggtacatggatagttatacaaacaataagatagttagggaatataagagcatcgctgacttcgtgagcggcgcagaaagccgcacgtacaatttgccttttaagtgggcagggaccaatcacgtggtatacaacgggtccctgtactttaataaataccaatcaaatataattattaagtactcctttgatatgggaagagtgttggcccagagaagcctggaatacgcagggtttcataatgtgtacccctatacatggggaggctttagcgacattgacctgatggccgatgaaatcggattgtgggctgtatacgccacaaaccaaaacgccggcaacatcgtcatctcgcagcttaaccaggacacccttgaagtaatgaagtcatggtccacggggtacccgaagcgaagcgcaggggaatcatttatgatctgtggcaccttatacgtgactaacagccacctcaccggtgccaaggtctactactcttacagcaccaagacctcaacatatgaatatacagacattccctttcataatcagtatttccatataagcatgctcgactacaatgccagggacagggctttatacgcttggaacaacgggcaccaagtgttgttcaacgtgacactctttcacataatcaaaacagaggatgatacatag

SEQ ID NO: 5748 - DNA, 915 bp, Artificial Sequence
  Description of Artificial Sequence: Synthetic coding sequence
atgttaccccccccgaggccagccgccgccttggctctccctgtgctgcttttattactcgtggtgcttacccctccccccactggcgcaagaccctctcccggcccagactatttacgacgaggatggatgaggttactggccgaaggcgaagggtgtgcaccttgtcgcccggaggagtgcgccgccccacggggatgtctggcgggccgggtgcgggacgcctgtggatgctgctgggagtgcgcaaacctagaggggcaactttgcgacttggacccaagtgcccatttctacggtcactgcggcgaacagctggaatgccggctagacacgggcggggacctttctagaggtgaggtgccagaaccattgtgtgcgtgtcgatcgcaatcacctctttgtggtagtgacgggcacacctactctcagatttgccgcctgcaggaagcagcccgcgctcggcctgacgctaacttgaccgtggcacatcctggcccgtgcgaatccgggcctcaaattgtgtcacacccatacgacacatggaacgtcacaggacaagacgtcatcttcggttgtgaggttttcgcctaccccatggcatccatcgaatggcggaaggatgggctggatatccagttgccgggggatgatccgcacatctctgtccagttccgcgggggccctcaacgcttcgaagtaacaggctggctacagatccaggccgtgcggccctccgacgagggcacatataggtgtctgggccggaatgcgctcggccaggtcgaagctcctgcatctctcaccgtgctcacccctgaccagctcaattctactggtatcccccaattgcggagcctgaacctggttcccgaagaagaggcagaatccgaggagaatgacgactactattag

SEQ ID NO: 5749 - DNA, 327 bp, Artificial Sequence
  Description of Artificial Sequence: Synthetic coding sequence
atgaccccatctagactcccgtggctgctgtcctgggtttcagctaccgcatggcgcgctgcccgatccccgctgctctgccacagtctgcggaaaacttcatccagtcagggcgggaaatccgagcttgtgaaacaatctctcaagaaacccaagcttccagaaggcaggttcgacgcgcctgaggatagccatctagaaaaggagcctttggagaagtttccagatgatgtaaatcctgtaacgaaagagaaggggggaccccgtggccccgaacccacccgctatggagattgggagcgcaagggaagatgtatcgacttttag

SEQ ID NO: 5750 - DNA, 663 bp, Artificial Sequence
  Description of Artificial Sequence: Synthetic coding sequence
atggccgggctaagccgggggagtgctagggcacttctcgccgcactccttgcctctactctgctggcccttctggtctcccctgcgaggggccgcggcgggagggatcacggcgactgggacgaagcttcccgcctgccgccactaccacctagggaggacgcagcgagggtggcccgcttcgtgacccacgtgagcgattggggcgctctcgcgacaattagcaccctagaggccgtgagaggaaggcctttcgcagacgtgctatctctctcagacggtcctccaggagctggaagtggcgttccatatttttatttgtcgcccctgcagctatccgtaagcaacctgcaggagaacccgtacgcgactttgacgatgaccttagcccagactaacttctgtaaaaaacacggttttgatccccagtcaccactgtgcgtgcacataatgctgtccgggactgtgaccaaagtcaatgaaaccgagatggacatcgccaagcacagcctattcataaggcacccagaaatgaagacctggccttcttcccacaactggtttttcgctaagctcaatatcacgaacatttgggtcctcgactattttggtgggccaaaaattgtaacaccggaggaatattacaatgtgacagtacagtag

SEQ ID NO: 5751 - DNA, 2760 bp, Artificial Sequence
  Description of Artificial Sequence: Synthetic coding sequence
atgggtctgtttcggggcttcgtttttctgctggtgctctgcttgctgcaccaatctaataccagcttcattaagttgaacaacaacggattcgaagacattgtgattgtaatagatccgtctgtgcctgaggatgagaagatcatcgagcagattgaagacatggtgaccaccgccagtacttacctgttcgaggcaaccgaaaagcgctttttttttaaaaacgtgtctatccttatccccgaaaactggaaggagaacccacaatataaaagacccaagcacgagaaccacaaacacgctgatgtaatcgtggctccacccaccctacccggcagggatgaaccctatacaaagcagttcacggaatgcggcgaaaaaggcgagtatatccacttcactcccgacttgctcctcggaaagaagcaaaatgagtatgggcctcccggcaagctgtttgtccatgaatgggctcacctccggtggggcgtgtttgacgagtacaatgaagaccaacccttctatagggccaaaagtaaaaaaatagaagccactaggtgttcagccggcatttctggtaggaaccgggtgtacaagtgccaggggggcagctgcctttctcgcgcttgcagaatagactctaccacaaaactttacggtaaggattgccagttctttccagataaggtacaaaccgagaaggcttcgatcatgttcatgcagagcatagatagcgtagtggagttctgtaacgagaaaacccacaatcaggaggcaccctccctccagaacatcaagtgtaatttcagatccacctgggaagtgatatcaaacagtgaagatttcaaaaataccatacctatggtgacacctccaccgccccctgtcttctcgttgcttaaaatctcacagaggattgtgtgtctggtattagataaaagtggcagcatggggggcaaggataggctgaataggatgaaccaagccgcaaaacactttcttcttcagaccgtggagaatggttcgtgggttggaatggtccactttgacagcactgcaactatcgtaaacaaactcattcagattaagagtagcgacgaacggaacaccctgatggccgggctcccaacctaccccctcgggggcacctcaatttgttccggtataaaatatgcttttcaggtgattggagagctgcactcacagttagacggaagtgaagttcttctcctgactgatggagaagacaatactgccagttcctgcattgacgaggtcaagcagtctggcgcaatcgtacacttcatcgcactaggccgggccgccgacgaggccgtgattgaaatgtcgaaaataacaggtgggtcacatttttatgtgtccgacgaggcgcaaaataacggtctgatagacgcatttggggcgctgactagtggtaatactgatcttagccagaaatccttgcaactcgaatcaaaagggctcaccctgaactcaaacgcctggatgaatgatacagtgattatcgactcaacagtgggcaaagataccttttttctcattacatggaactctctgccgccaagcatctcattgtgggatcctagcggaacaatcatggagaactttaccgtagatgccacatcaaaaatggcttatctatctatcccgggaacagcaaaagtcgggacatgggcctataatctgcaagcgaaggcaaacccagaaacactcacaattacggtgacctctagagctgctaatagtagtgtaccccccattaccgtaaacgccaagatgaataaagacgtcaattccttcccctctcctatgatcgtttacgcagaaattctacagggctatgtgcccgttctgggtgcaaacgtgacagcattcatcgagtcccagaacggccacaccgaagttctcgagctgttagacaatggcgctggggcagacagtttcaaaaacgatggggtgtatagccgctatttcacggcctacactgagaacggacgctacagccttaaagttcgggcccacggaggagcgaataccgcacgcctgaaacttaggccccctctgaatagagcagcttacattccagggtgggtcgttaatggcgagattgaagccaatcccccgcggccagagattgacgaggacacccagacaactctggaagactttagccgaaccgctagtggaggggctttcgtggtgagtcaggtacccagcttgccacttcctgaccagtaccctccatctcaaatcacggacctggacgccaccgtgcatgaggacaagattattctgacttggacagctccaggagacaacttcgacgtggggaaagttcaacgttatatcatccgcatatcagcctccatcctggacctgcgggattcttttgacgacgccctccaggttaatactacagacctgagcccaaaggaagctaacagcaaggaaagtttcgcatttaagcccgagaatattagcgaagaaaatgctactcacatcttcatagcgatcaagtctattgataagtcaaacctgacttctaaagtcagcaacatagcccaagtgaccctgtttattccacaagccaacccagacgacatcgacccaaccccaacaccaacccctactccaacacctgataaatcgcacaacagcggagtgaatattagcactctggtcctgtcagtcatcggaagcgtggtcatagtgaatttcattttatcgaccacgatctag

SEQ ID NO: 5752 - DNA, 1938 bp, Artificial Sequence
  Description of Artificial Sequence: Synthetic coding sequence
atggctccctctgctgaccccggcatgagtagaatgctcccattccttctgctcctgtggtttctgccgataacagagggctctcaacgcgccgaaccgatgttcaccgccgtaaccaacagtgtactcccaccagattatgatagcaatcccactcagcttaactatggggttgctgtgaccgacgttgaccacgacggcgatttcgaaatagttgtggccgggtacaacggacccaacctggtactcaaatatgatcgtgcccagaagagactggttaatattgctgtcgatgaacgtagcagtccctactacgccctcagggaccgccaggggaacgctatcggagttactgcctgcgacatcgatggtgatgggcgtgaagagatctactttctgaacactaataacgcttttagtggcgtcgccacatataccgacaaactctttaagttccgcaataaccggtgggaagatattctttcagacgaagtaaatgtcgcacgcggagttgctagcctgtttgctgggaggagcgtcgcctgtgtggaccgcaagggttccgggagatattcaatttacattgctaactacgcgtatggaaacgtgggtcccgacgcgctaatcgagatggatccagaggcatcggatctgtctcggggtatactggcactgagggatgttgccgctgaggctggtgtcagtaagtataccggtggccgtggagtctccgtgggacccatcctgtcttcatctgcctctgacattttttgcgacaatgaaaacggacccaactttctcttccacaatcgcggcgatggcacattcgtcgacgcggcggcctccgcaggggtcgacgaccctcatcaacacggccgcggggtggcgctggccgatttcaatcgtgacggaaaggtggacatcgtttacggaaattggaatgggccccaccgactgtatctccagatgtccacgcatggcaaggtccgatttagggacatagcttcgcccaaattttctatgcccagccccgtccggaccgtcattacagcggattttgataacgaccaggaactggagattttttttaataacatcgcttataggagttcctcggcaaataggttgttccgggttatcaggcgagagcatggcgatcctctgatcgaggaattgaatcccggtgatgctctggagccagaaggcaggggtacaggtggggtggtaacagatttcgacggcgacggcatgctcgatctcattctgtcccacggcgagagcatggcacagcccctcagtgtatttagaggaaaccagggcttcaacaataattggctgagagtggtgcctcggacgcgctttggggctttcgcgaggggagctaaggtggtcctgtacacaaagaaatctggggcacacctccgcatcatcgacggcggatccggatacctatgcgaaatggaacctgttgctcacttcggactgggtaaagacgaggcttcaagtgtggaagttacctggccagatgggaagatggtttccagaaacgtcgccagtggcgagatgaattctgtgttggagatcctttatcctagggacgaagacacccttcaggatccggctcctctcgagtgcggccaaggattcagtcagcaggagaacggccactgtatggacaccaacgaatgtatacagttcccgttcgtttgtccccgggataagccggtctgcgtgaatacctatggatcttatagatgccgtacaaacaaaaagtgttcccgcggatacgagccaaatgaggacggcaccgcatgtgtggcacaagtcgcattcctcggcggatatagctctgccgcatcgagaatcagtgaacccctctctcgggcttcatatctctctctaggtctcgggctatgtcttcagctgtatgccctatag

SEQ ID NO: 5753 - DNA, 1986 bp, Artificial Sequence
  Description of Artificial Sequence: Synthetic coding sequence
atggcccccagtgcagaccccgggatgagccgcatgctgccttttctgctgttactatggtttcttcccatcaccgaggggtcccagagagccgagccaatgttcaccgctgtgactaattctgtccttcccccagattacgacagcaaccctacccagctgaattacggtgtggctgtcactgacgtagatcacgacggggacttcgagattgtggtggctggctacaacgggcccaacttggtgttaaaatacgaccgcgcccagaagagattggtgaatatcgccgttgatgaacgcagctctccatattatgccctaagagatcggcaaggaaacgccatcggcgtaactgcatgcgacatagatggcgatggccgtgaagagatatacttcctgaatactaacaatgctttcagcggagtggcgacgtacaccgataagctctttaaattccgaaataaccgctgggaagacatcctgtcagatgaggtaaacgtggctagaggcgtggcctctcttttcgccggacggagcgtagcatgtgtcgacagaaaaggctctggtcggtacagtatatacattgccaactatgcgtatggtaatgtagggcccgatgctctcatcgaaatggatcctgaagccagcgatttgtcccggggcatcctcgcgttgcgagacgtcgccgccgaggccggcgtaagtaaatacactgggggcagaggagtatccgtcggccccatcctctcgagcagcgcgtctgacatcttctgcgataacgagaatgggcccaacttcctgttccacaatcgtggcgatgggacctttgtggatgcggccgcgtcagcaggggttgatgatccccaccaacatggtcgaggcgtggccttagcagactttaatagggacggcaaggtggacattgtgtacggcaactggaacggtcctcatagactttaccttcagatgagtactcacggcaaagtacgcttcagggacattgcatcacctaagttttccatgccctctcccgtgaggaccgtcatcaccgctgactttgataatgatcaggagttagagatatttttcaataacatcgcctaccgatcgagctcagctaaccgacttttccgggttatcaggcgtgaacatggcgatcccctgattgaagagctgaatccaggcgacgcgctggagcctgaggggaggggcacgggaggcgtggtcaccgacttcgacggtgacggaatgctcgacctgattctttctcatggcgaatctatggcccagcccttatcagtgttccggggaaaccaggggttcaataataactggttaagagtcgtcccaagaacgcgcttcggagctttcgctcgaggggcaaaggtcgtcctttacaccaaaaaatctggagctcacctcagaattatcgacggtggcagtggttatctctgtgagatggagcctgtggctcactttggcctcgggaaggacgaggcttcttccgtggaggtcacttggccagacgggaagatggtgtcccggaacgtggctagcggcgagatgaattcagtgctggaaattctttatccacgggatgaagatacgttgcaggacccagccccactggagtgcggccagggcttttcacaacaggagaatggccactgcatggacacgaacgaatgcattcaatttccttttgtctgtcctcgggataagcctgtctgtgtcaacacatacggcagctacagatgtaggaccaataagaagtgcagccgcggctacgaacctaatgaagacggcacggcgtgcgtggggactttagggcaatccccgggaccgagaccaacgacacccacagcagctgctgctactgccgcggctgctgccgctgccggggccgccactgccgctcccgtcctcgtggacggggatctgaacctggggagcgtggtcaaggaaagctgtgagccctcctgctag

SEQ ID NO: 5754 - DNA, 1230 bp, Artificial Sequence
  Description of Artificial Sequence: Synthetic coding sequence
atggctttgaccccgggatggggcagctcagctggccccgttagaccggagctttggcttttgctttgggccgccgcctggagattgggggcttcagcatgtcctgcactgtgcacatgtacaggcacaaccgttgactgtcacggtacggggttgcaggccatccccaaaaatatccctcgtaacactgagaggctggaattgaatggcaacaacattactaggatccacaagaacgatttcgccggcttgaaacagttacgggttctacagctcatggagaaccagatcggcgcagtagagcggggggctttcgacgacatgaaggagcttgagcgtcttcgcttgaatagaaaccagctgcatatgcttcccgagctgctttttcagaacaaccaggcactgtcgaggttagatttgtctgaaaacgccatacaagcaatcccccggaaggctttccggggcgctactgacttgaagaatctccaactggacaagaatcaaattagttgcatcgaggaaggcgcattccgggcacttaggggtctagaggttctgacactcaataataataacattaccaccatccctgttagcagcttcaatcatatgcctaaacttcgcacttttaggcttcattcaaatcatctgttttgcgactgtcatctggcttggctgtctcagtggcttaggcagagaccaactattggactattcacccagtgctccgggcccgcgtctctgcggggtctgaacgtagcagaagtccagaaatctgagtttagctgttccggccaaggagaggccgggcgagtgccaacatgcaccctgagtagtgggtcttgccccgctatgtgcacgtgtagtaatgggatcgtggactgtcgaggcaaaggcctcaccgcaatcccagccaacctccctgagacaatgaccgaaattagattggaactgaatggcattaaaagcattccacccggggcattctccccctacagaaagctcaggagaatcgatctgtcgaataaccaaatcgcggagattgccccagatgcattccagggcctgagaagtctaaatagcttacacactgggcccgtaacgtgcccacataccaccggcacccacagctcacactgtagggcattcgctgttgcggttccacatagtaggaatgatctggaggctatgttcgaagaagaggttccacgcatcttctatagtgcatag

SEQ ID NO: 5755 - DNA, 1143 bp, Artificial Sequence
  Description of Artificial Sequence: Synthetic coding sequence
atggccctgacccctggttgggggagttctgctggtccagtgagacccgagctttggctcttgctgtgggccgctgcatggcgattgggggcaagcgcctgcccagcgctttgcacctgtaccggtaccaccgtcgattgccacggaaccggtctacaggcaatcccaaaaaacatcccccgtaacacagaaagactggaactgaacggaaacaacatcacacggatccataaaaacgatttcgctgggcttaaacagctacgggtattacagctgatggaaaaccaaattggggccgtagaaagaggcgcattcgacgacatgaaggagttagagcgacttgacctctccgagaacgctatccaggctattcctcgtaaggcatttcgcggcgcgactgacctgaagaacctgcaactcgacaaaaatcagatcagctgtatagaagaaggggccttccgggccctgcgggggctggaagtgctgaccctgaacaataacaacattactaccatcccagtttcttcatttaatcacatgccgaaactccgcacttttcgactgcacagcaaccatctattctgcgattgccacctagcctggctttctcagtggctgagacagagaccaactataggtctgtttacgcaatgttcggggcctgccagtctgcgcggactgaacgtcgccgaggtacagaaaagcgagttctcctgcagcggacagggagaagccggtagagtgcccacatgcaccctgagtagtggctcttgccccgcaatgtgtacatgttccaacgggattgtggactgcagaggcaaagggcttactgccatcccagccaacttgccagagaccatgactgaaattagactggagctgaacggcatcaagtccattcctccgggagctttttctccctatagaaagttgagaaggatcgacttaagtaacaatcagatcgccgaaattgcacccgatgctttccagggtttgaggtcccttaattccctggtgttgtatggcaacaagatcacagatttgcccaggggcgtttttgggggtctgtacaccctgcagctgctgctactgaacgccaataaaatcaactgtattaggcccgatgcttttcaggatctatag

SEQ ID NO: 5756 - DNA, 2448 bp, Artificial Sequence
  Description of Artificial Sequence: Synthetic coding sequence
atggctctgaccccaggatggggctccagcgctggaccggtccgtcccgagctgtggttgctgctttgggccgctgcctggagactgggggcttccgcctgcccggcactttgcacgtgtaccggcacaaccgtagactgtcatgggactgggctgcaggcgatccccaagaacatacccaggaacactgagcgattggagcttaacgggaataacataactcgaatccataaaaacgacttcgctgggctgaagcaattacgtgttctgcagctgatggaaaaccagattggcgcagtagaacgcggggcgtttgatgatatgaaagaactcgaacggctgcgcttaaacagaaatcagctgcacatgttgccagagcttctgttccagaacaaccaggctcttagcaggctggatctatccgagaatgcaattcaggctatcccccgcaaagccttccgcggcgccactgacctaaaaaaccttcagttggacaaaaatcaaatctcctgcattgaagagggagccttcagggccttacgggggctggaagttcttaccttaaataacaacaacattaccaccataccggtgtcatcttttaatcacatgcccaaactgcgaacttttaggctgcattcaaatcatcttttctgcgattgtcatttggcctggctgtctcagtggctccggcaaaggccaacaatcggtctgtttacccaatgctccggccccgcaagtttacggggactaaacgtcgcagaagttcagaagagcgagttttcatgttctggacaaggcgaggccggccgcgtgcccacctgcacccttagcagcgggtcatgtcccgccatgtgtacatgttctaacggaatcgtagattgccgcggcaaggggctcaccgccatccctgccaatctgccggagactatgactgaaatccgattggaactgaacgggattaaatctattcccccgggtgccttctccccctaccggaagctaagaaggatatgtccactttcattctgttccccatgccgggatctgagtaataaccagatcgccgagatcgctcctgacgctttccagggtctaagatctttgaattcgcttgtactctacggcaacaaaataacagatctgccaaggggggtctttgggggcctgtacaccctgcagctactattgttgaatgcgaataaaatcaattgcatccgccctgacgcctttcaggatttgcagaacctttccctgctgagtctatacgacaataagattcagtcactggctaaggggactttcaccagcctccgtgcgatccagactttgcacttagcacaaaatccatttatttgtgactgcaatctcaagtggttagccgacttcctcaggacaaaccccatagagacatccggggcccggtgtgcaagcccaaggaggctggcaaataaacgtatcggacagatcaaaagtaagaagtttagatgttctgccaaagagcaatattttataccaggcactgaggactatcagctgaactccgagtgtaactcagatgttgtctgtccacacaagtgtcgctgcgaggccaacgtggtcgagtgtagcagtttgaagctgacgaagatccccgaacgtatcccccagagcaccgcagagctaagacttaacaacaacgaaattagcattttggaagccactggtatgtttaaaaaactcactcatctgaaaaagataaacctgtctaataacaaggtcagcgagatcgaagatggtgcttttgagggagccgccagcgtgagtgaactgcatctgacggcaaatcagctcgaatccatccggagtgggatgtttcgcggtctcgatggcctccgcacactgatgttgcgcaacaacagaatatcctgtatccacaacgatagttttactggactccgaaatgtgaggctgctgtccctgtacgataatcagataactaccgtttctcccggagcgttcgataccttacaatcgctcagcacactgaatttgctagcaaatccttttaactgcaactgtcagttggcttggctgggtggttggttaaggaaacggaagatcgtcacaggcaatcctagatgccagaacccagattttctgcggcagatcccccttcaggatgtggcatttcccgacttcagatgcgaggaaggtcaggaggagggtggctgcctcccccgcccccagtgcccccaggagtgtgcatgcctagatacagttgtgcggtgctccaataaacacctacgggcccttcctaaaggcatcccgaagaacgttaccgaactgtacctggacggcaaccagttcaccttggtgcctgggcagctctcaacttttaagtatctgcagctcgtaatcctcagctacaacgcactgcagtgtatccctcccctcgccttccagtag

SEQ ID NO: 5757 - DNA, 4386 bp, Artificial Sequence
  Description of Artificial Sequence: Synthetic coding sequence
atggcccttactccggggtgggggtcctcagccggccctgtcagacccgaactctggctactcctttgggcagccgcctggaggttaggtgcaagtgcatgcccagcactgtgcacctgcactggtacaaccgttgattgccatggcaccggcctgcaggcaattcccaagaacattccgcgaaacactgagcgtcttgaactcaacgggaataatatcaccaggattcacaaaaacgacttcgccggactaaaacagctcagagtcctgcaacttatggaaaaccaaattggggccgtggaacgcggagcttttgacgatatgaaggaactggaaagactccggctcaatcgcaaccagctccatatgctacctgagcttctcttccagaacaaccaagcgttgagtcggctggacttgagcgagaatgctatacaggccatccctcgtaaggccttccgtggcgctactgacctgaagaatctgcagctggataagaatcagatctcttgcatcgaagaaggcgctttccgggcgctgaggggccttgaggtgcttaccttgaacaacaacaatatcaccacgatcccagtgtcgtcatttaaccacatgcccaagttaagaaccttccggctacatagtaaccatctattttgtgattgtcacttagcgtggctgagtcagtggctgaggcaaaggcctactataggtttattcacccagtgttctggcccagcctctctgagggggctaaatgtggctgaggtgcaaaagagtgaatttagttgcagtgggcagggggaggcgggtcgggtccccacctgtacactatctagcggtagctgtccggccatgtgcacgtgttcaaatggcatcgtcgattgtaggggcaaaggactgaccgctatcccggcgaatctgccggaaactatgacagagatccgcctggaactgaacggcataaagtcgattccaccaggcgcttttagcccttacaggaagctgcgacgcatcgacctgagcaacaatcagattgctgagatcgctcctgatgcattccagggattgcgctcactgaacagcctggtgttgtatggcaacaagattacggatcttccaaggggagttttcggtgggctttatactctccagctgttactgctgaacgctaataagataaactgcattcgtcccgacgcctttcaagatctgcaaaacttaagtcttctctccctgtatgataataaaattcagagcctggcaaagggcacgtttacaagcctgcgtgctatccaaaccctccacctggcccagaaccctttcatctgtgattgtaatctcaagtggctggctgacttcttaagaactaatcctatcgagacatctggcgcccgatgcgctagcccgagacgcctggccaacaagagaattggacagatcaagtccaagaagttccgatgctcggccaaggagcagtatttcatccctggtacagaggattaccagttaaactctgagtgtaattcagatgttgtgtgtccccataagtgtaggtgcgaggccaacgtggtggagtgctcttctctcaagctgacaaaaatccccgaaagaattccacagtctactgctgaattaagactcaacaataatgagatcagtattctcgaggccacaggcatgttcaagaagcttacccacctgaaaaaaatcaacctatccaacaacaaggtcagcgaaatcgaagacggggcattcgagggcgctgccagtgtcagcgagctccacctaaccgcaaaccagctggaatcaatccgtagcggaatgttccgggggcttgacggtctgcggaccctaatgttgcgcaataacagaatctcctgcatacataacgactcctttactggacttcggaatgtgagattgctgagcctctatgataatcagatcacaacagtttcgcccggtgcattcgataccctgcagagcctgtctactctcaacttgttagctaatcccttcaactgcaactgccagctcgcctggctggggggctggcttagaaaaaggaaaatcgtgaccgggaacccgcgatgccaaaaccccgatttcttaagacagattccattacaggatgtggccttccccgactttagatgtgaagaagggcaggaagaggggggttgtctgccacgtccgcagtgcccacaggagtgcgcctgtctggacactgtcgtaagatgtagcaacaaacatttgcgggcattgcctaaggggataccaaaaaacgtgactgagttgtacctcgacggcaatcagtttaccctggtgccaggacagctttccacttttaaatatctccaattggtggacctctcgaataacaaaataagctcactcagcaactcgagttttacaaatatgtctcagttaaccacccttatactctcttacaatgctctccaatgcattccaccacttgccttccagggattgagaagcctcaggttactttccttgcatgggaatgacatcagcacactgcaggaaggtatattcgcggacgtgacaagtctttctcatctggccatcggagcgaatccactgtactgcgattgccacttgcgctggctatcctcctgggttaaaacaggttacaaggagccaggcatcgcacggtgcgcgggcccccaggatatggagggcaaactgctgctgactactccagcaaagaagttcgagtgccagggcccccctacactggcagtccaggctaaatgtgacctgtgcctctcatccccatgtcagaatcagggaacttgccacaacgatcccctcgaggtttaccgatgcgcttgcccgagtggctacaaggggagagactgcgaggtgagtctggatagctgttcatcaggtccttgcgagaacggggggacatgccacgcccaggagggggaagacgcacctttcacctgtagttgtccaactggctttgaggggcccacttgcggagtgaataccgacgactgtgtggatcacgcctgcgcgaacgggggagtatgcgtggatggagttgggaactatacatgccagtgcccactgcagtatgaggggaaggcctgtgaacagcttgtggacttgtgtagccccgacttgaatccatgtcagcatgaggcccagtgcgtgggaacacctgacggcccacggtgcgagtgtatgccaggttatgcgggagacaattgtagcgagaaccaggatgactgccgggatcacaggtgccagaatggtgctcagtgtatggacgaggtcaacagttattcgtgtctttgcgccgaaggctactctggacagttatgcgaaatccctccccatctccccgccccaaaatcaccctgtgaggggacagagtgccagaatggggccaattgtgtggatcaggggaaccgaccagtctgccaatgcctgcctggattcggaggacccgagtgtgaaaaactgctgtctgtcaactttgtcgatcgggatacttacctccaattcaccgatctgcagaactggccccgcgccaacatcacgcttcaggtgagtaccgcagaagacaacggcatacttctgtacaacggagacaatgatcatattgctgtcgaactgtaccagggccacgttagagtcagctacgatcctggtagctacccttcctccgctatctattccgcagaaactatcaacgacggacagtttcataccgtggagctggtggctttcgaccaaatggttaatctcagtattgacggcggcagtcccatgacaatggacaacttcggcaagcattacacactgaattctgaggcaccattgtatgtggggggcatgccggtggacgttaactccgcagctttcagattgtggcagattcttaacgggaccgggtttcacggctgcatccgcaacctgtatattaacaatgagctgcaagacttcaccaagacccagatgaaacctggcgtggtgcctggatgtgagccgtgcagaaagctgtattgtctgcacggcatctgtcaacccaatgccacaccgggcccaatgtgccactgcgaagcgggctgggttgggctgcattgtgaccaacccgccgatggcccttgccatgggcataagtgcgtacacggccagtgtgtgcctcttgacgctttaagttacagttgccagtgtcaggatggttacagcggggccctctgtaatcagtccccctctgcgggtggaaccttaagcgggactttcacaaggagtcgcggagcaatgcctagcgcgcgtccccgagccccatgccacgggtggtccgccggagccagggctcaagctcgtgccgctgccagggccttcggctag

SEQ ID NO: 5758 - DNA, 570 bp, Artificial Sequence
  Description of Artificial Sequence: Synthetic coding sequence
atggaggccacgggtacagatgaagtcgacaaactgaagacaaaattcatttctgcttggaataatatgaaatatagctgggtactgaaaaccaaaacctacttttcacgcaactccccggtcctgctgttgggcaagtgttatcacttcaagtacgaggatgaggataaaaccctgcccgccgagtcaggctgcactatagaagaccacgtgattgcaggaaacgtcgaggaatttaggaaggactttatcagcagaatctggctgacataccgagaagaatttccacagatcgagggctccgccctgaccaccgactgtggctgggggtgcaccctccggacaggccagatgttgcttgctcagggtctgatccttcactttctgggacgagcgtggacatggccagacgcgctgaatatagaaaattctgattcggagtcatggactagccacactgttaaaaagtttacagcgtcctttgaggcaagcttgtcaggggagagggagttcaaaacacccacaataagcctaaaggagaccatcggcaagtactcggatgatcattag

SEQ ID NO: 5759 - DNA, 1377 bp, Artificial Sequence
  Description of Artificial Sequence: Synthetic coding sequence
atggaagcgacgggcactgatgaagttgacaaactcaaaaccaagttcatctccgcatggaacaatatgaagtactcctgggtgttgaaaactaagacttacttcagtcggaacagtcccgtactactcctgggtaagtgctaccactttaagtatgaggatgaggataagactttgccagccgagtctgggtgtactatcgaagaccacgtgatagcaggcaacgttgaggaattccggaaagactttatctctagaatttggctgacctaccgcgaagaattccctcagattgaaggctctgctctgacaacagattgtgggtggggttgtactctgcgcacaggccagatgcttttggctcaaggcctgatcctccacttcttgggcagggcatggacgtggcctgatgcattgaacatcgagaattctgactcagagtcgtggacttcccacactgtgaagaaattcacggccagctttgaggcatctctgagcggggagagggagttcaaaacccctacaatttcactcaaggagaccatagggaagtatagtgatgatcacgaaatgcggaacgaggtgtaccataggaagatcatatcatggttcggcgattcacctctggctctatttggcctgcaccagctcatcgaatatggtaaaaaaagcgggaaaaaagctggagactggtatgggcctgctgtggtagctcacatcctgaggaaggcagtagaggaggctaggcacccggatctgcagggcatcacaatctatgttgctcaggactgtactgtctataacagtgacgtcattgataaacagtcagcctctatgactagcgacaatgcggacgacaaggctgtcattatcttggtaccagtgagactcgggggcgaacgaactaacaccgattacctagagttcgtgaaaggaatcctttctctggaatactgcgttggcattattggtggcaagccaaagcaaagttactactttgctggcttccaagatgattcacttatctacatggaccctcattattgccaatctttcgttgacgtgagcatcaaggacttccccctcgaaacatttcattgtcccagtccaaagaagatgtcctttcgtaaaatggaccccagctgcacgatcggtttttattgtcgtaatgtacaggattttaagagggcctccgaggagatcactaagatgcttaagttctcctccaaggaaaaatatccactgttcacctttgttaatggccattccagagattatgacttcacttcaactacaactaatgaggaagatctgttctctgaagatgaaaaaaaacaacttaagcgctttagcaccgaagaatttgtgctgctgtag

SEQ ID NO: 5760 - DNA, 8178 bp, Artificial Sequence
  Description of Artificial Sequence: Synthetic coding sequence
atggagcagaccgattgcaagccttaccagcctcttccaaaggtgaaacacgagatggacctcgcttatacatccagttctgacgaaagcgaggatggtcgtaaaccgaggcagtcttacaactcaagagaaacgttacatgaatataatcaggaactgcgcatgaattataacagccagagcagaaaacgaaaagaagttgagaagtccacacaagagatggagttctgtgaaacttctcacacactgtgttccggatatcaaacggatatgcattcggtgtctcggcacggctaccaactcgagatgggctcagatgtcgacaccgaaacagagggcgctgcctctcccgaccacgccctgcgtatgtggattagggggatgaaatctgagcactcttcctgcctcagctctcgagccaactcagccttgagtctgactgacaccgaccatgagcgcaagagcgacggtgaaaatggatttaaatttagtcctgtgtgctgcgatatggaggcgcaggcaggctccacccaagatgtgcagtcgagcccacacaatcagtttaccttcagacccctacctccacctccaccccccccacatgcctgtacatgcgctaggaaacctcctccagctgccgattccttgcaacgtagaagcatgacaacccgatcacaaccatcccctgcggcgcctgctccccccacaagcacccaggatagcgtgcacctccataactcctgggttctgaattcgaatatccctcttgagacgcggcatttcctctttaagcatggatccggtagctctgctatcttttcagcagcctctcagaattatcctctcacctctaatacggtctacagccctccccctcggcctcttcctcgctcaactttctctagacctgccttcactttcaataagccctatcgctgttgcaattggaagtgtacagccctaagcgccacggcgatcactgtgaccctggctctcctgctggcatacgtgattgcagtgcacctattcggcttgacttggcaactccaacctgtggagggagagctgtatgccaacggggtctcgaagggtaaccggggcacggagagcatggataccacctattcccccattggcggtaaagtgagcgataagagcgagaagaaagtgttccagaaaggaagggcaatagacactggagaggttgatataggcgctcaagtgatgcagaccattccaccaggtctattctggaggtttcagataactatccaccaccccatttatttgaagttcaacatcagccttgccaaagacagcctcctcggtatttacggccggaggaatattccccccacacacactcagttcgacttcgtcaaattaatggacggcaagcaactcgtaaaacaggacagcaaaggctctgatgacacacaacatagcccaagaaacctcattctgacatccctacaggaaacggggttcatagagtacatggatcagggtccatggtacctggccttttataacgatggaaagaaaatggaacaggtgtttgtgctgacgaccgccatcgagatcatggacgactgtagcacaaactgtaatggcaacggagagtgcatatctggccactgtcactgtttcccgggcttcctgggccccgattgcgcacgggatagctgtccggtgctgtgtggtgggaacggcgaatacgagaagggccactgtgtgtgtcgccacggctggaaagggcccgagtgtgacgttccggaagagcaatgtatcgatccaacctgtttcggccacggcacgtgcattatgggggtttgtatctgcgttcccggttataaaggggagatttgtgaggaggaagattgcctagatccaatgtgctctaaccacggcatatgtgtcaaaggggaatgccactgctccactggctggggcggcgttaattgtgaaaccccactgcctgtgtgccaagaacagtgctccggtcatggtacatttctcttagatgccggggtctgctcttgtgatcctaagtggacgggcagcgactgtagcaccgagctctgtactatggagtgcggatcgcatggggtatgcagtagaggaatctgtcagtgcgaggaagggtgggttgggcctacatgtgaggaaaggtcctgccacagtcactgcacagagcacggccagtgcaaggatggcaaatgcgagtgtagccctggttgggagggagaccattgcactattgctcactacctcgatgctgtgcgggacggctgtcccggcctgtgtttcggtaatgggcggtgcactttggatcagaacgggtggcactgcgtttgtcaggtggggtggtccggaacagggtgcaacgtggtgatggaaatgctttgtggcgataacctcgacaacgatggagatgggttgactgattgcgtggatcccgattgttgtcagcagtccaactgctatatctcgcctctgtgtcagggatctccagacccgctcgatctgatacaacaaagccagacattgttctcccagcacacatctaggttgttttatgatcgtatcaagttcctgatcgggaaagactccacacatgtcattcctcctgaggtgtcctttgattcgagaagagcttgcgttatccgcggacaggttgtggctatcgatggcacacctctggtgggcgtgaatgtgtccttcctccaccatagcgattatggatttactatttcgaggcaggacggatctttcgacctggtcgcgatcggtggcatctctgtcatccttatatttgacaggtccccttttcttcctgagaagagaaccttgtggctcccctggaatcagtttattgtggtggagaaggtgacaatgcagagagtagtgtccgatccgccaagttgtgacatctcaaattttatttcgcccaaccctattgtgctcccatcacccctgacgagtttcggtggctcttgccccgaaaggggcacaatcgttcctgagctgcaggtcgtgcaggaggaaatccccatccccagcagctttgtgcgcctgtcgtatctgtccagtaggacccctggctataaaactctccttaggattctgctgacacatagcaccatcccagttgggatgataaaggtgcatctgaccgtagctgtcgaggggcgccttacccagaagtggtttcctgcagcgattaatctcgtgtatacatttgcttggaacaagaccgacatctacggccagaaagtgtggggacttgccgaagcactggtgtcggtgggctatgaatacgagacatgtccagacttcatcctctgggaacagcgcactgtggtgctgcaaggctttgaaatggacgcctctaacctcggcgggtggagccttaataagcatcacattctgaatcctcaatcgggcatcatacacaagggaaacggcgagaatatgttcatcagccaacagcctcccgtcatctctaccataatggggaacggacatcaacggtctgttgcatgtaccaattgcaacggaccagctcataataataagttgttcgctcccgtcgcgcttgcatctggccctgatggttctgtgtacgtgggcgacttcaatttcgtccggcgaattttcccgtcagggaattcagtctctattttggagctcagcacctctcccgctcacaagtattatctcgccatggacccagtcagcgaatccctgtacctgagcgacaccaacacccgcaaagtgtataagcttaaatctctcgtagagacaaaagacctgagcaaaaacttcgaggtggtagccggtacaggcgaccaatgcctgccttttgaccagagtcattgtggcgacgggggacgagcgagtgaagcctccctgaatagtccccgtggaataaccgttgatcggcacggcttcatttacttcgtagatggtactatgatcaggaagatcgatgagaacgccgtgataaccaccgtgattggttccaacggcctcacctccacccagcccctgagttgcgatagtgggatggacattactcaggtgagactggagtggcctaccgatctggcagttaacccaatggacaattcactctatgtgctcgacaataacattgtgctgcaaatctcagaaaatcgtcgggtccgcataatagccgggcgcccaattcattgtcaggtccccggaatcgaccactttctggtgagcaaggttgcaatacattctactcttgagagcgctagagcaatatctgtatcccacagcgggctgctgtttattgcagagactgatgaaaggaaagtaaaccgcatccagcaagtgacgacgaacggcgagatttatatcatcgccggcgccccaactgactgcgattgtaaaatcgatcctaactgcgattgcttcagcggagatggagggtatgcgaaggacgccaaaatgaaagcaccaagttctctagcagtgtcccccgacggtaccctgtacgttgctgacctcggtaacgttagaatcaggacaatttcccgcaatcaggcgcacctgaatgatatgaacatctacgagatcgcatcaccagcggatcaggaactctatcagtttacagtgaatggcacccacttgcatacgctgaacctaatcacccgcgactacgtgtacaatttcacttataacagtgagggtgacctgggcgctatcacttcatcaaacgggaatagtgtgcatatccgacgtgacgcaggcggcatgccactttggttagtggtgccggggggccaggtctactggctgacaatctccagcaacggcgttctgaaacgggtcagcgcgcaaggctacaacctggccctgatgacctaccctggtaatactgggctgctggccactaaatcgaatgagaacgggtggaccactgtgtatgaatacgaccccgaagggcacctcacaaacgccacctttcccacaggggaggtctcctccttccattccgacctcgagaaattgactaaagtggaactcgatacctctaacagggaaaacgtcctgatgtcaacaaacctaaccgccacgtctactatttacattctcaagcaagaaaatactcaaagtacttaccgggtgaacccagacggaagcctccgagtgacttttgcaagtggcatggagatcgggctgagttcagagccccacattttggccggcgcagtcaacccaactctggggaaatgtaatatctccctgcccggtgagcacaacgctaatctcatcgagtggcgccagcggaaagaacagaataaaggaaatgtgagtgccttcgagcggcgtctacgggcacataatcgaaatcttctttctatcgacttcgatcacattacgcgaactggcaagatttatgacgaccacagaaagttcaccctgagaatcctgtatgaccagacaggacgccccatcctatggtcacctgtcagcaggtacaatgaagtgaacataacatactcgccatcaggcctggtaactttcatccaacggggcacctggaatgaaaaaatggaatacgatcagtctggtaaaattatctcccgaacgtgggctgatgggaaaatctggagctacacatacctcgaaaaaagtgtaatgctgcttctgcattcccagcgacgttacatctttgagtatgatcagccagattgtttgctgtctgtgaccatgcctagcatggtccggcactcgttgcagaccatgctgtctgtgggatactaccgaaatatctatacccctccagactcttctacaagtttcatccaagactattctcgggatggtcgcctactgcaaaccctacacctcggaaccggccgcagagttctatacaaatacactaagcaggctcgactatccgaggtgctctacgacactactcaggtgaccctcacatacgaagagagctctggcgtcatcaagaccatccacctgatgcatgacggattcatatgtacgatacggtaccgtcaaactgggcccttaattggccgccaaatcttcagatttagtgaggaaggcctggtaaatgccaggttcgattattcatacaataactttagagtgacctcaatgcaggctgtgatcaacgaaactcctctccctatagatttgtatagatatgtggacgttagcgggcgaaccgaacagttcggcaagtttagtgtgatcaattatgacttaaatcaggtaatcaccactacagtcatgaagcacaccaagattttttctgctaacggccaagtgattgaggtccagtatgagattcttaaggcaatcgcttattggatgaccatacagtacgataacgtgggcagaatggtcatatgcgacatcagagtgggagtggacgccaacataacccgatacttctacgagtacgacgcagacggtcagctccaaacagtgagcgtgaacgataagacgcaatggaggtacagctacgacttaaatggcaatatcaaccttcttagtcacgggaagtccgccaggttaacacctcttagatacgatctccgagatcgcatcactcggctgggagagattcagtacaagatggatgaggatggatttctccgacagagaggaaatgacatattcgagtacaactccaatggcctgctgcagaaagcgtataacaaagccagtgggtggacggtacagtattactacgatggtctgggccggcgcgttgcttctaagtcatcactcggccagcatctccagtttttctacgccgacctgaccaatcctattagagttacccacttgtacaaccacacttctagcgaaattacaagcctctattacgaccttcagggccaccttatcgccatggaactgtcttcaggagaggagtactacgttgcctgcgataataccgggacacctctcgctgtcttctcctcccgggggcaggtgattaaggaaattttgtacaccccatacggggacatttaccacgatacatatccagacttccaggtgattattggatttcatggggggctatatgacttcctcacgaagctcgtgcaccttggccagagggactacgacgtggtggcaggacggtggacaacccccaatcatcacatttggaaacaattaaacctgctgcccaagcccttcaacctatactcctttgaaaataactacccagtcggaaagatccaggatgtcgcgaaatacacaactgacattaggtcatggttggagctgtttggatttcaactgcacaatgtcctgcccggctttccgaagccagagcttgagaatttagagctgacctatgagctcctacgcctgcagactaaaacacaggagtgggacccagggaaaacaatacttgggatccaatgcgagttacagaaacagttacgcaattttatcagcttagaccagctgcctatgaccccacgctacaatgacggtcgctgtctggagggaggcaaacaaccccgtttcgctgccgtgccaagcgttttcggaaaagggattaaatttgccataaaagatgggatcgtcaccgcggacattatcggggtagcaaatgaagatagcaggcgcctggccgccatcctgaataatgcacactatttggagaacttgcatttcacaattgaaggtagagacacccactattttataaagctgggctcactcgaggaagacttggttctcatcggcaacacaggtggacgacgaatcctggaaaatggcgttaacgtcactgtttcccaaatgactagtgtactgaatggacgcacaagacggtttgccgacatacagctgcaacacggagcactatgtttcaacattcggtacggaacaacagtggaagaggaaaagaaccatgtgctggagatagccagacaacgggcagttgctcaagcctggactaaagagcaaaggcgccttcaggaaggagaggaaggcattcgggcatggactgaaggcgagaagcagcagctcctgagcacaggtcgcgtacagggttatgatgggtacttcgttctcagtgtggagcaatatcttgagctctctgatagcgcaaataatatacactttatgcgccagtccgaaatcggccggcgctag

SEQ ID NO: 5761 - DNA, 204 bp, Artificial Sequence
  Description of Artificial Sequence: Synthetic coding sequence
atgaaaattcagcttttctttttcatcctgcacttttgggtgactattttacctgccaagaaaaaatacccggaatacggaagcctagacctacgcagagagtgccggataggcaacggccagtgtaagaatcagtgccacgaaaatgaaatcagaatcgcctactgcatacgaccaggcacccattgctgcctgcaacagtag

SEQ ID NO: 5762 - DNA, 831 bp, Artificial Sequence
  Description of Artificial Sequence: Synthetic coding sequence
atgaaacagatccttcatcctgccctggagaccaccgcttgtaccaaccactttaacgccgatccctgctccaccggcttcgtgttcccagccatgaccctgttcccagttttgctgttcctcgtggctgggctgctgccttctttccctgctaacgaagataaagatcctgcctttactgctttgctgaccacccagactcaggtccagagagagattgttaataagcataacgagctgagaagagccgtaagcccacccgcccgtaacatgctaaaaatggaatggaacaaagaagccgccgcaaatgcacagaaatgggctaatcagtgcaattaccgccactctaatccaaaggaccggatgacttctttgaagtgcggcgagaacttgtacatgtctagcgccagcagcagctggagtcaggccatccagtcctggtttgacgagtacaacgacttcgacttcggtgtgggacctaaaacgcctaacgcagtggtggggcattacacccaggtggtgtggtacagttcttatttagtcggatgtgggaacgcatactgccccaaccagaaggtactcaaatattattacgtttgccagtactgccctgccggcaattgggccaaccgactatacgtgccttacgagcaaggagctccctgtgcctcttgtcccgacaactgcgacgacggactctgtacaaatgggtgtaagtacgaggatttgtacagcaattgcaagtctcttaagctaacactgacatgcaaacatcagcttgtccgcgatagttgcaaagcttcctgcaattgctctaactctatttactag

SEQ ID NO: 5763 - DNA, 1350 bp, Artificial Sequence
  Description of Artificial Sequence: Synthetic coding sequence
atgctcgcagaatggggtgcctgtctcctcctagccgtggccctgctcggacccggactgcaagcgcaggctatggaaggagtgaaatgcggaggagtgttgagtgcaccatcaggcaattttagctctcccaactttccacgcctgtacccctacaatactgaatgcagttggttgatcgtggtcgctgaggggagctctgtattactcacttttcacgcttttgatttggaatatcacgatacttgctccttcgatttccttgaaatttacaatggagccagcccggataagggcaacttgctcggacggttttgcggaaaagtccctcccccccccttcacatcttcctggcatgtgatgtctgtcattttccattcagacaaacacgttgcctcccacggtttcagcgcaggctaccagaaagatgtttgtggcggggtgctgaccggcctctccggcgttttgaccagtcctgaatacccgaacaactaccccaactccatggagtgtcactgggtgattcgagcggccggccccgcccatgttaaattagtgttcgtggatttccaggttgaaggcaacgaggaatgtacctatgactatgtggcagtcctcggaggcccaggaccaaccagaggacatcactactgtggatcaacaagacctccgacgcttgtttcacttggtcacgagctgcaagttgtgttcaaaagcgatttcaatatcggaggaagaggcttcaaagcatattatttcagcggggagtgccaagaagtatatatggctatgagggggaacttcagttccccccagtacccctccagttacccaaataacattcgttgccactggacaatcaggctacctcctggatatcaggtgaaagtcttctttctcgacctggacctcgaggaaccaaattccctaaccaaaacatgcgattttgatcatctggccgcatttgatggcgcctccgaggaagcccccctcctgggaaactggtgtgggcaccacctccccccaccagtgacgtcatctcataatcagttattgcttctgcttcacacagacaggtcaactaccaggcgaggattcagcgtcgcttatatcggtggccagctggggtgtggcagtggctccacggaaggtgagggtgaggccctgcagcctcaatcactccaatcaccctcatccatccctcctgtgtgtccagctccccctatgaacggccttctgcagctgctgttacactggctacatccctgtccactcagtggcccactgagactcgatggcaccgcccccgcttgttttcactattgcagagcttcatttcctagcttctag

SEQ ID NO: 5764 - DNA, 1434 bp, Artificial Sequence
  Description of Artificial Sequence: Synthetic coding sequence
atgacaagtaagttcctgctcgtctctttcatcctggcagctctgagcctatctactaccttctctctccagccagaccagcagaaggtgctgctagtgtccttcgacggctttcgttgggactatctatacaaggtacccacgccacactttcactatatcatgaagtatggcgtgcatgtgaaacaggtgacaaatgtctttattacgaagacatacccaaaccactacactcttgtcacaggtcttttcgctgagaatcacggaattgttgcaaacgacatgttcgacccgatccgcaacaagtcttttagcctggatcatatgaatatctatgattctaagttttgggaggaggcaaccccaatctggatcacaaatcagcgagccggtcacacctcgggtgccgcaatgtggccaggcacagacgtaaagatccacaaaagattccctacacactacatgccttacaacgagtctgtgtctttcgaagaccgcgtcgccaagattattgagtggtttacctccaaagaacccatcaacctggggctcctctactgggaggaccctgatgatatggggcaccatctcggaccggatagtcctctgatggggcctgttatctccgatattgacaaaaagctaggctacctcatccagatgctcaagaaggccaagctgtggaatacactgaacctcataatcaccagcgaccacgggatgacgcaatgttctgaggaacggcttatcgagcttgatcagtacctggataaggatcactatactctgatcgaccagtcccccgttgcggctatcctgcccaaagagggtaagtttgatgaagtatacgaggcacttactcatgcacatccaaaccttacagtgtataagaaggaggatgtcccagagagatggcattacaaatataactccaggatacagccaattatcgcggtggctgatgagggctggcacattcttcagaacaaaagcgatgattttttgctcggcaaccacggttatgataatgctctggcagatatgcaccccatattccttgctcacggaccagccttccggaagaattttagtaaagaagctatgaattccacggacctttacccactgctctgtcacctactaaacattaccgcgatgccccacaatggatcattctggaatgtacaggacctactgaacagtgccatgccacgtgttgtaccatacacccaatctactattttgcttccgggctcagttaaacccgctgaatacgaccaggagggcagttacccttatttcattggggtgagcctggggtcaataattgtcattgtgttctttgtgattttcatcaagcatttgatccactcacagatcccggcattgcaagatatgcacgctgaaatcgcacaacctttgttgcaggcgtag

SEQ ID NO: 5765 - DNA, 1479 bp, Artificial Sequence
  Description of Artificial Sequence: Synthetic coding sequence
atgggatccgcaccttgggcccccgtccttctgttagctctgggcctgcggggcttgcaagctggcgcccgcagggctcctgacccaggttttcaggaaagattttttcagcaaagactggatcacttcaatttcgaacggtttggcaacaagacatttccccagaggtttctggtttccgacagattctgggtccgcggcgaggggccaattttcttttacacaggaaacgaaggcgacgtttgggccttcgctaataactctgcatttgtagccgagctggccgccgagagaggtgcactcctggtcttcgctgaacatagatactatggcaagtcactgcctttcggggcccagtctacccagagggggcacacagaactgctgactgttgaacaggctctggctgatttcgccgaacttctccgcgcgctgcggagagacttgggggctcaggacgcaccggcaatagcatttggcggatcttatgggggtatgttaagcgcctacctgaggatgaaatacccgcatctagtcgccggggccctggcagcctccgcacctgtgctcgccgtcgccggactaggcgacagtaaccagttctttcgtgatgttactgccgatttcgaaggccagtcaccgaagtgtactcagggcgttagagaagctttcagacagattaaggaccttttcctacagggcgcttatgacaccgtccgctgggaattcggaacatgtcaaccactgagtgacgagaaagacctgacccagttgtttatgtttgctcgtaacgcttttaccgttctcgctatgatggattacccataccccacagatttccttggacctctccctgctaatcctgtcaaggttggatgcgatcgccttctgtctgaggcacagcgaataactggattgcgtgctctggcgggcctggtgtataacgcatcaggctccgaacattgttatgacatataccggctataccacagctgtgcagatcctacagggtgcgggaccggcccagatgcacgggcgtgggattaccaagcctgtaccgaaattaacctgactttcgccagcaacaatgtgactgacatgtttccagacctcccctttactgatgaactgagacagcgctactgcctcgacacctggggcgtgtggccccgcccagattggctcctgacatccttttggggaggagacctgagggcagcctctaatattattttctctaatggaaatctggacccctgggcagggggaggcatacgcagaaacttatctgcaagcgtgattgctgtgacaatccagggcggggcccaccacctggaccttcgggcatcacacccggaagacccggcatcggtggtcgaggctaggaaattggaagccacaatcattggtgagtgggtcaaagctgcccgccgcgaacagcagcccgcactaaggggcggcccgaggctgtcactgtag

SEQ ID NO: 5766 - DNA, 2850 bp, Artificial Sequence
  Description of Artificial Sequence: Synthetic coding sequence
atgattctgtccttgctgtttagcctgggtggtccgctgggttggggcctgcttggcgcctgggcccaggcatcctctacatcactctccgatctgcaaagcagcagaacccctggagtctggaaagctgaggctgaagacacaggcaaggaccccgtgggcaggaattggtgtccctacccaatgagcaaacttgttacccttctggccctgtgtaaaactgagaagtttctgattcattcacagcagccttgccctcagggagcaccagactgtcagaaggttaaggtcatgtataggatggctcacaagcctgtttatcaggttaagcaaaaagtcttgacttccctcgcttggagatgttgcccaggatatacagggcctaattgcgagcaccacgactcaatggcaattccagaaccggctgatccaggcgattcacatcaggaaccacaagacgggcctgtgagctttaagccagggcacttagccgctgttattaatgaggttgaggtccagcaagagcaacaggagcatttgttaggggatctccaaaacgatgtccatcgggttgccgactcactgcccggattgtggaaagctctgcccggcaatctgacagcggctgtaatggaggctaaccaaaccgggcatgagtttcctgacagaagcctcgagcaggtgcttctgccacacgtcgatactttcctccaggtgcatttttcaccaatttggcggtcctttaatcagagccttcacagcctgacacaggccattagaaacctgagtctggacgtcgaagctaatcgtcaggcaatatctcgagtccaggatagcgcagtcgccagggccgacttccaggagctgggggcaaaattcgaggccaaggtgcaagagaatacacagagggtcggccaactcaggcaggatgtggaagaccggctccacgcacagcacttcacccttcacagatccatttctgagcttcaagcagatgtagacacgaagctcaaaagactgcacaaggcccaggaggcgccaggcacgaacggttctttggtgctggctacccccggcgcgggcgccaggcccgaacccgatagtttgcaggcccgtctgggacagctacagagaaatctctctgaattacacatgactacagctcggagggaagaagagcttcagtacacattagaggacatgcgagctacactgaccagacatgttgacgaaataaaagagctgtatagcgaatcagacgaaacattcgaccagattagcaaggtcgaacggcaggtggaggagctgcaggtgaaccacacagcgctgcgagagctcagggtgatacttatggagaagagcctcataatggaggagaacaaagaggaagttgagaggcagctcctggagttgaacctgactctgcagcacctgcaaggtggccacgccgacctgattaagtatgtaaaagattgcaactgtcagaaattgtatctagaccttgacgtgatccgggaagggcagcgcgacgcaacccgcgccctagaagagacgcaggtgagcctcgacgagaggaggcagttggacggctcttccctgcaggcgttgcagaatgccgtggacgctgtcagtcttgctgtggatgcacacaaagcggagggggagcgggcacgcgctgccacttctcggctccggagccaagttcaggccctggacgatgaagtgggcgcacttaaggcggctgcggctgaagcccggcacgaagtgcggcaactacacagcgcctttgcagccctgctcgaggacgccctgcgtcacgaggcagtcctggctgctcttttcggcgaagaggtccttgaggagatgagcgagcaaacgccggggccattgcctttgtcctatgagcagatcagggttgcactgcaggacgccgcttccggccttcaagagcaggccctgggctgggatgagctggcagcgcgtgtcactgcactggaacaggccagcgaaccaccccggcccgctgagcacctcgaaccgtctcacgatgccggccgcgaggaggccgcaacaactgcactggccggcctggccagggaactgcaatccctgtccaacgatgtcaaaaacgtggggaggtgctgcgaagcggaggctggcgctggcgcagcctcactcaacgcctcgctgcatggcctccataacgctttgttcgcaacccaacggtctcttgaacagcaccagagattgttccactctctgtttgggaattttcagggactgatggaagccaacgtgagcctcgacctgggaaaactgcagaccatgctcagtcgcaaaggaaagaagcaacaaaaagatctcgaagccccacggaagagggacaagaaggaagccgagcctctggttgacatccgagtgacaggccccgtcccaggggccctcggagctgcattgtgggaggccggatcacctgtagcgttttacgcatcattctctgaaggcacagccgccctgcaaacagtcaagtttaacacaacttacattaacatagggtctagctattttccagaacacgggtatttccgggcacctgagagaggagtctatttatttgcagtgtctgtggagttcggaccaggaccaggcacaggtcaactcgtctttgggggccaccacagaacccccgtgtgtaccacgggccagggctccggcagtaccgccacagtctttgcgatggctgagctgcagaaaggtgagcgcgtgtggttcgaactgacccaaggctctattacaaagcgctctctgagtgggacagcctttgggggattccttatgttcaaaacttag

SEQ ID NO: 5767 - DNA, 246 bp, Artificial Sequence
  Description of Artificial Sequence: Synthetic coding sequence
atgcgcttgctggtgctgagctcactgctgtgcattttgttgctttgtttttccatcttctcgactgaagggaaaaggaggccagcaaaggcctggagcggccggcggacacggctgtgctgtcaccgtgtgcccagcccgaatagcacaaacctgaaaggtcaccacgtgagattgtgtaaaccatgcaagttggagcccgaaccccgtctgtgggtagtgccgggcgcactgccccaggtgtag

SEQ ID NO: 5768 - DNA, 690 bp, Artificial Sequence
  Description of Artificial Sequence: Synthetic coding sequence
atgtcatttctgcaggacccaagcttctttacaatgggtatgtggagcatcggggctggggccttgggtgctgccgctctggccctcctgctcgctaacacagacgtgttcctgagcaaaccacagaaggctgcactggaatatttggaggatatagacttgaaaactttggagaaagaaccacggacatttaaagctaaggaactttgggagaagaacggcgcggtcataatggcagtgcggcggcccgggtgctttctctgccgggaggaggcagcagacctgagttccctcaaaagcatgctcgaccaattaggagtgcctctgtacgccgtggtgaaggaacacatcagaacagaggttaaggattttcaaccgtactttaagggggagatcttcctggacgaaaagaaaaagttctacggccctcagcggcgcaagatgatgtttatggggttcatcagattgggtgtgtggtacaacttttttagagcatggaacgggggattctccggtaatttagagggcgagggcttcatcctcggcggcgtgtttgtcgtcggatcaggcaaacagggaattcttctagagcatcgcgagaaggagttcggcgacaaggtgaacttgctcagcgttctggaagccgccaagatgataaagcctcagactctagcctctgaaaagaaatag

SEQ ID NO: 5769 - DNA, 657 bp, Artificial Sequence
  Description of Artificial Sequence: Synthetic coding sequence
atggggatgtggtccattggcgctggggcgcttggtgcagcagccttggcactcctgttggccaacacagatgtctttctctctaaacctcagaaggccgctctggaataccttgaggacatcgatctgaaaacactggagaaggaaccaaggactttcaaggctaaggagctgtgggaaaagaatggagctgtgataatggccgtgaggaggccaggttgctttctttgcagagaagaggcagcggaccttagctctctgaaatccatgctggaccagctcggcgtgccactttacgcagtggtgaaggagcacatccggaccgaagttaaggattttcagccctattttaaaggtgagattttcctggacgagaagaagaaattttacggtcctcagcgccgcaagatgatgttcatggggttcatcaggctgggcgtgtggtataatttcttccgggcttggaatggaggttttagcggcaatcttgagggcgagggatttatcctgggcggtgtctttgtggtggggtctggtaaacagggtattcttctggaacatagagaaaaagaattcggagacaaggtcaacctgctctcagttctggaggccgccaaaatgatcaagccccagactttagcgagtgaaaaaaagtag

SEQ ID NO: 5770 - DNA, 690 bp, Artificial Sequence
  Description of Artificial Sequence: Synthetic coding sequence
atgagcttcctgcaggatccgtcctttttcacaatggggatgtggtccatcggagcaggcgctctgggcgccgctgccctggcccttctgctggccaatactgacgtattcttgagcaaaccacaaaaggccgcactggagtacctggaggacatagacctcaagacattggaaaaagaacccaggactttcaaggccaaggaattgtgggaaaaaaatggcgccgtgattatggctgttaggcgtcctgggtgcttcctctgcagggaagaggctgctgaccttagtagtctgaagagcatgcttgatcaattaggcgtgcctctgtatgcggtggtaaaagaacatataagaacagaagtaaaagatttccaaccttattttaagggcgaaatattcctcgatgaaaaaaagaagttctacggccctcaacgacggaagatgatgtttatgggctttatacggcttggcgtctggtataatttcttccgcgcgtggaacggtggcttttccgggaacctcgaaggcgaaggctttattttgggaggcgtgtttgtagtcggttcaggaaaacagggcatattattggaacacagggaaaaagaattcggagacaaggtcaatctactctctgtcctggaagctgcaaagatgattaaacctcagactctggcatcagaaaaaaaatag

SEQ ID NO: 5771 - DNA, 690 bp, Artificial Sequence
  Description of Artificial Sequence: Synthetic coding sequence
atgtcttttctccaggacccctccttttttacaatgggaatgtggagcattggcgctggcgcactcggagccgctgctctggccctgctactggctaacactgatgtctttctaagcaagccccagaaagcggcactggagtatttagaggacatagatctgaagacactcgaaaaggagccaagaacctttaaggcgaaagaactgtgggaaaagaacggtgcggtcattatggccgtgcgaagaccgggttgtttcctgtgtcgcgaggaggccgctgacctgtctagtcttaaatccatgctggatcagcttggggtcccactctatgcggtcgtgaaagagcacatcagaacagaggtaaaggacttccaaccctattttaagggcgagatatttctagacgaaaaaaagaagttctacggtccccaaaggagaaaaatgatgttcatggggtttatccgtctgggggtgtggtataacttctttagggcctggaacggaggcttctctgggaatctggagggcgaagggtttattctgggtggtgtgttcgtcgtgggaagcggaaaacagggcatcctcctggagcaccgtgagaaagagttcggcgacaaggtcaatctgctatctgtgctggaggccgcaaaaatgattaaaccacagacccttgcgtcagagaagaagtag

SEQ ID NO: 5772 - DNA, 1248 bp, Artificial Sequence
  Description of Artificial Sequence: Synthetic coding sequence
atgagtccgttcttgtaccttgttttgctcgtgctcggcctgcacgccaccattcattgtgcaagccccgaaggtaaagttactgcctgccactcctcccagccgaatgctaccctgtataaaatgtcaagtataaatgccgatttcgccttcaacctatatcgcagattcacggttgaaaccccagacaaaaacatcttttttagcccagtatcaatatctgctgccctggtcatgttgtcttttggcgcatgttgcagcacacaaactgaaattgttgagactttaggtttcaacctcaccgatacccccatggtggagatccagcacggctttcagcacttgatatgttctctgaattttcccaaaaaagagttggaactgcaaatcggaaatgcgctgtttatcggcaaacacttgaagcctctggccaagtttctgaatgacgtgaaaaccctctatgagacagaagtttttagtacagatttctctaatattagcgctgcgaagcaggagatcaactctcatgtggagatgcagacaaaggggaaggtcgtcggcctgatccaggacctgaagcctaacacaatcatggtccttgtgaattatatccattttaaggctcagtgggccaatccctttgacccttctaaaacagaagatagctcatcgtttttaatagacaagacaactacagtacaagttccaatgatgcaccagatggagcagtattatcatctggtagacatggagcttaattgcactgtgcttcagatggattattccaaaaatgcgctagcccttttcgtcctgcctaaggaggggcaaatggaaagtgttgaagccgccatgtcatcaaaaacactcaaaaagtggaataggctgctccaaaagggctgggtcgatctcttcgtgccaaagtttagtatttccgccacatacgatctgggggctaccctgctgaagatgggcattcagcatgcttatagcgaaaacgccgattttagcggtctgactgaagacaacgggcttaagcttagcaatgcggcccacaaggctgtgctgcacattggggaaaaagggaccgaagcagctgcagtacccgaagtggaactctccgatcagcctgagaatactttcttgcatcctatcattcagatagaccgtagttttatgctacttatcctggaacgtagcactcggtctatcctcttcctgggaaaagttgtgaaccccacagaggcttag

SEQ ID NO: 5773 - DNA, 240 bp, Artificial Sequence
  Description of Artificial Sequence: Synthetic coding sequence
atggcgccacaaaccctcttgcccgtcctggtgctgtgcgtgctcctgcttcaggcacagggaggctaccgcgacaagaagagaatgcaaaaaacgcaactgtcccctgagatcaaagtgtgtcaacagcagcccaagttgtatttgtgtaagcacttatgcgagtcccaccgtgactgtcaggctaacaatatctgctgctcaacatactgtggcaatgtgtgtatgtctattctctag

SEQ ID NO: 5774 - DNA, 486 bp, Artificial Sequence
  Description of Artificial Sequence: Synthetic coding sequence
atgggattgagcggcctgcttcccatactggtacctttcatcctcctgggcgacattcaggagcccgggcacgctgaaggaattttggggaaaccctgtcctaagattaaggtcgaatgtgaggtggaggaaatcgatcagtgcacaaagccccgggactgccccgaaaacatgaaatgctgtcccttcagcagagggaaaaagtgtcttgactttaggaaaatttatgctgtgtgtcaccgacgactggcgccagcgtggccaccctatcataccggaggtactatcaagaagacaaagatctgtagcgagttcatctatggcggcagccaaggtaataacaacaactttcaaacggaggccatttgcctcgtgacatgtaagaaataccacaagagcgccctgctgtacacgataagacgaagtctcaataacctgcaggacctagcccataacccaggactttcaccgagggtgcccgactag

SEQ ID NO: 5775 - DNA, 261 bp, Artificial Sequence
  Description of Artificial Sequence: Synthetic coding sequence
atgggtttgtccggtctgctgccaattctcgttccattcattctgctgggggacatccaggaacctggacacgctgaggggattctcgggaagccatgccctaagattaaagtggagtgcgaggtggaggagatcgaccagtgtacgaaaccacgggactgccccgaaaacatgaagtgttgcccctttagtcgtggcaagaagtgtctagatttccgcaaggtatctttgacgctgtatcacaaagaggaactggaatag

SEQ ID NO: 5776 - DNA, 375 bp, Artificial Sequence
  Description of Artificial Sequence: Synthetic coding sequence
atgcccgcctgccgactgggaccactcgccgctgcactgcttctgagtcttctgctgtttggcttcaccctcgtcagcggtaccggagcagagaagactggtgtttgccccgaactccaggcagaccagaattgtacacaggagtgtgtgtcagactccgagtgtgccgataacctgaagtgctgttctgctggttgcgccactttttgcagtctgcccaacgataaggagggcagttgcccacaagtgaatattaatttccctcagctaggcctgtgcagggaccagtgtcaggtagactcccagtgccccggacagatgaagtgttgccgtaacgggtgcggcaaggtttcttgtgtaacaccaaatttttag

SEQ ID NO: 5777 - DNA, 1428 bp, Artificial Sequence
  Description of Artificial Sequence: Synthetic coding sequence
atggccgatatgcagaacttagtggaacgactagagagagccgttgggaggctcgaagcggtctcccacacaagcgatatgcataggggctacgccgattccccctctaaggcgggagctgccccgtacgtccaggccttcgattcgttgcttgctggacctgttgcagagtacttaaagatcagcaaggagatcggcggtgatgtacagaaacacgcagaaatggtgcacaccggcctcaaacttgaaagagccttgctggttacggcctcgcagtgtcagcagcctgcagaaaataagctgtctgacctcctcgcgcccatatccgaacagattaaggaggttattaccttccgcgaaaaaaatagaggatccaagctgttcaatcacctctctgcagtcagtgaaagtatacaagccttgggatgggtagctatggccccaaagcccggcccgtacgtgaaggagatgaacgatgccgcaatgttctacaccaatagagtgctgaaggagtataaggacgtagacaaaaaacacgtggactgggttaaagcctacctcagcatttggaccgaactgcaggcctacatcaaggaatttcacactactggcttagcttggagcaagaccggtccagtcgctaaggagctgagcggcctgcccagtggtccgtctgcggggagctgccctccaccaccacctccctgtccacccccccctccagtgtccaccatttcatgtagctatgaaagcgcaagtcgatcttcattattcgcacagatcaatcagggggaaagcattacccacgctctcaagcacgttagcgacgacatgaaaacgcataaaaaccctgcactgaaggcacagagcggacccgttcggtctggtccaaaacctttcagtgcccctaaaccccagacgagccctagtcctaagcgcgccaccaagaaagaacccgccgtactcgaactagaagggaagaagtggcgcgtggaaaaccaggagaatgtgtccaatttagttattgaggatacagagttgaaacaggtggcctacatatacaaatgcgttaacaccacactccagatcaaagggaagataaactctatcacagttgacaactgcaaaaaactcggtctagtgttcgacgatgtagtgggcattgtggagattattaacagcaaagatgtcaaggtgcaggtgatgggcaaggtgcctacgatcagtataaataagacagatgggtgccacgcttatctgtcaaagaatagtcttgattgtgagatcgtgagtgccaaatcttcagagatgaatgtgttgatccctaccgaggggggggactttaatgagttccctgtgccggaacagtttaaaacactgtggaatggacagaagctggtaaccaccgttactgaaattgccgggtag

SEQ ID NO: 5778 - DNA, 438 bp, Artificial Sequence
  Description of Artificial Sequence: Synthetic coding sequence
atggcggatatgcagaatctcgtggagagactggaacgcgccgtcggacgcttggaggcagtttcccatacatcagacatgcaccgcggctacgcagatagcccctctaaagcaggggccgccccatacgtccaggcctacattaaagaattccataccacagggctggcctggtctaagaccggtcccgttgcgaaagagctgagcggactacctagcgggccgtcagccggctcctgtcccccgcccccgcctccatgcccgccccctccgcccgtctcaactatctcttgctcttacgagagtgcaagccggtcaagcctttttgcccagatcaaccagggagagtcaatcacgcacgcgcttaaacatgtgtctgacgatatgaagacacataagaatccagccctcaaggcacagtctggtcccgtccggtag

SEQ ID NO: 5779 - DNA, 1428 bp, Artificial Sequence
  Description of Artificial Sequence: Synthetic coding sequence
atggcagatatgcaaaatctggtcgagcgcctagagcgggccgtgggcagattagaggctgtgagtcatacctccgacatgcatcgaggatatgccgactccccttctaaggccggggctgcaccctacgtgcaggctttcgactcgcttctcgccggaccagtggccgagtacttgaagatttcaaaagagattggcggggatgtccagaagcacgccgaaatggtgcataccggcctgaagctggaaagggctctgctggtgaccgcctcccaatgccagcagcctgccgagaataagctatcggacctgctggctcccatatccgaacaaatcaaagaggtgatcaccttcagagagaaaaatcgaggcagtaaactgttcaaccacttatctgccgtctccgagtctattcaggcactgggttgggtggccatggcacccaagcccggaccttacgtcaaggaaatgaacgacgccgccatgttttataccaatagggttctgaaagaatacaaagacgtagataagaagcatgtcgactgggttaaggcgtatctgtccatctggactgaattgcaggcttacataaaagagttccacacgacaggcttggcctggtcaaagactggccctgttgcgaaagagctctctggcctgccgagcggtccgtccgcaggatcttgtcccccccctcccccgccatgtcctccccctcctccagtgtctacaattagctgctcttatgaaagtgcaagtagaagcagcctcttcgcacaaatcaatcagggcgagagtatcacccacgccctcaaacacgtgtccgatgacatgaaaacccataagaatcctgctttaaaggcccagtcagggcctgtgcgcagcggccctaagcctttcagtgcccctaagcctcagacaagtccctcacctaaacgcgctaccaaaaaagaacccgcagttcttgagcttgagggcaagaagtggcgcgtggagaaccaagaaaacgtctccaatcttgttatcgaagataccgagcttaagcaggtggcgtatatttacaagtgcgtcaacacaacactgcaaatcaaaggaaagattaatagcataaccgtggataactgtaagaagttaggactggtctttgacgatgtcgtgggcatcgtcgagattattaattcgaaggatgtaaaagttcaagtgatgggcaaggtcccgacaatcagcatcaacaaaaccgacggttgccacgcctacttaagtaagaatagtcttgactgcgagatagtaagcgctaaatctagtgaaatgaatgtgctcattcccacagagggaggcgacttcaatgagtttcccgtcccggaacaatttaaaactctgtggaatggccagaaactggtgacaaccgtcaccgaaatcgctggttag

SEQ ID NO: 5780 - DNA, 1425 bp, Artificial Sequence
  Description of Artificial Sequence: Synthetic coding sequence
atggccgatatgcagaatctggtggagaggcttgaaagagctgtcggacgacttgaagccgtgtcccacacaagtgatatgcacaggggctatgcagatagcccctccaagggagccgctccttacgtgcaggcattcgactctctgctggctgggcctgtggccgagtacctcaagatcagcaaagagatcggcggcgatgtgcagaaacatgcggagatggtccatacaggcctgaaactggaacgcgctttgcttgtaaccgcctcgcaatgtcagcagcccgccgaaaataaattatctgaccttttggccccaattagcgagcagattaaggaagtcatcaccttcagagagaagaatcggggttctaagctgttcaaccacctgagcgctgtctcggaatccattcaggcgctgggatgggtggcaatggcaccaaagccaggcccttacgtgaaggagatgaacgacgcggccatgttctacacaaatcgcgtcctgaaggagtacaaggacgttgataaaaagcatgttgactgggtcaaggcctatctttcgatctggaccgaactccaggcgtacataaaggagttccacaccacaggtctggcatggtccaagactgggcctgtggccaaagaattgagtggcctgccaagtgggcccagcgccggctcctgtccgcctccgcctcctccctgtccaccaccccctcccgtttctactatctcctgctcatacgagagcgcatctcgcagttccctatttgcgcagataaaccagggcgagtcaatcacgcatgctttaaagcacgtgtcagatgacatgaagacacacaaaaaccccgcactcaaggctcagtcgggtcccgtacgctcagggcccaagccctttagcgcccctaagccccagacgtcccctagccccaagagggcaaccaagaaggaacctgcagttttggagctcgagggcaaaaaatggcgcgttgagaatcaggagaatgtgagcaacctggttatagaggacacagaacttaagcaggtcgcgtacatctataagtgcgtcaatactaccctccaaataaaaggaaaaatcaatagcatcacagtcgataactgcaagaaactgggtttagtgtttgacgatgtcgtgggcattgtcgagatcattaactccaaggatgtcaaggtacaagtcatgggtaaagttcctactatatctatcaataagacagacggatgtcacgcctatctgtcaaagaacagtctggactgcgagatcgttagcgctaaatccagtgaaatgaatgtgttaatccctacagaaggaggcgactttaatgaattccccgttccggagcagtttaagactttatggaacggtcagaagctagtgacgacagtcactgaaattgcaggttag

SEQ ID NO: 5781 - DNA, 1425 bp, Artificial Sequence
  Description of Artificial Sequence: Synthetic coding sequence
atggcggacatgcaaaatctggttgaaagactcgagagggctgttgggcgcctggaagccgtatcacacactagcgacatgcatcggggctatgctgatagcccaagcaagggtgccgctccttacgtccaggcattcgatagcctcctcgccgggcccgtggctgaatatctgaaaattagcaaggaaatcgggggcgacgtgcagaagcacgctgagatggtccatacaggactgaagttggagagggcgttgctggtcaccgctagccagtgccagcagcccgctgagaataaactcagtgacttgctggctccaatttcagagcaaatcaaagaggtgattacctttagggaaaaaaatagaggctcaaagctgttcaaccatttatccgctgtatctgaaagcatccaggccttgggctgggtggcaatggctccaaaacctgggccctacgttaaagagatgaacgacgcagccatgttctataccaaccgagtgctaaaggaatataaggatgtggataaaaaacacgtcgattgggtgaaggcctacctaagtatctggacggagttgcaggcctacattaaagagtttcacactacagggctggcttggtccaagacgggaccggttgccaaggagctgtccggcctccccagcggaccatctgccggttcttgtcctccgcccccacctccctgcccgcctcccccacccgtgagcacgatcagctgctcgtatgaatcagcttccaggtcaagcctatttgcacagatcaatcagggcgaatcaatcacccatgccctgaagcatgttagcgatgatatgaagacacataaaaacccggctttaaaggcacagtctggacctgtgcgatccgggccaaaacccttttctgccccaaaaccccagacttcccccagccccaaacgcgcaaccaaaaaggaaccagctgtgttagagctcgaagggaagaaatggcgtgtggagaatcaggagaatgtgagtaatttagtgatcgaggatacagaactgaagcaggtggcctacatttataaatgcgtaaacactacgctccagatcaaaggaaaaattaattccatcactgtggacaactgcaaaaaactcggcctcgtgttcgacgacgtggtcgggattgtggagataatcaatagcaaggacgtgaaggttcaggttatggggaaggtgcctacaatctcaattaacaagacagatggctgccacgcttacctcagcaagaacagtctggattgtgagatcgtatcagccaagtcctccgaaatgaacgtccttatcccgacagaaggtggtgactttaacgagttccctgtgcccgaacaatttaagacattgtggaacggacaaaagttagtaacaacagtgactgaaattgcaggatag

SEQ ID NO: 5782 - DNA, 1428 bp, Artificial Sequence
  Description of Artificial Sequence: Synthetic coding sequence
atggctgacatgcagaatctagtggagcggctggagcgggccgttgggaggttggaggcagtcagccacacctcggatatgcataggggttacgcggacagcccttcgaaggctggtgcagcgccatacgtgcaggcctttgactccttgctcgccggcccggtggccgagtatcttaaaatttctaaggagattggtggtgacgtacaaaagcacgccgagatggtgcacaccggactgaaactcgaaagggcacttctggtaacagcatcacaatgtcagcagcccgccgagaacaaactgtctgacctcctggccccaatatcagagcagattaaagaagtaataacctttcgagagaaaaacagggggtctaagctttttaaccacctgtctgccgtgtccgaaagcattcaggccctcgggtgggtggccatggcgcctaaacccgggccatatgtaaaagaaatgaacgacgcagctatgttctataccaaccgcgtgctgaaggaatacaaagatgtcgataaaaagcatgtggattgggtgaaggcgtacttgagtatctggacagagttgcaggcctacattaaggagtttcacacaaccggtctggcctggtccaaaaccggtcccgtagcaaaggaactttctggacttccatctggtcccagcgctggaagttgcccacccccccctcctccgtgtccacccccaccacctgtgtctactatctcttgcagctacgagtcggcttcccgctcaagcctgtttgctcagatcaaccagggagagtcaatcactcatgccctgaaacatgtctccgatgatatgaagactcataagaatcccgctctgaaagcgcagtcaggccctgtgagatccggcccaaagccctttagtgcaccgaagccccagacatctccgagtcccaagcgagctacaaagaaggaaccagccgttttggaactggaagggaagaaatggcgagttgagaaccaagagaacgtatccaatctggttattgaggataccgaactcaagcaggtggcctacatttataagtgtgtcaataccacgttacagatcaagggcaagatcaattccatcacagtggacaactgtaaaaagctggggttggtgtttgatgacgtggtcggcattgttgagattattaattctaaggacgtgaaagttcaggtgatgggaaaggtacccacgattagcatcaacaagaccgacggctgccacgcctacctatctaagaattcccttgactgtgagattgtttctgccaagagctccgagatgaatgtgctcattccgactgagggcggagattttaacgagttccctgtgccggagcagtttaaaacgttgtggaatggtcaaaagctggtcacaactgtaacagaaatcgctgggtag

SEQ ID NO: 5783 - DNA, 1209 bp, Artificial Sequence
  Description of Artificial Sequence: Synthetic coding sequence
atgacggcgctgccagggccactgtggctactcgggctggcactgtgcgccttaggtggtggtggcccaggcctgcggcctccacctggttgccctcaacgccggctgggagctagagagaggagggatgtgcagcgagagatcctggcggtgctcgggctccccggcagacccaggccccgtgcaccacctgcagctagccgtctgcccgctagcgcccccttgtttatgctggatctctaccatgcgatggcaggggacgatgatgaggacggtgcacctgcagaacgccgactgggaagagccgacctggttatgagctttgtaaatatggttgagagggaccgagcactgggacaccaggagccccattggaaagagtttaggttcgatttgacacagattcctgccggcgaggcggtgacagccgctgaatttagaatctataaggtgccatctatccaccttctcaatcggactctgcatgtgtcaatgttccaagtggtccaagaacagagtaaccgagagtctgacctctttttcctcgatctgcagaccctccgggcgggcgacgaaggctggctggtcctggacgtcaccgcagcctctgactgctggttgctgaaacggcataaggatttagggctgagactgtacgtggaaacagaagacggccattcggtcgatccagggcttgccggactactgggacaaagagcgccaaggtcacagcagccatttgtggtgactttctttcgagccagtcctagtcccatcaggactccgcgggccgtgcgcccattgcgacgtagacagcccaaaaagagcaacgaattgccccaggcaaatcggttgccgggtatttttgatgacgtccatggaagccacggccgacaggtgtgcagaagacacgaactgtacgtctcattccaggatctgggctggcttgattgggtcatagctccccaggggtactctgcgtactactgcgaaggcgaatgtagttttcctctggactcctgcatgaacgctacaaaccacgctattttacagtccttggtgcatctcatgatgccagacgccgtgcctaaggcctgctgcgccccaacgaagttgagtgctacaagcgtgctctattatgactcctctaataacgtgatcctacgaaagcacagaaatatggttgttaaagcttgtggctgtcattag

SEQ ID NO: 5784 - DNA, 804 bp, Artificial Sequence
  Description of Artificial Sequence: Synthetic coding sequence
atggccgctatacggatgggaaagctgacaacgatgccggccggactcatttacgcatccgttagcgtgcacgcagctaagcaagaagaaagtaaaaaacagctcgtcaagcctgagcagctgcctatctacacggcgcctcctctccagtcaaagtacgtcgaggaacaaccggggcatctgcagatgggcttcgcatcgattcgcaccgctacaggatgctatataggatggtgcaagggcgtctacgtgtttgtgaagaatggcattatggacaccgtccagttcgggaaggacgcttacgtgtacctgaaaaacccaccacgagatttccttccgaaaatgggggtgataaccgtttctggccttgcaggtctggtatctgccagaaaggggagtaaatttaaaaaaatcacatatcctcttggtctggccactctcggcgcgacagtgtgctaccccgtacagtctgtgatcatcgccaaggtgacagctaagcggtacatgcttcaggcatccaagtttttggaacagctgaaccattgcgggcagaaagcagcaaaaaagtctcatagcctgaatctgaaaaaaacaaagctggggagttcgtccgagattgaggttcccgccaaaaccacacacgtgctgaagcatagcgtgcccttgcctaccgagttatcctctgaggccaaaacgaaatctgaaagtacttcgggagccacccaatttatgccagacccaaagctgatggatcatgggcagagtcaccctgaagacatcgatatgtactcaacgcggtcctag

SEQ ID NO: 5785 - DNA, 807 bp, Artificial Sequence
  Description of Artificial Sequence: Synthetic coding sequence
atggcagcgatcaggatgggaaagctcaccacaatgcctgctggtctcatatacgctagtgtgagcgtgcacgctgcaaaacaggaggaaagcaaaaagcaacttgtgaagccagagcagctcccaatctacactgcaccgccattgcagtccaagtatgtcgaagaacaaccagggcatttacagatgggctttgccagcatacggacggcaactggatgctacattggatggtgcaaaggggtatacgtgttcgttaagaatggaatcatggatactgtgcagttcggaaaggatgcatatgtctacctgaaaaatccgcctagagatttccttcctaaaatgggagtgattactgttagcggcttggccggtttagtttctgctcgcaaaggctccaagtttaagaagattacatatcctctgggcctggcgactctgggggctactgtgtgttatcccgtccaatccgtgatcatcgctaaagtgacagctaaaaaggtgtacgccaccagccaacagattttcggggcagtgaaaagtctgtggacaaaatcctctaaggaagaatctctccctaaacccaaagaaaaaaccaagctgggatcatcaagcgaaattgaggtccctgcaaaaaccacccacgttctgaagcactccgtaccattgcctaccgagctgagttctgaggcgaagacaaaatccgagtctacttccggggccacccagttcatgcccgacccaaaacttatggatcatggtcaatcccatccagaagatatcgacatgtattccacccggagctag

SEQ ID NO: 5786 - DNA, 3672 bp, Artificial Sequence
  Description of Artificial Sequence: Synthetic coding sequence
atggccccgcttcgagctttactatcctacctgctgcctctgcactgtgcactctgcgccgcggccggaagcagaacaccggagctccatctgtctggaaagctgtcggactatggagtgacagttccctgcagtaccgattttagaggcagatttctgtcccacgtggtgagcggaccagccgcggctagcgccgggtccatggtggttgacactccccccacactgccccggcatagctcgcacctgagagtggctagatctcctttacatcctggcggaacgctgtggccaggccgcgtcgggcgtcatagcctgtactttaatgtgacagtgttcggaaaggagctgcacctgagactacgcccaaacaggcgcttagtggtccctggcagcagcgtggagtggcaggaggattttcgcgagttattccggcagccactgcggcaggagtgtgtttatacaggtggcgtgaccgggatgccaggggctgcagttgccatctccaactgtgacggtttggctggtcttatacggacagactccactgacttcttcatcgaacccctggagcgcgggcagcaggaaaaggaggcctccggcagaacacacgtggtgtaccggcgggaagccgtgcagcaagagtgggctgagcctgacggtgaccttcacaacgaggcttttggactgggcgatctgcccaacttactgggcttggtaggcgatcagctcggcgacacagaacgaaaacggagacatgcaaagcctggtagctactcaatcgaagtgctgttggtcgtcgatgactcagtggtgaggttccatggcaaggagcatgtccagaattatgttctcaccctcatgaacatagtggacgagatttaccatgatgagtccctgggcgtccatattaacatcgctctcgtgaggttgattatggtaggatatcggcagtctttaagtctcatcgaaagaggcaatccttctagatcactcgaacaggtctgcaggtgggctcacagccagcaacggcaggacccaagccatgctgagcatcatgatcatgttgtcttcttaactcgtcaggacttcggaccctcaggttatgccccagtaacaggcatgtgccaccctttgagaagctgcgccctgaaccacgaagatgggttcagctcagccttcgtcatcgcacacgaaactgggcatgtgctggggatggaacacgacggccagggcaacggctgcgctgacgaaacatctcttggatccgtcatggccccactcgtacaggccgccttccaccgcttccactggagtaggtgttccaaattagaactatcacgttatctgccaagctacgattgtctcctcgacgatcctttcgaccctgcctggccacaaccccccgaactccccggaattaactattcaatggatgaacagtgtcggttcgacttcggcagcggttatcaaacatgcctggctttcagaacttttgaaccttgcaaacaactctggtgcagtcaccctgataacccctatttctgcaaaaccaaaaagggcccccctttagacggcaccgaatgcgcaccggggaaatggtgcttcaaaggccactgcatttggaaaagccctgagcagacttatggccaggacggtgggtggtcttcttggactaagtttggctcctgtagccggagttgcgggggcggagtgcgttctaggtctcgctcttgcaataaccccagccccgcatacggcgggcgactttgtctcgggccaatgtttgaataccaggtctgcaatagcgaggagtgcccaggcacatacgaggacttcagagctcaacaatgtgctaaacgcaactcatactatgtgcatcagaatgccaagcactcttgggtgccttacgaacctgatgacgatgcgcaaaaatgcgagctcatttgccaatcggcggacaccggcgatgtcgtcttcatgaaccaggttgtccatgacggaacaaggtgttcatatcgagacccatacagcgtctgcgcccgtggcgagtgcgtccccgtgggatgcgacaaagaagtcgggagcatgaaagccgacgacaaatgcggagtatgtgggggcgacaacagtcactgccgcacggtgaaagggaccttgggcaaagcttctaagcaggccggcgccctcaagctggttcagatacctgcaggagcacggcatatccagatagaagctctggagaaatctccacatagaatcgttgtcaagaatcaggtgacaggctcgttcatcctcaacccgaagggcaaggaagccacctctcggacatttactgcgatgggcctggagtgggaagatgcagtggaagacgctaaagagagcctcaagacatcagggcctctgcctgaggcaatagctatactcgccttgcccccgactgaaggggggccccggtcctctctcgcatacaagtatgtgatccacgaagacttgctgccactcataggcagcaataacgtattgctggaggagatggacacctacgaatgggcccttaagtcatgggctccttgcagtaaggcctgcggtggaggtatccagttcactaagtatgggtgtagacggcgcagggaccatcatatggtccaaaggcacttgtgcgaccacaagaaaagacctaagcctatccgtcggcgctgtaaccaacacccatgctctcagccggtgtgggtgacagaggaatggggtgcctgttcccgttcgtgtggcaagctgggggttcagacccgaggaatccagtgcctgttgccccttagcaacggtacacataaggtgatgccagccaaggcctgcgcgggggaccgccccgaggctcggagaccttgcttaagagtcccttgtccggcacaatggagattaggggcttggagccagtgttccgccacctgcggcgagggaatccagcaaaggcaggtagtgtgcaggaccaacgccaactcactgggccattgcgaaggggaccgtcccgacaccgtacaagtctgctcgctccccgcttgtggaggcaaccatcaaaactccaccgtcagggcggacgtgtgggaactcggaacacccgaaggacaatgggtgccccagtctgagccactgcaccctatcaataagatctccagcaccgagccctgcacaggagaccgcagcgtgttctgtcagatggaggtcctggacaggtactgctcaatcccaggttatcatagattgtgttgcgtttcctgcatcaagaaggcttccggacctaaccccggtccagaccccggaccaacgagcctgcctcctttcagcactcctggatcacccttgcccggccctcaagaccctgccgatgctgccgaaccacctgggaagcctaccgggagtgaggaccaccagcatggccgcgcaacgcagctgcctggagcgctggacacctcttcacctggcacacagcaccctttcgcccccgaaacccccatcccaggcgccagctggtcaatctcacctaccacgcccggagggctgccatggggctggacccagacacctactccagtgcccgaggacaagggacaacctggcgaagacctgagacatcccggtacctcgctgcccgccgcgagccccgtgacctag

SEQ ID NO: 5787 - DNA, 3681 bp, Artificial Sequence
  Description of Artificial Sequence: Synthetic coding sequence
atggcacccctgcgagccctgctgagttatctgctcccactgcactgcgctctgtgtgccgccgccggtagcaggacgccggagctccatctcagtggcaaactgagcgactatggtgtaacagtcccatgctctacagattttcgggggcgatttctgtcacacgtggtgagtggtccagccgccgcctcagccggatcgatggttgtcgataccccacccacgctacctcgtcattccagtcatttaagagtggctaggagtccactccacccaggaggaactttgtggcctgggcgcgtaggacggcattcactgtatttcaatgtcacagtgtttggcaaggaactccacctcagattgagacccaaccgtcgtcttgtggtgcctggctcttccgtggagtggcaggaagatttccgagaactgtttagacaaccactacggcaggagtgcgtttacaccggcggtgtcaccggtatgcccggcgcggcagttgctatttccaactgcgatggcctggcaggcttaatccgtactgactccactgacttttttattgaaccactagagcgcgggcagcaggagaaggaagcctccgggcgaacccatgtcgtgtaccggcgcgaagccgttcagcaagagtgggctgagccggacggcgacctacataacgaggctttcggacttggtgacctcccaaatttgcttggtctggtcggggaccagctcggagacaccgaaaggaaacgcagacacgcaaagcctggatcttactccatagaagttctgctcgtggttgatgattctgtcgtacggttccatggaaaggagcacgtacaaaactatgtgctcacacttatgaacatagtagacgaaatttaccatgacgaatccctaggcgttcatataaacatcgccctcgtgcggttaattatggtgggttaccgtcagagcttgagtttaatcgaaagggggaacccaagtcgctccctggaacaggtttgccgatgggctcacagtcagcagcggcaggatcccagtcatgccgagcaccatgaccacgtggtgttccttacgcgacaggactttggcccctccggtatgcagggatacgcgccagttacagggatgtgccacccactccgctcttgtgctctgaatcatgaggatggcttttccagcgcttttgtcatagcacacgagacaggtcatgtcttagggatggaacatgacggacaaggcaatgggtgcgccgatgagacctcattgggctctgtcatggccccactcgtccaggctgccttccacagatttcactggagcagatgcagcaaactggaactcagtcgctacctgccctcctacgattgtctgctggatgacccattcgatcccgcttggccccaaccccccgagctccccggcatcaactattctatggacgaacagtgccggttcgattttggttcaggctaccagacttgcctcgctttccggacattcgaaccatgcaaacagctctggtgcagtcatcctgataacccctacttttgcaaaaccaagaaaggaccacctcttgatggaaccgaatgcgctcccggtaagtggtgcttcaaaggccattgtatctggaaaagcccagagcaaacttacggtcaggatggaggatggtcatcctggacaaaattcggctcctgttcccgcagttgtggtggaggggtgcgttcaaggagccgctcttgtaacaatccttcacctgcttacggtggcagattgtgtctaggcccaatgttcgagtatcaggtgtgcaattcagaggaatgtccgggcacatacgaagattttcgcgctcagcagtgcgcgaaacggaatagctattacgttcatcagaacgctaaacattcttgggtcccgtacgaaccggacgacgatgcccagaaatgcgaactcatctgtcaaagtgcagatactggggacgtcgtatttatgaatcaggtggttcacgacggtacccggtgtagttaccgagatccttatagtgtgtgcgcaagaggcgaatgcgttcccgtgggctgtgataaggaggtgggatccatgaaagctgacgataaatgtggcgtctgtggcggagacaatagccattgccgaaccgtaaaggggactctcgggaaggcctccaagcaagccggcgccctgaagctcgttcagatcccagccggggcacgccacatccagatcgaagcactggaaaagagcccacatcggatcgttgtgaaaaaccaggtcaccggcagtttcatactgaacccgaaaggcaaggaagccacttcaaggactttcaccgcaatggggctggagtgggaggacgccgttgaggatgcaaaagaaagcctgaagactagtgggcccctaccagaggcaatagccatcctggctctccccccaaccgagggtggaccgcgatcaagtctggcgtacaaatatgtgatacatgaagatttgttacctctgattggctccaacaatgtgcttctagaggaaatggatacctatgaatgggctctgaagtcttgggctccgtgctccaaagcatgcggcggcggcatccagttcaccaagtatggttgtcggcgccgccgcgaccatcacatggtgcagaggcacttatgcgaccacaagaaaaggccgaagcctataaggcgcaggtgtaaccagcatccctgttcccaaccagtgtgggttacagaggagtggggggcctgcagtcgcagctgcggcaagctgggcgtgcagactcgcggaatacagtgtctcctgcccctcagcaatggtacccacaaagtgatgccagccaaagcctgtgctggtgataggcccgaggcgcgacggccctgcctgcgggtcccctgtcctgcgcagtggcgattgggcgcctggagtcagtgctccgccacgtgtggcgagggcattcagcaacgtcaggtggtgtgcagaaccaatgctaactctcttggacattgcgaaggggaccgtccagatacagtgcaggtgtgttccctacccgcctgtggcggcaaccaccagaattctacagtaagagccgacgtctgggaactgggaacgcctgagggacagtgggtgccccagtccgaacctttgcaccccataaacaagatcagtagcaccgagccttgcactggcgatcggtccgtgttctgccaaatggaagtattagatcggtactgtagcattcctgggtatcaccgactgtgttgtgtttcatgtatcaaaaaggcctccgggcctaatcctggacctgatcctggaccaacctcactgccccctttcagtacgcccggcagtcctctgccagggccacaagatccagctgatgccgccgaacctcccggcaagcctacagggtccgaggatcatcagcacgggagagcgactcagctgcccggcgctctggacacaagcagcccgggcactcagcatcccttcgcccctgaaaccccaatccccggagccagttggagcatctctcccaccacacctggcggcctgccttggggctggactcagaccccgacgcccgtccctgaggataagggccaaccaggcgaggacctgagacacccagggacatctctccccgccgcctcaccggtgacctag

SEQ ID NO: 5788 - DNA, 762 bp, Artificial Sequence
  Description of Artificial Sequence: Synthetic coding sequence
atggccgctgctacccgaggttgcagaccctggggtagtctgttgggcctgctcgggctcgtctcggctgcagcagcagcttgggatttagcgtctctccgttgcaccttgggcgctttctgtgagtgcgatttcaggcccgatctacctggtcttgagtgtgatctcgcccagcacctggcagggcagcacctagcgaaagcacttgtggtaaaggctcttaaagcttttgttcgggacccggccccaacgaaaccccttgtactgtccctgcatggatggactggcactggaaaaagttacgtgtcaagtctgctcgctcactaccttttccagggtggcctgagatcaccccgcgtgcatcacttttcaccagtgctgcacttcccgcacccttcccacatcgaacggtataagaaggacctcaagagctgggtgcagggcaatctgactgcttgcggccggtccctgtttctttttgacgagatggacaaaatgcccccagggcttatggaggtcctgcgccccttcctagggtcctcatgggtggtctatggtaccaactaccggaaggcaatatttattttcatcagatggggtccagcactgcagtgggctcagtggggtggacatttttccgaagtccagctttatagtctgtccctgtgttctcagcagaaccctgtaccacacgggctcagttgggccttccctgtgccctctgctaccctccgggacgacattgttatcccgcccggctag

SEQ ID NO: 5789 - DNA, 966 bp, Artificial Sequence
  Description of Artificial Sequence: Synthetic coding sequence
atggctgctgctacccggggatgccggccctgggggagtcttctggggttgctgggactggtttcggctgcagcagctgcatgggaccttgcaagcctccgctgtaccttgggggccttttgcgaatgcgacttccgtcccgatttacctggcctcgaatgcgacctcgcacagcatcttgccggtcagcatctcgccaaagctctagttgtgaaggccctgaaggcctttgtccgcgatccagcccctactaagcctttagttctgtcattgcacggctggacaggaactgggaaaagttacgtgagctcattgttagcacactatctatttcaaggcggattaaggagcccacgcgttcaccacttttcccccgttctccatttccctcatccgagccacattgaacgctataaaaaagatttgaagtcttgggtacaaggcaatctgaccgcgtgtggtcgatccctgttccttttcgacgagatggacaagatgccacctggactgatggaggtacttcgaccattcctaggttccagttgggtggtctacggaaccaattacagaaaggccatcttcattttcatctccaatacgggcgggaagcaaattaatcaggtggctctggaggcctggaggagccgtcgtgatagggaagaaattctcctccaggagctggagcctgtgatatcgcgggcagtgctggacaacccccaccacggattctccaattcaggcattatggaggagcggctcctggatgcagtggttccctttctgcctctccagcggcaccacgtgcgtcattgtgtactgaacgagttggcacagctggggctggaaccacgtgacgaggtcgtgcaggcagttctggacagtacaactttttttccggaagacgaacagctgttttcaagtaacggatgtaagacagtggctagtcggatagcattttttctttag

SEQ ID NO: 5790 - DNA, 576 bp, Artificial Sequence
  Description of Artificial Sequence: Synthetic coding sequence
atgcaggtgtggtgcgaccagaggcatgaccccgggggttggaccgtgatccagaggcgcctggatggaagcgtgaactttttccggaactgggagacttacaagcagggttttgggaatatcgatggcgagtattggctgggtcttgaaaatatttattggcttaccaaccaggggaactataagctgttggtgacaatggaggactggagtggtcgcaaagtgtttgcagaatacgctagcttccgcctggagcctgaatctgagtattataaattgcgcctcggacggtatcatggtaatgccggcgatagttttacctggcacaatggtaaacaatttaccactctggacagggaccacgatgtatacaccggcaactgcgcccactaccagaagggtggatggtggtacaacgcctgtgcgcacagcaatttgaacggagtatggtaccgcggaggacactaccgctctcggtatcaggacggggtatactgggcagaattcagggggggaagttactcattaaaaaaggttgtgatgatgattcgaccgaatcctaacacgttccactag

SEQ ID NO: 5791 - DNA, 1482 bp, Artificial Sequence
  Description of Artificial Sequence: Synthetic coding sequence
atgcgccctttgtgcgtgacgtgctggtggctggggctgctcgccgcgatgggcgctgttgctgggcaggaagatggcttcgagggcaccgaagagggcagcccccgcgagtttatttacctgaacaggtacaaaagggctggagagagccaggacaaatgcacttacactttcattgtacctcagcagcgcgttacgggagcaatatgcgtcaatagtaaagagccggaagtcctcctggagaacagagtgcacaagcaggagctggaattgctgaataatgagcttttgaagcagaaacgccagattgagaccctgcagcaactggtggaagttgatggaggaatcgtaagcgaggtaaaactgctgaggaaagagtcacggaacatgaattcaagagtcacacagttatacatgcagctgctgcacgaaattatccggaaacgcgataatgcccttgagctgtcgcagcttgagaatcgcatattaaaccagacggctgacatgctccagcttgcatcaaagtataaagatcttgagcacaaataccagcatctggcaacgctcgcccacaatcaatcggagattatagcccagctggaagagcattgccaacgcgtgccctctgcccgcccggtgccacagccgccgcccgcagccccgccaagggtgtaccagccgccgacgtacaataggataataaatcagatttccaccaatgagatccagtccgatcagaatcttaaggtgctgccacccccactgcctaccatgcctacactcaccagtctgccatcctcaacagacaagccgtcgggcccctggcgcgactgtctccaagctttggaggacggccacgacacgtcttccatatacctggtgaagccagagaacacaaaccgcctcatgcaggtgtggtgcgaccagagacacgatcctgggggatggaccgtgatccaacgtcgactcgacgggtctgtcaacttctttaggaactgggagacctataaacaaggctttgggaacattgacggggagtactggctcgggttggaaaatatttactggttgactaaccaaggcaactacaagctgctggtaacaatggaggattggtccggtagaaaagtgttcgccgagtacgcatcatttcgtctggagcccgagtcagaatactacaaattgcgtctgggtagatatcacggtaacgcaggcgattctttcacctggcacaacggtaaacaattcactacactggatcgtgaccacgacgtgtataccggcaattgcgctcactaccaaaagggtgggtggtggtacaacgcttgcgctcacagtaaccttaatggagtctggtaccgtggagggcactaccggtccaggtaccaagacggagtgtactgggcagaatttaggggtggcagctacagcctgaagaaggtggtcatgatgatcagaccaaaccccaatacattccactag

SEQ ID NO: 5792 - DNA, 1959 bp, Artificial Sequence
  Description of Artificial Sequence: Synthetic coding sequence
atggccgctgccgcactaccacctcggcccctgctgctcctacctctagtacttcttctgtcaggaaggcctacccgcgccgactctaaggtgttcggagatttggaccaggtgcgcatgacatctgagggatccgactgccgatgtaagtgcatcatgcgaccgctgagtaaggacgcatgcagcagagttcggtcgggccgggctcgggtggaggatttctatactgtagagaccgtgtcttccggcacagactgcagatgctcctgcaccgcccctccttcatccttaaacccttgtgagaatgaatggaagatggaaaagctgaagaagcaggcaccggaactactgaaactgcagagcatggtggatcttctcgagggcacactttatagtatggatctcatgaaggtgcatgcatatgtccacaaggtcgcatcccagatgaatactctggaagaaagtattaaagcgaacttatcccgggagaatgaggtggtcaaggacagcgtcaggcaccttagcgaacagctgcggcattacgagaatcactccgcaatcatgctaggtatcaagaaagagctttctaggttgggactgcaactcttacaaaaggatgcagccgcagcccccgccacgcccgctacaggcactggctcaaaagcgcaggataccgcacggggaaaaggaaaggacatctctaagtatgggagcgtgcagaagagtttcgcggaccgggggctgccaaagccaccaaaagaaaaactgttacaggtggagaagctgagaaaggagagcggcaaaggttcatttcttcagccgacagctaagccccgggctctggcccagcagcaagccgtaataaggggtttcacctattacaaagcaggcaaacaggaggtaaccgaggccgtggccgataatactctgcaggggacctcttggctagagcagctcccaccaaaggttgagggacgatccaactcggcggagccaaatagtgccgaacaggacgaagctgagcctcggagtagcgaacgggtcgacctcgccagcggcacaccgacttctattccagctactaccactaccgcgacgacaacccctactcctactacctctcttttgcccacggagcccccaagcggaccagaggtgtcttcacaggggagggaagcttcttgtgaaggaactctgcgcgccgtggatcccccggtccggcatcactcatacgggaggcacgaaggggcctggatgaaggacccggcggcgcgggatgatagaatttacgtgaccaactattactacggcaattcccttgtagagtttcgcaatctggaaaacttcaagcagggacgctggtccaacatgtataagttgccctacaattggattgggactggacatgtggtctatcaaggggcattttactataacagagctttcaccaagaacatcatcaaatatgaccttcgccaacggttcgtcgcttcttgggcgttattgcccgacgtcgtgtatgaggacactaccccctggaagtggagaggccacagtgacattgactttgccgtggatgagtcaggcctttgggttatctacccagccgtggacgatcgcgacgaggctcagccagaggtcatcgtcctttctcgtctggatccgggagacttaagtgtccatagggagacaacatggaaaacccgccttcggagaaactcctatggtaactgcttcttggtttgtggaatactctacgctgttgacacatacaaccagcaggaagggcaggtggcgtatgctttcgatacacataccggaacggacgcacggccacagttgccctttctgaatgagcacgcctatactacacagattgattataatcccaaggagagagtgctctatgcttgggacaacggtcaccagctcacctacaccttacattttgtcgtgtag

SEQ ID NO: 5793 - DNA, 1641 bp, Artificial Sequence
  Description of Artificial Sequence: Synthetic coding sequence
atgaaaaatcaggacaaaaaaaatggcgctgctaaacaatccaaccccaaatcgtcccctgggcagcccgaggctggccctgagggcgcacaggaacggccctctcaggcagcgccggcggtcgaggctgaaggccctggctctagtcaggcgcctagaaaacccgagggggcacaggcccgcacagcacaaagtggagccttacgcgatgtgtcagaggagctctcgagacagctcgaggacattctctcaacctactgcgttgataacaatcaggggggccccggcgaagatggcgcgcaaggcgagcccgcggaaccagaggatgcagagaaaagccgcacgtacgtcgcgcgaaacggagagcctgaacctacacctgttgtaaatggcgaaaaagaacccagtaagggagaccccaacacagaggagattagacagtctgacgaagtaggggacagggatcatcgacggccacaggagaagaaaaaagcgaaaggtctcggcaaagagatcaccctcctgatgcagaccctgaacacccttagcaccccagaagaaaagctggccgcattgtgcaaaaagtacgccgaactgctggaggagcaccgcaattctcaaaagcaaatgaaactcttacagaagaaacagtcccagttagtccaggagaaggatcaccttaggggcgaacactccaaggcggtgttggctaggagcaagctggagtctctgtgtcgagaactgcagaggcataaccggtctttgaaggaggagggtgtacaacgagcccgcgaggaagaggagaagcgcaaggaagtcactagtcactttcaggtaaccctaaacgacattcagctacagatggaacagcataatgagcgcaactccaaacttcgccaggagaacatggagctcgccgagcggctgaagaagttaatcgaacagtacgagctgcgcgaagaacatatcgataaggtcttcaaacataaagaccttcaacagcagctggtcgacgctaaactacagcaggcacaggagatgctgaaggaggctgaggagcgacaccaacgcgagaaagattttctgctcaaagaggcagtcgagagtcagcggatgtgtgaacttatgaagcaacaggagacccacctgaaacagcagctagccctgtataccgagaagttcgaggagttccagaataccctgtcaaagagcagtgaggtcttcactaccttcaaacaagaaatggagaaaatgactaaaaagatcaaaaagttagagaaggaaacaacaatgtatagatcccgctgggaaagctcaaacaaggcattgttggaaatggctgaagagaagacagtgcgcgataaggaactggaaggattgcaggtcaaaatacaaagactggagaaactttgccgcgccctgcaaaccgaacggaatgacctgaacaaaagagtccaggacctgtcggcgggcggccagggatcgctcactgattccggccctgagcgtaggcccgaggggcctggggcgcaggccccctcttctccgcgggtgacagaagccccctgttacccaggagccccttcaaccgaagccagcggccaaacaggtccccaggagcctacatccgcccgagcctag

SEQ ID NO: 5794 - DNA, 1641 bp, Artificial Sequence
  Description of Artificial Sequence: Synthetic coding sequence
atgaaaaatcaggataaaaagaatggcgccgccaaacagagtaacccaaagtcttcaccaggccagccggaagctggccctgaaggggcacaagaacgccctagccaagctgcacctgcggttgaggccgaaggtccgggcagctctcaagctccccgcaagcctgaaggggcccaagcgagaacagcacagtctggcgctctgagagatgtgagtgaggagttgtcacgacagctggaagatatcctttctacatactgcgtggacaataatcagggtggacccggtgaagatggcgcacagggcgagcccgcagaaccagaggatgcggagaagtcacgtacatatgtggcaagaaacggagagccggaacccacccccgtcgtaaacggggagaaggaacctagcaagggggatcctaataccgaagaaatccgacagtcagatgaagtgggcgatcgagaccacaggaggcctcaggaaaaaaagaaagcaaaaggactaggaaaagaaattactctgctgatgcagactttaaacacactcagcaccccagaggagaaactcgccgctttgtgtaagaagtacgctgaactgctcgaagagcatagaaacagtcagaagcagatgaagcttttgcagaaaaaacagagtcagttagtgcaggagaaagaccacctccgaggcgagcattcaaaggccgtgctggcccggagcaaactggagagtctgtgtcgcgagttgcagaggcacaacaggtcgttaaaagaagaaggggtgcaacgcgcccgtgaagaggaggaaaaaaggaaggaggttacttcccacttccaggtcaccctaaatgacattcaattgcaaatggaacagcacaatgagcgcaatagcaaactcagacaggaaaacatggagctggcagaaaggctgaagaagttgattgaacagtatgaactcagggaggagcacatcgataaggtctttaaacacaaggatctgcagcaacagctggtcgatgctaagttgcagcaggcacaggagatgctcaaggaggcagaggagagacaccagcgagaaaaggattttttgttgaaagaagccgtagaatcccagagaatgtgcgagctcatgaaacagcaggagactcatctgaagcagcaactcgcattatatacagaaaagtttgaggagtttcagaatacactgagcaagagctcagaagtctttactaccttcaagcaagagatggagaaaatgaccaaaaagatcaaaaagctggagaaagagacgacaatgtatcggtcccgctgggagagctccaataaggccttgctggaaatggctgaggaaaaaacagttcgggataaagagcttgagggactccaggtgaaaattcagcggctggaaaagctttgccgagccctgcagaccgagaggaatgatcttaataagagagtgcaagatctgtcagcaggggggcaggggtctttgactgacagcggtcctgaacgaagacctgaagggccaggagcccaggcccccagttcacctagagtgacggaggcaccctgctaccccggagcgccgtccactgaagcctctggacagacgggtccccaggaaccaacctctgcacgcgcctag

SEQ ID NO: 5795 - DNA, 1392 bp, Artificial Sequence
  Description of Artificial Sequence: Synthetic coding sequence
atgcatggttcttgctccttcctgatgctgctcttacctctcctattactgctggtggcaactaccggccccgtgggcgcgctgacagatgaagagaaaagacttatggttgagctgcataatttataccgggcacaggtctcacctactgcctcagacatgctgcacatgcggtgggatgaggagttggccgccttcgcaaaagcttatgcccgccagtgcgtgtgggggcacaacaaggaacggggcagacgcggtgaaaatctatttgctatcacagatgaggggatggacgtgcccctggccatggaggagtggcatcacgagcgggaacattacaatttgagcgcagcaacctgctcacctgggcagatgtgcgggcactacacacaagtggtctgggccaagaccgagaggattggctgcggcagtcacttctgtgagaaattgcagggtgtggaagaaaccaatattgagctgcttgtttgcaattatgagcctccaggtaatgttaaagggaaacgcccgtaccaggagggcactccctgcagccagtgtccaagtgggtaccattgcaagaattctctgtgcgagccgatcggctcccccgaggacgcacaggatctgccatatctcgtgaccgaggctcccagcttcagagcgaccgaagcgtcggactctaggaaaatggggacaccatcttctctggcgactggcattcccgcattcctggtgactgaggtttctgggagcctggcaaccaaagctctacccgctgtggaaacccaggctcctaccagccttgctactaaggatcctccttccatggctacagaagcccccccctgtgttacaaccgaggttccatcaattctggcagcgcacagcctgccttcactggacgaggaaccagtaacgttcccaaagagtacccacgttccaattcccaaaagcgctgacaaggttacagataaaacaaaggtacctagccggtctcctgaaaattcactagatccaaaaatgtctctcaccggagccagggaattgcttccccacgcccaagaggaggccgaagcagaggccgagctgcccccgtctagcgaagtcctagcttctgtctttcctgcacaggacaagcccggcgagctgcaggccactctggaccatacaggccacacatccagcaaatcacttccaaacttcccgaatactagtgccactgcgaatgccactggtggaagggcccttgccctgcagtcctcgctgccaggggcagaaggcccagataagccatcagtagtttccggactgaattccggcccaggacatgtgtgggggccattgctgggtctgctgctattgccaccactggtgctggcaggtatcttctag

SEQ ID NO: 5796 - DNA, 459 bp, Artificial Sequence
  Description of Artificial Sequence: Synthetic coding sequence
atgatgttgccccagtggctgctgctcttgtttttactcttcttctttctgttccttctgacgcgaggtagcctttctccaacgaagtacaatctgctggaactcaaggaatcatgtatccgaaaccaggactgcgaaacaggatgctgccagcgagcccccgataattgcgagagccactgcgctgaaaaaggcagcgaagggtctctctgccagactcaggtcttcttcggccagtatcgcgcctgcccatgcctgagaaatcttacttgcatctattccaaaaacgaaaagtggctgagcatagcttatggtcgatgccagaaaataggcaggcagaaactggctaaaaagatgtttcttgttctcccgccttcctgttgtctgctccttcttcatctgttaagcagtttacctcgagcattatgttccccatgtagcccagagcctcctccctag

SEQ ID NO: 5797 - DNA, 366 bp, Artificial Sequence
  Description of Artificial Sequence: Synthetic coding sequence
atgatgttgccgcagtggttgttactgctcttcctcttattctttttcctttttcttttgacacgggggtcgctttcacctaccaaatacaatctgctggagttgaaagaatcttgcatccgcaatcaggactgcgagactgggtgttgtcagcgcgcacccgacaactgcgaatctcactgtgcggaaaaggggtcagagggttcgttgtgccagacccaggtttttttcggacagtatcgcgcctgcccatgcctgagaaacctcacttgcatctatagtaagaatgagaaatggttgtccattgcttatggtagatgccaaaaaatcggacggcaaaagctggcaaagaagatgttcttttag

SEQ ID NO: 5798 - DNA, 1122 bp, Artificial Sequence
  Description of Artificial Sequence: Synthetic coding sequence
atgcgcctcctagcatggttgatattcctcgcaaactggggtggagcgagagccgaacccggtaagttttggcacattgcggatctgcatttggatcccgactacaaagtttcaaaggatccttttcaagtgtgcccaagcgccgggagccagccagtgcccgacgcaggaccatggggagattatttgtgcgattcaccatgggctttgattaactcgtctatttatgcaatgaaagaaatcgagcccgagccggatttcattctttggacaggcgatgatacaccacacgtacctgatgaaaaactcggtgaggctgccgtcctggagattgtcgaacggctgacaaaacttattagggaagtatttccagacaccaaggtttatgccgcattaggcaaccacgactttcatccgaaaaatcaattccccgcaggttctaacaacatttacaatcagatcgcagaactgtggaaaccatggctttctaacgagtctatcgcgctgtttaaaaagggagcattctattgcgagaagttacctggtcccagcggggcaggacgaatagtggtactgaatacaaatctgtactacacttccaatgcccttacagccgatatggcggatccaggacagcagttccagtggctggaggatgtgctgacagatgcgtccaaggctggtgacatggtatatatcgtaggccacgtcccccccggtttctttgagaaaacccagaacaaagcctggttccgtgagggatttaacgagaaatatctcaaggttgtcagaaagcaccatcgcgtgattgctggtcagttcttcggacatcatcatacggatagctttagaatgctgtatgacgacgcgggggtccctatcagcgccatgtttataacccctggcgtaaccccttggaaaacaaccttgcctggagtggtgaatggcgccaacaatcccgccattagggtatttgagtacgatcgggccaccttgagtttgaaggtccggagccccgctgaagcacgcggtggcggctgggagggccttaagtgtatcacaactttccctcactcacagcttatacacctgccactcaccacagaacctcaggagggctag

SEQ ID NO: 5799 - DNA, 810 bp, Artificial Sequence
  Description of Artificial Sequence: Synthetic coding sequence
atgagacttctcgcctggctcatctttttggctaattgggggggagctagagcagaacccgaagaagctcaggggccctgtgcccaggagaagggcaagggccccccgccaacatccatcctagcgtcgctagctcccggcttggaggccgggaagttctggcatatcgccgatctgcacttagaccctgattacaaagtatccaaggatccctttcaagtctgcccttcagccggaagccaacccgtgccagacgccgggccctggggggattatctctgcgacagtccgtgggctctcatcaacagttcaatttatgctatgaaagagattgagcctgagcctgacttcattctgtggaccggggacgacacccctcatgtgcctgatgagaaactgggcgaagcagcagtgcttgaaattgttgaacgtctcaccaaacttatcagagaggtctttccggacactaaggtctatgctgcactgggcaaccatgattttcaccccaaaaaccaatttcctgccggtagcaacaacatttataaccagatcgcagaactctggaaaccttggctttctaacgaatcaatcgctttgtttaagaagggggccttctattgcgaaaagctgccgggtccctccggggccggacgaatcgttgtgctgaacacaaacttgtattacacgagtaacgctctgaccgccgatatggcggaccccggtcagcagtttcagtggttagaggatgttctgacggatgcaagcaaggctggagatatggtgtatatcgtgggtcacgtccccccatag

SEQ ID NO: 5800 - DNA, 1368 bp, Artificial Sequence
  Description of Artificial Sequence: Synthetic coding sequence
atgcggcttctcgcatggctgatctttctggccaattggggaggagcccgggccgaacctggtaagttctggcacattgcagatctgcatttggatcccgattacaaagttagtaaagatccctttcaggtttgtccctccgcgggatcacagcctgtgcccgacgcgggcccttggggagactacctgtgcgacagcccatgggccttgatcaacagcagcatctacgctatgaaagagatcgaacctgagcccgatttcatcctgtggaccggggatgatactccccatgttcctgacgagaagttaggcgaggccgccgtcctggaaattgtcgagcgattgacaaagcttatcagggaggtcttccccgataccaaagtgtacgctgcccttggcaaccacgactttcaccctaaaaatcagtttcccgcaggttcgaacaacatctacaatcagattgccgagctctggaaaccttggctgtcaaacgaatcaatagctctgtttaagaaaggagcattttattgcgaaaaattgccaggtccttccggcgcaggcaggatagtcgttctcaacacgaacctttattatacttctaacgccctgactgccgacatggctgaccccggtcaacagtttcagtggcttgaagatgttcttactgatgctagcaaggccggagacatggtgtacatcgtagggcacgtgccccctgggttctttgagaagacacagaacaaagcctggttccgggaggggttcaacgaaaagtacttgaaggtggtgcgcaaacaccaccgcgtgatcgccggccagttcttcggtcaccaccatacggactctttccgcatgctgtacgatgatgccggcgtaccaatcagcgccatgttcattacccccggcgttactccatggaaaacaacactgcccggcgtcgtcaacggggcaaataacccggccatccgcgtcttcgagtacgaccgcgccacactgtccctcaaagatatggttacttattttatgaatctgtcccaggctaacgcacagggcacaccaaggtgggaactcgaatatcagttgaccgaggcctacggagtgccagatgcttcggcccatagtatgcatacagtgctggatcgtatagccggagaccagagtacactgcagaggtactacgtgtacaattctgtctcctattctgccggcgtgtgcgacgaggcctgttccatgcagcatgtatgcgctatgaggcaagtcgacatcgacgcgtacactacctgcctctatgcaagtggcactactcctgttccccaacttcccctcctgctgatggctctactcggcctctgcacccttgttctgtag

SEQ ID NO: 5801 - DNA, 867 bp, Artificial Sequence
  Description of Artificial Sequence: Synthetic coding sequence
atggcccttgcgccgccacctcggggcttgtggcaggcaaaagacattagcccgattgttaaggccgcccggcgagatggggaattactgttatctgcacaattagattctgaggagcgcgatccaggcgtaccgagaccaagtccttacgccccctacattcttgtgtacgcaaatgacttagctatttcagaacccaatagcgtggcagtgacactgcagcggtatgacccgttccccgccggggatccggagcccagggccgcccccaataatagtgcagatcctagggtccggcgcgccgctcaggcgacgggaccactgcaggataacgaattgcctggcctcgatgagcgccccccacgcgctcatgcccagcatttccacaagcaccaactgtggccctccccttttagggcactcaagcctcggcccgggcgcaaggaccgtcggaagaaaggacaggaggtgtttatggccgcttcacaggtgctggattttgacgagaagactatgcagaaagctcggcgaaaacagtgggatgagccgagggtgtgcagccgccggtaccttaaagtcgatttcgcggacatcggatggaacgagtggataatctcccctaagtcatttgacgcttactactgcgctggggcctgtgagttcccgatgccaaaaattgtgaggccttccaaccacgccaccatacagagtatcgtccgggccgttggaatcattcccggtattcccgaaccttgttgcgttcctgataagatgaattcccttggagtgctgttcctcgacgaaaatagaaatgtcgtactaaaggtgtaccccaatatgtcagtggatacatgtgcgtgccggtag

SEQ ID NO: 5802 - DNA, 1626 bp, Artificial Sequence
  Description of Artificial Sequence: Synthetic coding sequence
atgccatttaggcttctcattcctctgggactgctgtgcgcactcctgccccagcaccatggcgcgcctggcccagatggtagtgccccagaccccgcgcattattcttttagcctgaccctcattgacgcactagacaccctgctcatactcggcaacgtgtcagagttccagcgggtggtagaagtgcttcaagatagtgtggactttgatatagatgtgaacgcatcagtcttcgagaccaacatcagggtggtcggtggtctgctgtccgcccacctcctgtccaagaaagccggagtagaggtggaggcaggctggccctgctccggacccttgctccggatggcggaagaggccgcccgcaagctgctacccgccttccaaacgcccacaggtatgccttatggaaccgtcaatctccttcacggagtgaacccgggggagactcccgtcacctgtactgctggaatcggtacatttatagtcgaattcgcgaccctctcatcgctgactggcgacccagtatttgaagatgtagctcgtgtcgccctgatgcggttgtgggaatccagatcagatattggattagtcggcaaccatatcgacgtcctgaccgggaagtgggtcgctcaggatgccgggataggggcgggcgttgacagttatttcgagtacttagttaaaggggctatccttctacaggataagaaattaatggccatgtttttagaatacaacaaggccatcagaaactatacacggttcgacgactggtatctctgggtgcaaatgtacaaaggtacagtttccatgcctgtgtttcaatctctggaagcttattggcccggactgcagtctctaatcggcgatatagataatgcaatgcgaaccttccttaattattacaccgtttggaaacagtttggaggcctacctgaattttacaacatacctcaaggttataccgtagaaaagagagagggctaccctttgaggccggagctgatcgaaagcgctatgtatttgtatagagccaccggtgaccccaccctcttagaactggggagggacgctgtggagtctattgagaagatatccaaagtggaatgcggcttcgcaacaataaaagatttgagagatcacaagctggataatcgcatggagtccttcttcctggcggaaactgtgaaatatttatacctgctatttgacccgactaatttcatacacaataatgggtcaacatttgatgccgtgatcactccctacggggaatgcatcctaggcgccggtggttatatattcaatactgaagcacaccccattgacccagccgctttgcactgttgtcagagattgaaggaagagcaatgggaagtggaggacctcatgcgagaattttattccctcaaaagatctagatccaaatttcaaaaaaacacggtatcgagtggcccatgggaacctccagcaagacccggcacactcttttctcccgagaaccatgatcaagccagagagcgcaaaccagctaagcaaaaggttcctttgttgtcatgtcccagccagccgttcaccagcaaactggcccttctgggtcaagtgtttcttgattcatcatag

SEQ ID NO: 5803 - DNA, 1737 bp, Artificial Sequence
  Description of Artificial Sequence: Synthetic coding sequence
atgccattccggctcctcatacctctgggactcttgtgcgctttgctgccacagcatcacggcgcgcccggtcctgatggaagcgccccagacccagcacactacagagagcgggtcaaggcgatgttttaccacgcgtacgactcataccttgaaaacgcgttcccattcgatgaactccgccccctgacctgcgatggccatgatacatggggctcattcagcctcaccctgattgacgctcttgatacactacttattctaggcaacgtgagcgaattccaaagggttgtggaggttctccaggattctgtcgacttcgatattgatgtgaatgcgagtgtgtttgagactaatatccgcgttgtgggaggactcttgagtgcccacctcctttctaagaaggccggggtcgaagtcgaagcgggttggccctgctccggaccactcctgcgaatggccgaggaggcggctcgcaagctcctgccagcttttcagacccccaccgggatgccctacggcacagtcaacttactccacggggttaaccccggtgaaacacccgtgacgtgcacagcagggattggcacttttatcgtggaattcgccacactgtcttctctgaccggtgatcctgtatttgaagacgtggcaagggtggccctgatgagactctgggagtctaggtctgacatcggcctggttggcaaccacatagacgtactaaccggaaagtgggtggcccaggacgcgggtatcggcgctggcgtcgattcttactttgaataccttgtcaagggagccattctcctccaggacaaaaagctcatggccatgttcctcgaatataataaagccattcgcaattatacccgctttgatgattggtatttgtgggtgcagatgtacaagggtaccgtctccatgcccgtctttcaatctctggaagcctactggcctgggctgcagagcctaattggggacattgacaacgccatgcgtacttttcttaattactataccgtctggaagcagttcggtggactccctgaattctacaacattccgcagggatacactgtcgagaagcgcgaaggctatcctttgcgaccagagctaatagagtccgccatgtacctatatcgcgccacgggggaccctaccctgctcgaactcgggcgcgacgcagtggagtcaatcgagaaaatctccaaagtggaatgtgggtttgccactatcaaggacctccgcgaccataaactcgacaaccgtatggagagctttttcttggcagagaccgtaaagtacctgtatttgcttttcgaccctactaacttcatacataacaacggcagtactttcgacgccgtaataaccccttatggtgaatgtatcctgggcgcaggcggctacatattcaacaccgaggcacatccaatagacccagcagctctgcactgttgtcagaggctgaaagaagagcaatgggaggtggaggatctcatgagggagttctattctcttaaacggagtagatctaagtttcagaagaatacagtctcctctggaccctgggagcctcccgcgcgccctggcacccttttttctcccgagaaccacgaccaggccagagagagaaagcctgccaagcaaaaagtgccacttttatcctgtccctctcagccatttacatccaagttggcgttgctgggacaggtgttccttgattccagctag

SEQ ID NO: 5804 - DNA, 495 bp, Artificial Sequence
  Description of Artificial Sequence: Synthetic coding sequence
atgaggagctgctatgttgctcaggctggtttaaagttaccagggagcagcgatcctcctgccagcgcatctcagagtacacgcattactgccagcggctacggccctccgtcttcccgaccatcaagtagagtggtgaatggcgaggacgccgtcccatactcctggccatggcaggtcagtctgcaatacgagaaaagcgggtctttttaccacacctgtggtggtagcctgattgctcctgactgggtggtgacggccgggcattgtatctcaagcagccgtacgtatcaggttgtgcttggtgagtacgatcgggccgtgaaagagggtcccgaacaagtgatccctattaatagtggtgatctgttcgtgcatcccctttggaatcgtagctgcgtagcctgcggcaatgatattgcattgatcaagttgtcaaggtctgcacaactcggcgatgccgttcagctcgctagtctccccccggcagggtag

SEQ ID NO: 5805 - DNA, 3663 bp, Artificial Sequence
  Description of Artificial Sequence: Synthetic coding sequence
atgcccgggttactcaactggattaccggggcagcgctgcctctgaccgcatccgatgtcacttcttgcgtgtcagggtacgcactgggccttaccgcctctcttacatacgggaatctggaggcccaaccgttccaggggctgtttgtttaccctctggatgaatgcactacagtaattgggtttgaggccgttattgccgatcgcgtggtcactgtgcagatcaaagataaggctaaactcgaatctgggcacttcgacgcatcacacgtcaggtccccaacagtgacagggaatattttacaggacggagtatcaatcgctccgcactcctgtacccccggaaaggttacactcgacgaggacctggaaagaatactgtttgtcgctaaccttgggacaattgctcccatggagaatgtcactatctttatctcaacaagttccgagcttccaactctcccgtcgggagccgtgagagttttgctgcccgccgtgtgtgcacccaccgttccacagttctgtacgaaatctaccggcaccagcaaccagcaggcccaagggaaagatagacactgctttggggcctgggccccaggaagttggaacaaattgtgcttggctaccttattgaacactgaggtgtctaaccccatggaatacgaattcaacttccagctggagattcgcggcccctgtctcctcgccggggtggagagcccaacccacgagatccgggcagacgctgccccatcagctcgcagcgccaaatctattattatcaccctggctaataagcatacctttgaccgcccagtagagattctgattcatccgtccgagccacacatgcctcacgtgctgatcgagaagggtgatatgaccctcggagagtttgatcaacacctgaaaggacgcaccgacttcatcaagggtatgaagaagaagtctagagctgagcgcaaaaccgagatcattcgcaagagactgcataaggatattccacatcatagcgtgatcatgctgaacttttgccccgaccttcagagcgtccagccatgtttaaggaaagcacacggcgaattcatattcctgatagaccgaagctcctctatgtctggcattagtatgcatcgggtgaaggatgccatgctcgtagcgttaaagagcctgatgcctgcctgtctgtttaatatcatcggtttcggctccacctttaaaagtctcttcccaagcagtcaaacatattctgaagacagcctcgccatggcctgcgacgacatccagagaatgaaggctgatatgggcggcaccaacattctctcccctctgaagtgggtgatccggcaacccgtgcatcgcggacatcctcggttactgttcgtcatcacagacggcgcagtgaacaataccggcaaagtcctggagcttgtgcggaaccacgctttctcgacaagatgttactccttcggaatcggccccaacgtctgccaccgccttgttaagggtctggccagtgtcagcgagggttctgccgaactccttatggaaggcgagagactccagccaaagatggtgaaatctcttaaaaaggccatggcccctgtgctgtccgatgtgaccgtggagtggatcttcccggagactactgaggtgcttgtcagtccggtaagcgcctcctctctctttcccggcgaaagactcgtgggatacggaatcgtttgcgacgcctcattgcatatttcgaaccctcgatcagacaagcgtcgtcgatactcaatgctacattctcaggagtctgggtcatcagtattttatcactcccaggatgacgggcccggtctggaggggggcgattgcgccaaaaattcaggagcaccctttatcctcggccaagccaaaaatgcaagactggcttctggagacagcactaccaagcatgacctcaatctgtcacagagaagaagagcatactccaccaatcagataaccaaccataagccgctgccccgagcaactatggcgtctgaccccatgcctgccgccaagcggtatcctttacgaaaggccagactacaggatctgacaaatcaaacgtccctcgacgtccagcggtggcagatcgatctgcagccactcctcaattccggccaggatttgaaccagggtccgaagcttcgggggcctggagcccgcagacccagcttactgccccagggatgccagcccttcctgccgtgggggcaggagacccaagcttggagccccgtgcgggagcggacatcagattccaggtccccaggggacttggagcccagccatcacccctctgcgtttgagaccgagacctctagcgactgggatccccctgcagagtcacaagaaagggcttcaccgagtcgacccgcaaccccagcccctgttctagggaaggccctcgtgaagggtctgcatgactcccaaaggctgcagtgggaagtctccttcgagcttggaacccctggtccagagcgcggcggggcacaggacgcagatctatggtcagaaacatttcatcacctagccgcccgggctatcattcgcgacttcgaacagctggctgaaagagagggagagatcgaacaggggagcaatcggagatatcaggtgtcagccctgcacacaagcaaagcttgcaacatcatttcgaagtacaccgcctttgttcccgtcgacgtctccaaaagtagatacctgccgacagttgtcgaataccctaattctgccgccttgcgaatgttgggatcaagggctctggcccagcaatggcgcggcacctcttcagggtttggtcgtccccaaactatgctgggcgaagacagtgcccccggaaatggaaagttccaagcactaaacatggaagcaagccctacagccctgttctctgaagcaaggtcaccaggccgggaaaaacatggggcctccgaggggcctcaacgaagccttgcaacaaacaccctcagctctatgaaggcctctgaaaatctctttggaagctggttgaaccttaataagagcagactcctcacccgggccgccaaaggctttctcagtaaacccctgattaaagccgtggagagcacttctggaaatcaatcctttgattatatccccctggtttccctgcagctcgcttcaggggcctttttattgaacgaggcattctgtgaagccactcatatccctatggagaagctgaagtggacaagtccctttacatgtcatagagtttccttaactacaaggccctccgaaagtaagactcctagcccacagttgtgtacatcatcgccgccccggcacccttcgtgtgattccttcagcttagagccattggccaaagggaagctgggattggaaccccgtgccgtggtggagcacaccgggaagctttgggccacagttgtcggcctggcctggctggaacactcgagtgccagctacttcacagagtgggagctggttgccgcaaaggctaactcctggcttgagcagcaagaagtccccgaagggcgcactcagggcactctgaaagcagctgccaggcagcttttcgttttgttaaggcactgggatgagaaccttgagtttaacatgctgtgctacaaccctaactacgtgtag

SEQ ID NO: 5806 - DNA, 3051 bp, Artificial Sequence
  Description of Artificial Sequence: Synthetic coding sequence
atgcctggactgctgaactggatcaccggagccgcactgccgctgaccgcaagtgacgttacctcctgcgtgtcaggttatgccctgggcctgacagctagtttaacttacggcaacctcgaagcgcagcctttccagggactgtttgtctaccctttagatgaatgtaccactgttatcgggtttgaggccgtgatcgcagatcgagtggtgactgttcagatcaaggataaagccaagctggaaagtgggcactttgatgcctcacatgtcaggtcccccacagttactggtaatattctacaggatggagtgtctattgcgccccatagttgcacccctgggaaggtgacacttgacgaagatctggaacggattttgtttgtcgccaatttaggtacaattgcccccatggagaatgtcaccattttcatctcaaccagttctgagctgcccactctccctagcggggcagtcagggtcctcttaccggctgtgtgtgccccaacggtgccccaattttgtacgaaaagcacaggaacttctaatcaacaagcccaggggaaagaccggcactgtttcggagcttgggctccgggctcctggaacaaactctgcctggcaaccctgctaaacaccgaagtcagcaatcccatggaatacgaatttaactttcagctcgaaattcgtggcccatgtttgctcgctggagttgagtcccccacccacgagatacgggccgacgcggcaccttcagctcggagcgccaagagtatcattatcacgctagccaataagcatactttcgatcggcctgtggagatcctcattcacccctccgagccacacatgcctcatgtgctaatagagaaaggcgacatgactctgggcgaattcgatcaacacctcaaaggccgtactgacttcatcaagggaatgaagaaaaaaagccgcgcagagagaaagaccgagattatcagaaagagactgcataaggatatccctcaccacagcgtcataatgctaaacttctgtcccgaccttcagtcggtgcaaccctgtctcaggaaagcacacggtgagttcatttttctcattgaccggagcagcagcatgagcggcatttcgatgcatagggtgaaggacgccatgctagttgccttgaaaagcctgatgcccgcttgcctgttcaatattatcggattcgggagcacatttaagagcttatttccatcttctcaaacctattccgaagattctctggccatggcgtgcgacgacatacagagaatgaaggccgacatgggcggaaccaacatcctctctccactgaagtgggtgatcagacaacctgtgcacagagggcaccccaggctgctgtttgtaatcactgatggagctgtgaacaataccgggaaagttttggagctggtacggaaccatgccttctctacccgctgctacagtttcggtattggtcccaacgtctgtcacagactggtgaagggactggcctctgtgtctgagggctcagctgagctgttgatggaaggagaacgattgcaaccaaagatggtaaaatcgctgaagaaagccatggcccccgtgctgagcgatgtcacagttgagtggatatttcctgagactaccgaagtcctggtatcccctgtaagcgctagcagccttttcccgggcgagagactagttggatacgggattgtgtgtgatgccagtttgcacatttccaatccaagaagtgacaagcgccgccgctattccatgctgcattctcaggagtccggtagcagtgtattttaccacagtcaggacgacggaccaggcttggaggggggggactgtgctaagaatagcggggccccttttattctgggccaagcgaagaacgcccggctggcctccggcgatagcacaacaaagcacgacctcaatttgtcacagagacggcgggcatacagtacgaatcaaatcacaaaccataagcccctgccccgtgccacaatggcctctgacccgatgccagccgccaagcgctatcctctgcgaaaggccagactccaagatttgaccaatcagacctccttggatgttcaacgttggcaaatcgacttgcagccccttctgaattcgggacaggatctcaaccaggggcccaaacttcgcggtcctggggcccggagacctagcttattgcctcaggggtgtcaaccattccttccttgggggcaggagacccaagcatggtccccggtgcgggagaggacatcagactcaaggtcccccggtgatctcgaaccctcacatcaccccagcgccttcgaaactgagactagctccgattgggatccgccagccgagtctcaggagcgtgcgagcccttctcggccggccaccccagccccagtactcggcaaagcgctggtcaaaggtctgcacgattcccaacgcctgcagtgggaggtctcttttgagctggggacacccggacctgaacgtgggggtgcccaagatgccgatctctggtctgaaaccttccatcaccttgccgctagagcaatcatcagagactttgagcagttggcagaaagagagggggagatcgaacaaggttcaaacagacgctaccaggtatccgccctacacacctctaaggcctgtaacataatctctaagtacacggcctttgtgcctgttgatgtatcaaagagcagatatttgccaaccgttgtcgaataccctaactcagccgctctgcgcatgctgggctcacgagctctcgctcagcagtggcgtggaacttcgtctggcttcggccgccctcaaaccatgctcggagaagactctgcccccggtaatggacctcggaaatgttcgcagaccctgatgggtttcaaaacgaagaccgagactgagcattctgtaaggggatggaaaccgcggggcgcgctgcaaaaccagtctgtccttagcaccagttggtcccactggccccccaaaccacggcggacatcttccacaccagagccttcatag

SEQ ID NO: 5807 - DNA, 3663 bp, Artificial Sequence
  Description of Artificial Sequence: Synthetic coding sequence
atgcccggcctgctgaattggatcaccggcgcagctctgccgttgacggcctccgatgtcacttcatgcgtgagtggctatgccctgggactaactgcttcactcacatacgggaatctggaggcccaacctttccaagggctctttgtttaccccctggacgagtgtaccaccgttattggtttcgaggcagttatcgccgacagggtcgtgaccgtgcagatcaaggacaaagccaaactggagtcggggcacttcgacgctagccacgtcaggtcccccaccgttacaggaaatattctccaagatggagtgtctattgccccacacagttgtacccctggcaaagtgaccctcgacgaggatctcgagcggatcctcttcgtggcgaatctggggacaatagcccccatggagaacgtgacaatcttcataagcacatcttccgagctgcccaccctgcctagtggcgccgtgcgggtattgcttccggccgtgtgcgctcccacagtgcctcaattctgtacaaaaagcaccggaacctcaaaccaacaggcccaaggcaaagaccgccattgctttggcgcttgggcacctggtagctggaacaagctgtgcctggctaccctactgaacacagaagtgagcaatcccatggaatacgagtttaactttcagttggaaatccgtggaccttgcctactcgccggcgtcgaatccccaacacacgaaattcgcgctgatgctgcgccctccgcaagaagtgcaaagtcaattattattacacttgccaacaagcacaccttcgatagacctgtggagatactcatacatcccagcgagcctcatatgcctcacgtcttgatcgaaaagggcgatatgacacttggcgaatttgaccagcacctaaaaggccggacagatttcataaagggaatgaagaagaaaagccgggcggagcgcaagacagagattatacggaaaaggctccataaggatatccctcaccacagcgttattatgctgaatttttgccccgacctgcaaagcgtccagccttgcttgcgcaaggcccacggcgaatttatttttttgattgaccggagctcttccatgtctggtatctctatgcacagggtgaaggatgccatgctggtcgccctcaaatctttaatgcccgcctgcttattcaatattattggattcgggtcaacgttcaagtctctgttcccatcttcgcagacgtacagtgaggacagccttgctatggcttgtgatgacattcagagaatgaaggctgacatgggtggaactaatattttatctccactaaagtgggtcatccggcagcctgtgcaccgaggccatcctaggctgttgttcgtcatcacagacggcgctgtcaataacactgggaaagtgcttgagctcgtccgtaaccacgctttcagcactcggtgctacagttttgggattgggccaaacgtgtgccacagattggttaaaggcctggcatcagtctctgaaggaagcgccgagcttttgatggaaggggaaaggctccaaccaaagatggtgaaaagccttaaaaaggccatggccccagtcctctccgacgttactgtggagtggatcttcccggaaaccaccgaggtactcgtctcgccggtgagcgcgtctagtctatttcctggcgagcggctcgtggggtatggtatcgtctgtgacgccagcctgcacatctcaaaccccaggtccgacaagcgtaggaggtatagtatgcttcacagccaggagtccggctcctccgtgttctaccattcacaggacgatggcccgggactggagggaggcgactgtgctaaaaacagcggtgccccctttatccttggccaagctaagaatgctagactggcgtcgggagatagcactacaaaacatgatctgaacctgtcccagcggcggagagcctactcgactaatcagattaccaatcacaaaccactccctcgcgctacaatggctagtgaccccatgcccgccgccaaacgatatcctctaaggaaagcccgacttcaggacctgacgaatcagacctcattagacgtacagagatggcagatcgacctgcaaccattgctgaatagcggccaggacctaaaccaggggcccaaactgagaggcccaggagcccggcgcccttcccttttgccccagggatgccaaccctttttgccatggggccaggaaacccaggcatggtcaccggtccgggagagaacttcagacagcagatctcccggcgacctcgagccttcccaccacccaagtgccttcgagaccgaaacatcaagcgactgggatccacctgccgaatctcaagagcgcgcctccccaagccggcctgcaacgcccgcaccagtcctgggcaaagccttggtgaaagggctgcacgacagccagcggctccagtgggaggtctcattcgaattaggaacacccggacctgaacgtggcggagctcaagatgctgacctgtggagcgaaacatttcaccatttagcagcaagggcaatcattcgcgacttcgagcagctggccgaaagagagggcgaaatagagcagggttccaatagacggtatcaggtatccgcactgcacaccagtaaagcgtgtaacattatttcaaagtatacagccttcgttcctgtggatgtgagtaagtccaggtacttgccaacagtggtggaatatccgaatagtgccgctctccgaatgctcggatcgcgggccctcgctcagcagtggagaggcacgtcctccggattcggcagaccccaaaccatgttaggagaagactcagctcctggcaatggcaaatttcaagcgctaaacatggaagctagccctacagctctctttagcgaggcacggtcgcctggacgggagaagcacggcgccagtgaaggtccacaacgctccctcgcaactaacaccctaagctctatgaaagcatctgagaacctcttcggctcctggctaaacctgaataaaagtcggctactgacccgcgctgccaagggcttcttgtcgaaacctctgatcaaagctgttgagagtacgtcaggtaaccagagtttcgactatatcccactcgtgagcttgcagctagcatccggggccttcctgttaaacgaagctttctgtgaagccacccacatccctatggagaagcttaaatggacatctccatttacctgccaccgcgtgagtctgacaactcgcccctccgaatccaagacaccctcgcctcagctgtgtacatcaagcccaccaaggcatccatcatgcgattcatttagtcttgaaccactagctaaagggaaactcggtttggaaccacgcgcagtagtcgagcatacagggaagctgtgggcgaccgtcgtcggattggcctggctagagcacagctctgcatcttatttcaccgagtgggaactggtcgctgctaaggctaactcctggctcgaacagcaggaagtgcctgagggccggacacagggaacactgaaggctgctgctcgacagctattcgtgctgctgcgtcactgggatgagaacttagagttcaatatgctctgctacaaccctaactatgtgtag

SEQ ID NO: 5808 - DNA, 5235 bp, Artificial Sequence
  Description of Artificial Sequence: Synthetic coding sequence
atgagactgctgtggggtttaatatgggccagttccttctttactctgtccctgcaaaaaccgcggcttctcctgtttagccctagcgtcgtgcacctgggagtacccctttctgtgggagttcaactgcaagacgtccctaggggccaagtagtgaaaggatctgttttcctaaggaacccctcccggaacaatgtgccatgtagccctaaggttgattttaccctgagctccgaaagggatttcgcgttgctgagtctccaagtacctctgaaagacgcaaaaagctgcggtttacaccagttgctgcgggggccagaggtacagcttgtcgcacattctccttggctaaaagactctctttctaggaccacaaatatccagggcataaatctgctgtttagttctcgccgaggccacctgttccttcagacagaccagcctatttacaatccaggccagcgggtccgctaccgcgtgtttgcgctggaccagaaaatgagaccctctactgatacgatcaccgtgatggtagagaactcccacgggctccgcgtgcgaaaaaaggaagtttacatgcctagctcaatcttccaggacgatttcgtgattcctgacatttcagagccaggtacttggaaaattagtgcaaggtttagcgacggactggagtctaactcatctacacagtttgaggttaagaagtatgtgctgccgaacttcgaggtgaagattacccccggaaagccctatatcctgaccgtgcctggacaccttgatgaaatgcaacttgacattcaggctcggtatatatatggaaaacctgtccagggtgtagcatatgtccgtttcggtcttctggatgaggacggaaaaaagacttttttccggggccttgagtcccaaacaaaactcgtaaacggacaaagccatatttccctctctaaagcggaattccaggatgcattggaaaaattaaacatggggattacagatctacagggcttaaggctgtacgttgctgctgccattattgagtacccggggggtgaaatggaagaggctgagctgacaagttggtactttgtctcatcacccttttctcttgacctttcgaaaaccaagagacatctcgtgccaggagccccatttcttctgcaggccttggtgagagagatgtcaggatcgccagcaagtggtattccagttaaagtttcagccaccgtctctagccccggatccgtccccgaagtccaggacatccagcaaaacactgacggatccggtcaggtctcgattcccataatcatcccccaaaccatcagcgagttgcagctgtcggtcagtgccgggagcccccacccagctatagctcgtctcacggtggcagcaccccctagcggcggacccggattcctctccattgaaagaccggatagtcgccctccgagggttggagacacgcttaatttgaacctgagggccgtgggatccggagcaactttcagccattactattacatgatcctatcacggggccagatcgtgttcatgaacagggaaccaaagaggacactcacaagcgtgagcgtcttcgttgaccatcacctggcccctagcttttactttgtggcgttctactatcacggcgaccatcccgtggcaaacagcttaagagtggatgtccaagccggagcctgtgaaggtaaattggaattatcagtggatggtgccaagcagtacagaaacggggaaagtgttaaattacacctagagaccgactctttggccctggtggccctgggggcactggacactgccttatacgctgcaggaagtaaatcccataagccactcaacatgggaaaggtgttcgaggccatgaattcctacgatttggggtgtggacccgggggaggcgacagcgccctccaggtttttcaagccgcaggcttggcgttttcagatggagaccagtggactttgagccgtaaacgcctttcgtgccctaaggaaaagacaacaagaaagaaacgcaacgtcaactttcagaaggctattaacgagaagttaggccagtacgccagtccgaccgccaaacggtgttgtcaggacggcgttacaagattgcctatgatgcggagctgtgagcagagagccgcacgtgtccagcaaccagattgcagggagccatttctgtcttgctgtcagttcgccgaaagcctgaggaagaagtcgcgcgacaaaggccaggctggcctacaaagagcactcgaaattctgcaagaagaggatcttatcgacgaagacgacattccagtcaggtccttctttccagagaactggctgtggagagtcgaaacagtcgacaggttccagatcctgactctctggctgccggatagcctcacaacctgggaaatccatggcctctccctgagtaaaaccaagggtctctgcgttgctactcctgttcaactgcgggttttccgcgaatttcacttacaccttcggttgcctatgagcgtcagacggttcgaacaattggagctacggccagttctgtataactaccttgacaaaaacttaacagtgagcgtccacgtctctcccgtggagggtctctgcttggcgggcgggggcggcctggcgcaacaggtgctggtgcccgcaggaagcgcccggcctgtggctttttccgtcgtgccaacagcagctgcggccgtcagccttaaagtagtagcgagggggtccttcgagttccccgtcggagacgcagtttctaaggtgcttcagatcgagaaagagggagcaatccatagagaggagctcgtgtacgagttgaatccgctggaccaccggggccggaccctggagataccaggaaactctgatccgaacatgattcctgacggcgattttaactcttatgtgagggtaaccgcatccgatcccctagatacgctgggtagcgagggtgcactgagtcccggtggggtggccagccttctgcgcctcccaaggggctgtggcgaacaaacaatgatatacctcgcccctacactggccgccagcagatacctggacaaaaccgaacagtggtctactctgccccccgagactaaggatcatgccgtggacctcattcaaaaaggctatatgagaatccaacagtttcggaaggcagatgggagttatgcagcatggctttctagaggctcctccacctggctgaccgcgttcgtcttgaaagtgttatccctcgcccaggagcaggtggggggctcccctgagaagttacaggaaacaagtaactggctgctttctcaacagcaggcagacgggagtttccaggacctaagccctgtgatccatcgcagtatgcagggcggcttggtcggtaacgatgaaactgtagcattaactgcctttgtgaccatcgcactccatcatgggctggcagtgttccaggacgagggcgcggagcccctgaaacagcgggttgaggcctccatttcgaaggcttctagctttctcggggaaaaagcgtctgcaggactgctgggggctcacgccgctgcgatcactgcttacgcactcacattaactaaggcccccgcggaccttcggggagtagctcataacaatttgatggcaatggcccaggagaccggcgacaacctctattggggttccgtgactgggagccagtctaacgctgttagccccactcccgcccctcggaatccatccgatcccatgcctcaagctcctgcactgtggatcgagacgacagcttacgccctcctacacctcctacttcatgaaggcaaggccgaaatggcggatcaggctgcggcctggttgactcgacaggggtccttccaaggaggcttccgatcgactcaggatacagtgattgccttggatgcgctctccgcctactggatagcaagccataccaccgaggaacgtggcttaaacgtcacattgtccagcacagggaggaatgggttcaagtcacatgcccttcagctcaataatagacaaattagaggtctggaagaagagctccagttttccctgggtagtaaaataaacgtcaaggtaggcggaaactctaaaggtacattgaaggttctgcgcacctacaacgttcttgatatgaagaacacgacctgtcaggacctgcagattgaggtcacagttaaaggacacgtcgaatacacaatggaggccaacgaggattacgaggactacgagtatgacgaattacctgccaaagacgatccggatgcacccctccagcctgtaacacctctgcagctgttcgaaggacggcgaaaccgacgaagaagagaggcccccaaggtggtcgaagaacaggagtctcgcgtgcattacacggtgtgtatctggagaaacggcaaagtggggctcagcggaatggctatcgccgacgttaccctccttagtgggtttcacgccctgagggctgacttggaaaaactgaccagcctgagcgatcgctacgtgagtcactttgagactgaagggcctcacgtgttgttgtatttcgactctgtcccaaccagcagagagtgtgtgggcttcgaggccgtgcaggaggttccagttgggctagtgcagccggcttccgccacactgtatgattattataaccccgagcgcagatgctccgtgttttatggagccccctcaaagagtaggcttttggccaccctgtgctccgctgaggtgtgtcagtgtgcggagggtaagtgtccacgtcagagacgagctctggaacggggactgcaggatgaagatggataccgaatgaaattcgcttgttactatcctcgcgtggaatacgggtttcaggtgaaagtcttgcgggaggacagccgcgcagcctttagacttttcgaaaccaagattacccaggtgttgcatttcaccaaagacgtaaaagccgctgcgaatcaaatgaggaatttcctggtgagggcaagctgtaggttaagactcgaacccgggaaagagtacctgatcatgggcctagacggagccacttacgatcttgaaggacacccgcagtatctgctcgatagcaattcctggatagaagagatgcccagcgaaagactgtgcagaagcacaagacaaagggccgcgtgcgctcagctgaatgatttcctccaggaatatggcacccagggatgtcaggtgtag

SEQ ID NO: 5809 - DNA, 1242 bp, Artificial Sequence
  Description of Artificial Sequence: Synthetic coding sequence
atgaagggtgccctcggctcaccagtggcagcagccggggccgctatgcaggaaagttttggctgcgtggttgcgaaccggtttcaccagctgttggacgatgagagcgatccatttgatattttgagagaggcagagcgtagacgccagcagcagctgcagcgcaagcgtagagacgaagccgctgccgcagctggggcaggtccacggggcggcagatcacctgcaggcgcatctggtcaccgagccggcgctggaggcagacgagagtctcagaaggagaggaaatcattgccggcaccggtggcacaacgcccagatagtcctggggggggtttacaggctcccgggcaaaagcgcacgccgcgccgcggcgagcaacagggctggaatgatagtaggggtcctgaaggcatgctagagagggcagaaaggcgcagttacagagagtatcggccttacgaaacagaacggcaggcagatttcactgcagagaagtttcccgacgagaagcctggggacaggtttgatagggatcgtccattacgtggtcgggggggaccccgtggcggaatgagagggagaggccggggcggaccaggaaacagagtcttcgatgctttcgaccagcggggcaagcgcgagttcgagagatacgggggcaacgacaagattgcagttcggaccgaagacaacatgggcggatgcggcgtgcgcacttggggcagtggcaaagacacttccgatgtggaaccgacggccccgatggaggaaccgaccgttgtcgaggagagtcagggaactccagaggaagaatccccagccaaggtcccagagctcgaggttgaggaagagactcaggtacaggaaatgaccttggatgagtggaagaacctacaggaacagacgcgaccaaaaccggaattcaacattcggaaacccgaaagtaccgtcccaagcaaggccgtggttattcacaaatccaagtatcgagatgacatggtgaaagatgactacgaagatgactcacatgtctttcgaaagcctgctaacgacatcacctctcagctggaaattaactttggaaacttgccacgccctggacggggagccagaggtgggactagaggtgggcgaggcagaatcaggcgagctgagaactacggaccacgagctgaagttgtcatgcaggatgttgcccctaatcccgacgatccggaagatttccccgccctctcttag

SEQ ID NO: 5810 - DNA, 927 bp, Artificial Sequence
  Description of Artificial Sequence: Synthetic coding sequence
atgaagggagccctgggcagtccagttgccgcagctggagcagctatgcaggagtcgttcgggtgcgtcgtcgccaataggttccaccagcttctcgacgacgagagcgatccgttcgacattttacgggaggccgagcgccgacgacagcagcagctccaacggaagaggagagacgaagctgccgccgctgccggcgcaggcccaagagggggcagatcaccagctggtgcctctgggcaccgagccggggcaggtgggcgacgggaaagtcagaaggagcgaaaatcattacccgcccctgtcgcacagaggccagactcaccaggtggaggtcttcaggctcccgggcagaaacgcacgcctagacgcggggagcagcagggttggaacgattcacgcggccctgagggtatgttggaaagggccgagcgtcgatcctacagggaatatagaccatatgaaactgaaagacaggccgacttcaccgctgaaaaatttccagacgagaaggtgccggagctggaggttgaagaggaaacacaggtacaagagatgactctggacgaatggaagaacctgcaggagcaaacacgccctaagcctgagtttaatatcagaaagcccgaatccaccgtgccctctaaggccgtagtgattcataaatcaaagtaccgagacgacatggtgaaagacgattatgaagacgactctcacgtgtttcggaaacctgcaaacgatattacatctcagttggagataaacttcggaaacttaccacgtcctggccgtggggcgcggggaggaaccaggggaggcagagggcggatacgccgagccgagaactatgggcctcgagctgaagtggtcatgcaggatgtggcacccaatccggatgacccagaagacttccccgccttgtcatag

SEQ ID NO: 5811 - DNA, 1437 bp, Artificial Sequence
  Description of Artificial Sequence: Synthetic coding sequence
atgcctagacgcggctactccaagcctgggtcctggggaagtttttgggccatgctgacattagtgggattggtaactcacgcagcccagagggcagacgtgggcggggaggcagctggaacttctatcaatcactcccaagctgtcctccaaagactgcaggaacttttgcggcagggaaacgcatctgacgttgtgctgcgtgttcaggctgctggaaccgatgaagttagagtgttccatgcccacaggctgttgctgggactccattcggaattgttccttgagctgctctccaatcagagcgaagccgtgcttcaggagccgcaggactgtgccgccgtcttcgacaagtttatccgatacctttactgcggggaactgacagtacttctaacccaggctatcccacttcatcggctcgccaccaaatatggggttagcagcctgcaacgcggagtggctgactacatgcgcgcccacctggctggtggggcggggcctgccgtcgggtggtaccactacgctgtggggactggggatgaggccttgagggaatcatgcctgcagtttctagcctggaacctttcagccgttgccgcctccaccgagtggggcgcagtatcaccagaactgctatggcaacttctacagcggagcgacctcgtgttgcaagatgaactggagttgtttcacgctctggaggcgtggcttggtcgggcccgacctcctcctgctgtggccgaaagggcactgagggctattaggtatccaatgattcctccagcgcagttgtttcagctgcaggctcggtccgccgccctcgcgaggcatggacctgcagtagccgacttgctcctgcaggcctaccaatttcacgctgcctccccgttgcactatgctaagttctttgatgttaacggatctgctttcctgccaaggaattatctggccccagcttggggggctccatgggtaattaacaatccagccagggacgaccgctccactagctttcaaacacaacttggtccatctggccacgatgcagggagacgtgttacatggaatgtgctgttctccccccggtggctgcctgtctccttgaggcccgtctacgcggacgctgctgggaccgccctgcctgctgccaggcctgaggatggacgacctagacttgttgtaactcccgcctccagcggaggagacgctgctggcgtcagtttccagaagactgttctcgtgggtgcccgccagcagggcagacttctggtcagacatgcatactcttttcaccaatcttctgaagaggcgggggacttcctcgctcacgccgatctgcaaaggaggaacagtgagtatctggttgaaaatgcactgcatctgcacttaatcgtgaagcctgtgtaccataccctgattaggacccctaaatag

SEQ ID NO: 5812 - DNA, 477 bp, Artificial Sequence
  Description of Artificial Sequence: Synthetic coding sequence
atgtgttgcccaggagggcactacactctgatactccgacgcggcaacaggttccggcgagaaaaaaggccggctaaggtgactggtgcccaaaccgaggttcagcttgccccccccctcccccgggggagggccagacgctcgccatggtccgtaccaattagccttagtatagatcggctcgagttcgacttgctgtatccagctattaagggcgacacaatccagctctacttaggcgcgaagctgctcgatagccagggtaaagttacaaagtggtttaacaattccgccgcatcactcaccatgccgactctcgacaacatccctttcagcctcatcgtgtcgcaggatgttgtgaaagccgctgttgcggccgtgctttcacccgaggaattcatggtcctgctggattccgtgctgcctgagtccgcccacagattgaaatccagcattggactcattaacgagaagtag

SEQ ID NO: 5813 - DNA, 771 bp, Artificial Sequence
  Description of Artificial Sequence: Synthetic coding sequence
atgttccagacgggagggctgattgttttttacggactgcttgctcagaccatggcacagtttggcggactccctgtgcccctcgaccagactctgcctctcaatgttaaccctgctcttcccctgagccccacaggtctggccgggagcttgacgaatgcactcagcaatggtctcttaagcggcggattgttaggaattttggagaaccttcctctcctagacatattgaagccagggggaggtacgtctggggggctgctgggagggctccttgggaaagtgacttctgtcataccaggtctgaacaatatcatcgatatcaaagttacagacccccagttgctggagctaggactggtccagagtcctgacggccaccgcctctatgtcactatcccccttgggatcaaactgcaggtgaacacccccttggtgggggcatccctacttcggctcgccgtgaagttggatatcacagccgaaattctggcagtccgtgacaagcaggaaaggatccacttggtcttaggggactgtacgcattcccctggatctctgcagatctctcttcttgacggcctaggacctctgcccattcaggggctactcgatagtcttactggcatcctcaataaggtcctgccagagctggtgcaagggaatgtgtgccctctggttaatgaagtactgcgggggctagacattaccctggtgcatgatattgttaacatgttgatccacggcctgcagttcgtcatcaaggtttag

SEQ ID NO: 5814 - DNA, 771 bp, Artificial Sequence
  Description of Artificial Sequence: Synthetic coding sequence
atgtttcagaccggcggtctcatcgttttctatggactcttggcccaaacaatggcccaattcggcggacttcctgtacctctggaccagactcttcccctcaatgttaatcctgctttgcccctctcaccaacaggtttggcaggaagtctgaccaacgccctgtctaacggtttgctgtctggcgggctgcttggcatcctggaaaatctgccccttctagacattcttaagcctggaggaggaacatctggcggactcctcggggggcttctgggaaaggtaacctcggtcatcccgggcctgaataatattatagacataaaagttacggatccgcagcttctggagttgggtctcgtgcagagccccgatgggcaccgcctgtatgtaacaatccccctggggatcaaactgcaggtgaatacacctttggtcggggcatcacttttaaggcttgctgttaagcttgatattaccgccgaaattttggcagtcagagacaagcaggaacgaattcacctggtgctgggagattgtacacacagcccaggcagcctccagatttcattgttagacggcctcggcccactgccaatccagggtctcctggattccttgacaggcatcctcaataaggtcttgccagagctggtacagggcaacgtgtgcccccttgtcaatgaggttctcagggggctcgatattaccctcgtgcacgacattgtgaacatgctgatccacggactgcagttcgtgattaaagtttag

SEQ ID NO: 5815 - DNA, 657 bp, Artificial Sequence
  Description of Artificial Sequence: Synthetic coding sequence
atgatgtgtcctctttggcgtctgctcatttttttggggctcctggccttgcccctggcgcctcacaaacagccttggcctggcttagctcaggcccaccgtgataacaagtctacactcgctcgaatcattgctcaggggctcataaagcacaacgcagagtcgagaattcagaatattcactttggggacagactgaatgccagtgctcaggtggcccccgggctcgtaggatggctcatctcgggccgcaagcaccagcaacagcaggagagtaggagtttcgacaacaacatcgttaaaatgtgcgcgcatatgtcgatcgttgtcgaattttggctggaaaaggacgagtttggacggcgagacctcgtcatcgggaagtgtgacgccgaaccatcatctgtgcacgtggcaatacttaccgaagcgatacctccaaagatgaatcaatttctctacaatcttaaggagaaccttcaaaaggtactccctcatatggtagagagccaggtgtgtcccctgatcggggagatcctgggccagcttgacgtcaagcttctgaaaagcctcatagagcaggaagctgctcacgaacctactcaccacgaaactagccagccttcagcgtgtcaggcaggcgaatccccttcttag

SEQ ID NO: 5816 - DNA, 765 bp, Artificial Sequence
  Description of Artificial Sequence: Synthetic coding sequence
atgatgtgcccactctggcgactgctgattttcctggggctgctagccctgccgctagccccacacaaacagccttggcctggcttggctcaggcccatagggacaacaagagtacactggctcgcattattgctcagggtctcattaaacacaacgccgagtccaggatccagaacatccatttcggggacaggctgaacgcctctgcacaggtggcaccaggtcttgttgggtggttgataagtgggcgcaagcaccaacagcagcaggagtccagcatcaacatcactaacattcagctcgactgtggcggcattcaaatctccttccacaaagagtggttctcagccaacatcagcctggaatttgacctggaactgcgcccgtcttttgataacaacattgtcaagatgtgcgctcacatgagcatagtggtggagttctggctggaaaaagatgagtttgggcgtagggatctggttattgggaaatgtgatgccgagccatcatccgtgcacgtagctatacttaccgaggcaatccctcctaaaatgaaccaatttctctacaacctgaaagaaaatctgcagaaggtgctgccccacatggtcgagagtcaggtctgcccgctcattggagagatccttgggcagctagatgtcaaacttctcaagtccctcattgagcaggaagcagcccatgaacccacccaccacgagacttcccagccgtccgcctgccaagccggagagagtccgagttag

SEQ ID NO: 5817 - DNA, 1635 bp, Artificial Sequence
  Description of Artificial Sequence: Synthetic coding sequence
atgaagatatctatgatcaactacaagagccttctggccttactgttcatcctcgccagctggatcatcttcaccgtcttccagaattcgacaaaggtttggtcagctctcaacttaagcatttctctccattactggaataactccacgaaatctctcttccctaaaacccctctgataagtctgaaaccactcaccgaaacagaactgagaattaaggagattatcgaaaaactagaccagcagatcccgccacggccgtttacgcatgtgaacaccacaacttccgctactcattctaccgcaacaatcctaaatccaagagacacgtattgtaggggggaccagctgcatatcctccttgaggtgagagatcacctcggtagaaggaagcagtatgggggcgacttcctgcgcgcccgcatgagctccccagcactgatggccggagcaagcgggaaggtgaccgacttcaataatggaacctatctggtgtctttcacactgttctgggaaggccaagtatccttgtctctgctgctcattcacccctcagaaggagttagcgccctgtggtcagcacggaaccagggctatgaccgagtgatcttcacgggtcaatttgtcaatgggacaagccaggttcacagcgagtgcggcctgatcctgaatactaatgctgagctatgccagtacctggacaaccgagaccaggagggattctactgtgtgcggcctcagcatatgccgtgcgcagccctcacacacatgtactcaaaaaacaagaaagtttcctacttatctaaacaggagaagtctctattcgaaagatccaatgtcggtgttgagataatggaaaaatttaacacaataagcgtgtctaagtgcaacaaggagaccgttgccatgaaagagaaatgtaagttcggcatgacctcgacgattccttctggtcatgtctggagaaacacatggaatccagtgtcttgctcactagcgacagtgaaaatgaaggagtgcctccggggcaagctgatttatcttatgggcgattcaaccatacggcaatggatggaatatttcaaagcttcaattaacacactgaagagtgttgatctccatgaatccgggaagctgcagcaccaacttgctgtcgatcttgaccgtaatataaatatacaatggcaaaaatattgctatcctctgatcggaagcatgacatactctgtgaaggaaatggaatatctgacccgggccatcgaccggactggtggggagaagaataccgtgatagttatatctctgggacagcacttccgcccattccccatcgatgttttcatcaggcgagcccttaacgtacacaaggctatccagcaccttctgctgcggtctcccgacaccatggtcattatcaaaaccgaaaacattcgggaaatgtataatgacgcggagcgattttctgattttcacggctacatacaatacctcatcatcaaagacatctttcaggatctttcggtctccatcattgacgcttgggatatcactattgcgtatggtactaacaatgttcaccctccccagcatgtggtaggtaaccaaattaacatcttgcttaattacatttgctag

SEQ ID NO: 5818 - DNA, 1845 bp, Artificial Sequence
  Description of Artificial Sequence: Synthetic coding sequence
atgtggatggcttggtgtgtggccgcactaagtgtcgtcgcagtctgtggcactagccacgaaactaatacagtgcttagagtcactaaagatgtgctgtcaaacgctattagcggcatgctgcagcagtccgacgctctacattcagctttgagggaagttccactcggagtgggcgatattccatacaatgattttcacgttcgcggccctccacccgtgtacacaaacggtaagaagttggacggcatttatcagtacgggcacattgagaccaacgacaatacagctcaactggggggcaagtacaggtacggagagatcctcgagtctgaaggttctatccgggatcttcggaactcaggctatcgctccgctgagaacgcatatgggggccaccggggacttggcagataccgcgccgcgccggtgggccgactccaccgaagagagttacaaccgggcgaaattccaccgggcgtggccaccggtgccgtgggtccgggcgggctgctaggtaccggcgggatgctggccgctgatggtatattggccggccaggggggactgctgggcggagggggcctgctgggcgacggaggacttctcgggggaggtggtgtcttgggagtacttggagaaggaggtatcctgtctactgtgcagggtatcactggactgcggattgtcgaactgaccctgcctcgcgtcagcgtgagattacttcctggagtcggggtgtacctgtcactttacacaagggtcgcaattaatggaaaatcattgatcggcttcctcgatattgcagtggaggtcaacattacggcaaaggttcggttgactatggaccgcactggctacccgcggcttgtgatcgagcgttgcgacactctcctgggaggcattaaagttaaactcctccggggcctgctgcccaacctggtcgacaatctggtgaatagagtgttagcagatgtgctaccagatctcctctgtcctatcgtggatgtggtactggggctggtcaatgatcagttgggcttggtggacagtcttataccacttgggatcctgggctcagtccagtataccttttcctccctgccactcgtaaccggcgaattcctcgagctcgatctcaatacacttgtgggggaggccggaggcgggcttatagattacccccttgggtggcccgcagtgtcgccaaagccgatgccagagcttcccccgatgggtgacaatacaaaatcacagctcgccatgtccgctaatttcctggggagtgttttgacgctgttacaaaaacagcacgccctcgacttggatataactaacggcatgttcgaggaacttccccccctgaccaccgccaccctcggcgcactaattcccaaggtattccaacagtatcctgaatcctgcccccttatcattcgcatacaggtgctcaatccacccagcgtcatgttacagaaggataaagcgctggtaaaagttttggccaccgctgaagtgatggtctctcagcccaaggacctagaaaccacgatatgcttgattgacgtggacacagagttcctggcaagcttttctacggagggcgacaagctgatgattgacgccaagctcgaaaagacttctctcaatttgcgaacgagcaacgtggggaattttgatataggtttgatggaggtgctcgtggagaagatcttcgacctggcattcatgcccgcaatgaatgcagtattgggttctggggtgcctctgcctaaaatcctcaatatcgattttagcaatgcagatattgatgtcctcgaagacttgctggtactgagcgcttag

SEQ ID NO: 5819 - DNA, 1431 bp, Artificial Sequence
  Description of Artificial Sequence: Synthetic coding sequence
atgcagccagtcatgctggcgctgtggtccttacttctgctctggggattggccactccttgtcaggaacttctggaaacagttggtaccctagcccggattgataaggacgagttagggaaagcaatccagaattcattggtgggggagccaattctgcagaacgttttaggctcggtgacggccgtgaatagaggcctgttgggctctggcgggctattaggcggcggtggccttctaggacatggaggtgtgtttggcgtagtggaggagctttctgggctgaaaatcgaagaactaacactccccaaggtactgcttaaactgctcccaggattcggggtgcagttatctcttcacaccaaggtggggatgcattgctcagggcctcttggggggctccttcaactcgctgccgaggtcaacgtgacaagtcgggtcgctctggcagtctcctctcgtggaacccctatattaattctgaagcgatgtagcacactgcttggccatattagtctatttagtgggctgctgccaaccccattattcggtgtagtagaacaaatgctgtttaaggtgctgcccggactcctgtgtcctgtagtagactcagtcctaggcgtagtgaacgagttgctgggcgctgtgctcgggctcgtcagcctcggcgccctcggctctgtcgaattctcactcgcaactttgcccttaatttccaaccagtacatcgaactcgacatcaatcctatcgtcaagtccgtcgcaggagacattattgactttcccaagagcagggcccctgctaaggtcccgcccaaaaaggaccacaccagtcaggtgatggtgccactttatttgtttaataccacctttggacttctgcagaccaacggagcccttgatatggatatcacccccgagctcgtgccctccgacgtgcctctcaccaccactgacctggcagcgctgctgccagaggcccttggaaaactgcccctgcatcagcagcttcttctgttcctgcgcgtacgcgaggctcccactgtcacactgcacaacaaaaaggcacttgtgtcattacccgctaacattcacgtgctgttttatgtgcctaaaggaacacccgagtcactgtttgaactgaatagtgtcatgaccgtccgcgcccagcttgcaccttccgccaccaaattgcatatctccctttcacttgagagactctctgtgaaagtcgcaagctccttcacacacgcctttgacgggagccgcctcgaggagtggctgtcacacgtagtcggggcggtgtacgcacccaagctgaacgtcgccctggacgtaggcattccactgccaaaggttctgaacattaactttagcaattcggtcctggagattgtcgagaatgccgtagtcctgacagtggccagttag

SEQ ID NO: 5820 - DNA, 585 bp, Artificial Sequence
  Description of Artificial Sequence: Synthetic coding sequence
atgcaggatgcccctcttagctgtttatcaccaacaaaatggagttcggtgtctagtgccgactccaccgaaaagagcgcctccggggctggaaccagaaacctgcccttccagttctgtctgcggcaggctctgaggatgaaagcggcgggaattcttactctgatcggatgtctggtgacaggagcagagtccaagatctatactagatgcaagctggcaaagattttttccagggccggtttagacaactattggggttttagtctggggaattggatctgcatggcttactacgagtctgggtataataccacggctcaaacagtgttggatgatggatccatcgattatggcatcttccagatcaattcctttgcgtggtgccgaaggggtaagctgaaggagaataatcactgccatgtggcttgttcagctctcattaccgatgacttgacggacgccatcatctgtgcaaggaagattgttaaggaaactcagggcatgaactattggcaggggtggaagaaacactgtgaaggccgcgatctgtccgagtggaagaagggatgcgaggtgagttag

SEQ ID NO: 5821 - DNA, 1266 bp, Artificial Sequence
  Description of Artificial Sequence: Synthetic coding sequence
atgggttttctgtctccgatctatgtaattttcttctttttcggagttaaggtacattgtcagtacgagacgtatcagtgggacgaagattacgaccaggaacctgacgacgattatcagactgggtttcctttccgccagaatgtggattacggcgtgccattccaccagtacacactaggatgtgtgtccgagtgcttttgccctaccaattttccatcctccatgtactgtgacaatagaaaactgaagacaatcccaaatatcccgatgcacatccaacagctctatctccagttcaacgagattgaagctgttaccgccaattctttcataaacgccacacacctcaaagaaataaacctttcgcacaataagatcaagtcacagaagattgactacggtgtgttcgcgaagctgcccaatttgctacagctacatttggagcataacaatctcgaggagttccctttccccctacctaagagcctggaaagacttcttttgggttataacgaaatcagcaagttacagaccaacgcgatggacgggttggtgaacctgaccatgttggatctctgttacaactatctccatgatagcctgctgaaagataagatattcgcgaagatggaaaagttaatgcaactgaatctgtgcagtaatcggcttgaatcaatgcctcccggtctaccctcttctctgatgtacttatccttggagaataactctatcagcagcatacctgagaaatactttgacaaactccccaagcttcatactctccggatgtcccacaacaaattgcaagacataccgtataatattttcaacttaccgaacatcgtcgaactaagcgtggggcacaataaacttaagcaggctttttacattccacgcaacctcgagcacctatatctacagaataacgaaatcgagaaaatgaacttgaccgtgatgtgcccctccattgacccactgcactaccatcacctgacctatatcagggtggaccaaaataagctgaaggaaccgatttccagctatatattcttttgttttccacatatacacacaatatactatggagagcaacgctctactaatggacagaccattcagctcaaaacacaggtcttcaggagatttcctgacgacgatgacgagtcagaggatcacgacgatccagacaacgcccatgagtcacctgaacaggagggcgccgaggggcatttcgacctgcactattacgagaaccaggagtag

SEQ ID NO: 5822 - DNA, 252 bp, Artificial Sequence
  Description of Artificial Sequence: Synthetic coding sequence
atgctctgttgttgtccccttgctgacgctttgctgatttttctagaaacaggaagctgctttcagcccggccagcagtctgagaccctgtcgcagaaacagaacaagaccaataataagaagtgggcaggcggcgccggatgtcggccattccgcctatggtgggtggggcgtagcaggggggcaggggtccagctttactcaactaagaaaggatggattttacggggaaaaggagggacggaagcctag

SEQ ID NO: 5823 - DNA, 2559 bp, Artificial Sequence
  Description of Artificial Sequence: Synthetic coding sequence
atgctccccactgaagtgccccagtctcacccaggtccatcagccttgctcctgctccagcttctgctgccgccaacatccgccttctttccaaatatttggagcctgctagccgctcctgggtcaattacccatcaggacctgacagaggaggctgcactgaatgtgacactgcagctatttctggagcagcctcctccggggcgaccccctctgagactggaagactttctgggccgcacactgcttgctgatgatttgtttgccgcttactttggaccaggctctagtcgaaggtttagagcagctctgggcgaagtgtcccgcgccaatgcagctcaggactttttgcctacctccagaaatgaccccgacctacacttcgacgcagaacggctcgggcaagggcgcgcacgcctggtaggggcgcttcgtgagacagtggtggccgctcgcgcactggatcacacgttagctcgccagcgccttggggccgctttgcatgcgttgcaggacttctacagccactcaaactgggtggaactgggggaacagcagcctcatcctcacctcctgtggcctcgacaggaattacagaacctagcgcaagtcgctgaccctacctgcagcgattgtgaggagctcagctgtccgcgtaattggctgggtttcacattgctgacctctgggtattttggaactcaccctccaaagcctcctggcaaatgttcccatggaggccactttgaccgatcaagctcccagcctcctcgcggcggaataaacaaggattccacgtcaccaggcttctccccccaccatatgctacacctgcaggctgctaagctcgcactcctcgctagtatccaggcttttagcctgctgcgctcgaggctcggcgatcgggactttagtcgtctcctggacattacacccgcctctagtctttcttttgtcctggataccactggctccatgggagaagagatcaacgccgccaagatccaggcacggcacttggtggaacagcgccggggctctcctatggagcctgtgcattatgtgctcgtacccttccatgatcctgggtttggacccgtgttcaccacatctgaccccgattcattctggcaacagctcaacgagatccacgccctgggtggaggcgatgaacctgaaatgtgcctctctgctctgcaactggcacttctgcatacacctcccctctctgatatattcgtgtttactgatgcctctccaaaggacgctttccttacaaatcaggtggagtccttgactcaggagcggcgctgtagggtcacatttttggtgacagaggatacaagccgcgtgcaaggaagagctaggcgagagatcctgagccccttgagattcgaaccttataaagctgtggccctcgcctcaggcggagaagtgatttttaccaaagaccaacatatccgcgacgtggcggccattgtgggagagagcatggccgccctagtaaccctgccgctagatccacctgtagtcgtgccaggccaacctttggtgttctctgttgacgggctgctgcagaaaatcacagttagaattcacggcgacatttcttctttttggatcaaaaaccctgcaggggtttcacagggtcaggaggaaggtggtggacccctgggtcacacacgtcgtttcggccaattttggatggtgactatggacgatcctccgcagactggaacctgggaaatccaagtgacagccgaggacaccccaggcgtgagagtccaggctcagacaagcctggatttcctttttcacttcgggattcctatggaggacggtcctcatcctgggctttatccgctgactcagcctgtggcagggctacagacccaattacttgtcgaggttacgggcctgggctccagggccaaccccggggacccacagccacacttcagccacgtgatcctaagaggggttcccgagggggcagagttgggacaggtcccgctggaacctgtgggcccacccgagcgcgggctcttagcagcaagccttagccccactcttctgtctacaccccggccatttagcttggagctcatagggcaggacgcagccggccgcagactgcacagagccgctcctcaaccatcgacggtagtgcccgttctcttggagctttcaggccctagtgggtttctggctcccggttcaaaagtgccactttctcttcgtattgctagtttcagcggcccgcaggatctcgacctccggacgtttgtaaatcccagcttctcactgacaagtaatctatcccgggcccacctggagctaaatgaatccgcttggggtaggttgtggctggaggtgcccgatagtgccgcgcctgattcagttgtcatggttactgtcactgccggaggcagagaagcaaaccctgtgccacctacacacgctttccttaggttgctggtgtccgcccccgccccacaagtgaggaatcattactttccctcccagggccccgctcatcacccctataggctgatctag

SEQ ID NO: 5824 - DNA, 2676 bp, Artificial Sequence
  Description of Artificial Sequence: Synthetic coding sequence
atgctgccaacagaagtgccccagagtcaccccggcccaagcgccctcctccttctgcagttgcttctgcctcccacctccgccttcttccccaatatctggtctctactggcagcccccggatccattacacaccaagaccttacagaggaggcagccctcaatgtcaccttgcagctgtttcttgaacaaccccctccaggaagacctcccctgcgtctcgaagactttctaggacggaccctactggctgatgatctgttcgccgcctattttggccccggcagctctaggagattccgtgctgctctgggagaggtgagcagggctaacgccgcgcaggattttctccccacatctcgcaatgatcccgatctccattttgacgccgaaaggcttggacaaggccgcgcccgattggttggagccttgcgagaaacggtggtagccgcacgggctttagatcacacactggcacgccagagattgggtgccgccttacacgccttacaggacttctactcacatagcaattgggttgagctcggcgagcaacaaccccacccgcaccttctgtggccccggcaggaattacaaaacctcgcccaggtcgcggacccgacctgttccgattgcgaggagctgtcgtgtccccgaaactggttgggatttactctccttaccagcggctattttgggacccatccccctaaacctccagggaaatgttcgcacgggggacactttgatcgcagcagctcccaaccacctcgaggggggattaataaggacagcacctcacccggattcagccctcatcacatgctgcacttgcaggccgccaaacttgccctccttgcctcaatccaagccttctcgttactcaggtcaagactcggcgaccgagattttagccggctgttggacattacacccgctagctctctgtctttcgtgctcgatactactggaagcatgggggaggagatcaacgcagctaaaattcaggccaggcatttggtagaacaacgtagggggtcgccaatggaacctgtgcactacgtgctggttccgttccacgatcccggattcgggccggtgtttaccacctcagatcccgacagtttctggcagcagctgaatgagattcacgcactgggtggcggagacgagccagaaatgtgccttagtgctttgcaactggccttgctccacaccccacctctgtcggacatcttcgtgttcacagatgcaagtcctaaagatgcatttctgaccaaccaagttgaatcactgacccaggagaggcgttgccgggtaaccttcctagtgaccgaggacacctctcgagtgcaggggcgagcccgacgcgagattctgtctccgctgcgtttcgagccatacaaggccgtggccttagctagcggtggtgaggtaattttcactaaagaccagcatatacgagacgtggccgccatagtgggcgaaagtatggccgccctcgtcactctcccgctcgacccccctgttgtcgtccctggccaaccccttgtattctccgtcgacggcctcttacagaagatcactgttcgcatccacggtgatatctccagcttttggatcaagaaccccgcgggggtgtctcaaggccaggaagagggaggcggccccctgggccacactagacggtttgggcagttttggatggtaaccatggatgatccacctcagacaggcacctgggagatccaagtgaccgcggaggatacccccggggtacgtgttcaggctcagacgtctttggattttcttttccacttcggaattccaatggaagacggcccacaccccggtctgtatcctctaacgcaacctgttgcgggcctccagacacagctgttagttgaagtaaccggactgggctctagggccaatccaggggatcctcagccacacttctcacacgtcatcctaagaggcgttcccgaaggggctgagctcgggcaggtgccacttgaaccagtgggccctccagagcgggggcttttggcagcctcactttcccccacattgctgtctactccccggcccttctccctcgagctgatcggtcaagatgctgctggccgacggctccaccgcgccgccccacaaccttccacggtcgtccctgtcctgctcgagctctccgggccctctgggttcctggcccccgggagcaaggtaccactttccttgagaattgcaagtttctccgggcctcaagaccttgacctcaggacgtttgtgaatccatcgttcagccttacttctaatcttagccgcgctcacttggagcttaatgagtccgcatgggggaggctatggctcgaggttcctgacagcgccgcccccgatagcgtagtcatggtgacagttaccgctggcgggagggaagcaaatcccgtccctcccacccatgcatttctgcgtctgctggtttccgcaccagcaccacaagataggcacacaacacccaccgggtcgtccgaccccatactcacaaccgcaacccctgccttttctccgttcacattggtgacacagggacgggccggcgctgggctagctgcagggagcccctggtggggcaccgtgggtggagttctgctcctgctgggactggcatcctggtag

SEQ ID NO: 5825 - DNA, 552 bp, Artificial Sequence
  Description of Artificial Sequence: Synthetic coding sequence
atggttcgaatctggactacaataatgatcgtgttaattctgctgctgaggataggccctaataagccttcactctccggcagacaggctcctgcacaggctcagaccagcgacctcgtgcctagtctgtttcccctcggtttgtgggcacccggcttctgtacctggtcttctcctgatgaggataaaagacccaggaaaccagtcccaggaactggcaacagggattctggtactagacggcgactgcaagatgccacagagcaggatccaagacccgggaacgatgttgctagcgcagaaacagcgggcccgccttcacctagcggtatacgcgctcaggacagggcacccaggcaccgtcgtgcaccccctgcccgaatgcccgtcgcccccgctccaagcgcagatggagaaccactgcaggaacagggcggagggcttttccacaggacacgcagtgtctataatggactcgagttaaacacctggatgaaggtggagcgcctatttgttgaaaaatttcatcagtcctttagtttagataattag

SEQ ID NO: 5826 - DNA, 444 bp, Artificial Sequence
  Description of Artificial Sequence: Synthetic coding sequence
atggcaggccccgccggctctcagtctctgggccccttgtgcttccactcctccccacaggctctgtacacagtgctgctaattgtgctggttatgatgtcactcgttttcggcaaattcgtgccggtgaattgggagccaccacagccgttgccatttcccaaatatctgaggtgctataggtgcctgttggagactaaggagctgggctgcctcctggggtccgacatctgtctgacacctgcaggaagctcttgcatcaccttacataagaagaactctagcggcagcgacgtgatggtgtcagactgccggtctaaagagcagatgtctgactgttccaatacgagaacttcaccggtatcgggtttttggattttctcgcaatactgctttttggacttttgcaacgatccacagaaccgaggcctgtataccccatag

SEQ ID NO: 5827 - DNA, 447 bp, Artificial Sequence
  Description of Artificial Sequence: Synthetic coding sequence
atgcagacgtttccagttgcaggagccttggaccctgctatcctggacaccagcagtccccaagccctctacaccgtactgctcatagtgttggtgatgatgtcattagtcttcggaaagtttgtgcctgtgaactgggaaccaccccagcccctaccattccccaaatatctgcgatgttataggtgtctgctggagactaaagaactgggctgcctgctgggatccgacatctgtctaacccctgccggatcctcctgtattactcttcataaaaaaaactccagtggctccgatgttatggtgtcagactgccggtccaaggaacaaatgtctgactgctctaatacccgaacaagcccagtcagcggattttggatcttctcccagtattgctttctcgatttctgtaacgatccacagaaccgcggcctgtataccccttag

SEQ ID NO: 5828 - DNA, 606 bp, Artificial Sequence
  Description of Artificial Sequence: Synthetic coding sequence
atgaaagttcacatgctggtaggcgtactggtgatggtgggttttactgtgggaaaggtgcctgtgccagatatcaggacatgccacttttgcctggtggaggatccatctgtcggatgtatttctgggtctgaaaaatgtaccataagcagctcgagtttatgcatggtgattaccatttattacgacgtgaaggtgcgattcattgtacgggggtgcgggcagtacatcagctaccgttgtcaagagaagcggaatacgtacttcgctgagtattggtaccaggctcaatgttgccagtatgattactgtaacagttggagttcaccacaactacagtccagcctccctgagccacacgaccggcccctggcactgccactgtcagactcccagatccagtggttctatcaggccctgaatctgtccctcccactccccaacttccacgcggggacagagccagacggtttagacccaatggtgacattgagtcttaatctgggcctgagtttcgcagagctccggcggatgtacctgttccttaacagctccggcttgctggtactccctcaagctggcctgctcacaccacaccctagttag

SEQ ID NO: 5829 - DNA, 345 bp, Artificial Sequence
  Description of Artificial Sequence: Synthetic coding sequence
atgctaggcggcgaagaggctcgcccaaactcttggccctggcaggtgtcgcttcagtatagttccaatggtcaatggtatcacacttgtggtggaagcctgattgcaaatagctgggtgctgacagcggcacattgcattcggcagattatcaaagcccacaaggtgctgcaacggtgtagcctgatattgttcttcgtgcgcgacttatgttctagtcaattagaactgacaggcgtgagtgcaggcagcagcggaatttaccgcgttatgctggggcagcacaatctctatgtagctgagagcggttcactagctgtgagcgttagcaagatcgtagtgtag

SEQ ID NO: 5830 - DNA, 810 bp, Artificial Sequence
  Description of Artificial Sequence: Synthetic coding sequence
atgatacgtactttattgctttctacactggtggctggcgcactgtcgtgcggggtaagcacctacgcccctgatatgtcacggatgcttggcggggaggaggctcggcctaactcatggccatggcaagtgtccctccaatactcttcaaacggacagtggtaccacacctgcggtgggtctctgattgcaaactcctgggtcttgactgcggcacattgcatttcatcttccggaatatacagagtcatgttaggacagcacaacctctatgtcgctgaatcaggttcacttgccgtgagtgtgtctaaaattgtcgtgcataaagattggaacagtgaccaggttagcaaggggaatgatattgcgttacttaagctggctaatccagttagcctgactgataaaattcaactcgcttgcctgcctccagctggcactattctgccaaataactacccctgttatgtcaccggctggggccgccttcagactaatggggccttgccagacgatctgaagcaaggacagctgttggtggttgattacgcaacgtgttcttcatctgggtggtggggtagcacagtcaaaacaaacatgatatgtgcagggggagacggtgttatctgtacgtgcaatggcgattcaggtggccctttgaattgccaggcaagcgacggaaggtgggaagtacacggaattgggagcctcacttcagtactggggtgcaactactactacaagccctccatttttactcgggtgagcaattataatgattggatcaactctgtaatcgccaacaactag

SEQ ID NO: 5831 - DNA, 567 bp, Artificial Sequence
  Description of Artificial Sequence: Synthetic coding sequence
atgttccatcaaatatgggcagcattgttatacttctacggtatcatcctgaacagcatttaccagtgtcccgagcactctcaactgaccactttgggcgttgatggaaaggagtttcctgaggtccatctgggtcagtggtactttatcgcaggcgcggcccccactaaagaagaactggcaacattcgatcctgttgacaacatcgtcttcaacatggcagccggcagcgcccctatgcagttgcacctccgggccacaattcgaatgaaggacggactctgtgtgccacggaagtggatctaccacctgaccgaaggtagcaccgatttaaggacagagggtaggccagatatgaaaacagaactgttttcatccagctgtccgggcgggataatgctgaacgaaaccgggcagggctatcagaggttcttgctgtataacagaagtccccaccccccagagaaatgcgttgaagagtttaaatcccttacatcctgcctggattctaaagcctttctgctcacacctagaaatcaggaagcctgcgaactaagcaataactag

SEQ ID NO: 5832 - DNA, 390 bp, Artificial Sequence
  Description of Artificial Sequence: Synthetic coding sequence
atggctgctggctctgcacccatgcagctacatctgagggctactatccgaatgaaagatggcctttgcgtcccccgcaaatggatctatcacctgacggagggctcgaccgacttacgaactgaaggcaggccagacatgaaaaccgaattgttcagttcctcctgtccaggcgggatcatgctcaatgaaaccggtcagggataccagcggtttttgctatacaatagaagtcctcacccccctgaaaaatgcgtggaggagttcaaatccctgacttcttgcctggattccaaagctttcttgttaacaccgagaaatcagggaaaaggcttgaagtctcacaaaactgggctcgggttgactaagagcagcggagtcacgggttag

SEQ ID NO: 5833 - DNA, 351 bp, Artificial Sequence
  Description of Artificial Sequence: Synthetic coding sequence
atggccgcaggctcggctccaatgcagctgcacctgagggccaccatccgtatgaaggacggactatgcgtacccaggaaatggatctatcacttgacagaagggtccaccgatctccggaccgagggccggccagatatgaaaactgagctcttctcctctagttgtccaggagggataatgttgaacgagaccggacagggctatcaacgctttttactgtataaccggagtccacaccctcctgagaaatgcgtggaggagtttaaatccctcacaagctgcctcgattctaaggcgtttctgctgactccccgcaatcaggaagcatgtgagctgtccaataattag

SEQ ID NO: 5834 - DNA, 435 bp, Artificial Sequence
  Description of Artificial Sequence: Synthetic coding sequence
atgatccggacgcttctcttgtctacacttgtggcaggcgcattgtcttgtggggatcctacctacccaccatatgttactagggtcgtgggaggcgaagaggcccgtccgaattcttggccctggcaggtgtctctgcaatattcttcgaacggaaaatggtatcacacatgcggtgggtccttaatagctaactcttgggttttaaccgctgcccattgtatttctcagagtatggtgcagtgcgcgcacaaagtgctgcagagatgctcgctcatactatttttcgtcagagatctgtgttcctcccagctggagctgactggggtttctgcagggagctctcgaacttaccgagttggcctcggacggcacaacttgtacgtcgcggagtcgggcagtttggcagtttccgtatctaagattgtcgtgtag

SEQ ID NO: 5835 - DNA, 204 bp, Artificial Sequence
  Description of Artificial Sequence: Synthetic coding sequence
atgaagctcctgctgctgacattaacagtgctccttctgttgtctcaactcactcccggtggcacccagcgctgctggaacctatatggaaaatgcaggtaccggtgtagtaaaaaggagcgggtgtacgtgtactgcataaacaacaaaatgtgttgtgtgaagcccaaataccagcctaaggagcgttggtggcccttctag

SEQ ID NO: 5836 - DNA, 231 bp, Artificial Sequence
  Description of Artificial Sequence: Synthetic coding sequence
atgaagttgttgttactgctcctgacagtaaccctgctgctggctcaggttaccccagtgatgaaatgctggggtaagagcggtcgctgccgcacaacatgcaaggaatccgaggtctactacattctgtgcaaaactgaggctaaatgctgtgtggatccaaaatacgtgcctgtaaagccaaagctaaccgacaccaacacaagcctcgagtctacttccgcagtatag

SEQ ID NO: 5837 - DNA, 267 bp, Artificial Sequence
  Description of Artificial Sequence: Synthetic coding sequence
atgaaactcctgtacctcttcctggccatcctgctggctattgaggagccggtgataagtgtggaatgctggatggatggccattgcaggctactctgcaaggatggagaggacagcattatacgttgtcggaacagaaaaaggtgctgtgtgccctcccgttacctgactatccagcccgtgacgattcacgggatcctgggatggactactccccagatgagtacaaccgcgcccaagatgaaaaccaacatcaccaaccggtag

SEQ ID NO: 5838 - DNA, 255 bp, Artificial Sequence
  Description of Artificial Sequence: Synthetic coding sequence
atgaaactgctatacctttttctggccattctgctggctatagaggagcccgtcatttccggaaaaagacatattctgcggtgcatgggaaactctggcatttgcagagcatcctgcaagaaaaatgagcagccctacttgtattgccgaaattgccaatcctgttgcctgcaatcctatatgaggataagcatttccggcaaggaggagaacactgactggtcttacgagaagcagtggcccagactcccctag

SEQ ID NO: 5839 - DNA, 2631 bp, Artificial Sequence
  Description of Artificial Sequence: Synthetic coding sequence
atgggcccagaagctctgtcatctctgctcctccttctgctagtggccagtggggatgccgacatgaaaggacattttgatcccgcgaagtgcagatatgcgctaggaatgcaggacagaacaattccagactccgatatctccgcctccagtagctggtctgactctactgcagccagacattctcgcctggaaagtagcgacggcgatggcgcatggtgtcctgcgggctctgtgtttcccaaagaagaggaatatctgcaggtggatctgcaacggttacacttggtcgcactcgtcggaacacaagggcggcatgcggggggtttgggaaaggagttcagccgttcatacagactgcggtacagccgcgacggaaggaggtggatgggctggaaagataggtggggacaggaagttatctccggtaacgaagatccggaaggagtcgtgctcaaagacttggggccgcctatggtcgcccggctcgtccgcttctacccccgggccgaccgggtcatgagcgtttgtctgcgcgtcgagttatacggttgtttgtggcgtgacggcctgctttcttatactgcccctgttgggcagaccatgtatctctctgaagctgtttatctgaacgactccacatatgatggacacactgtcggcggccttcaatacgggggcctcggccaactagctgacggcgtggtcggcttggacgatttcaggaagagtcaggagctgcgcgtttggccaggctacgattacgtgggctggtccaaccacagcttctcaagcggttacgtggagatggaattcgagtttgaccgcctccgcgccttccaggcgatgcaggtccactgtaacaatatgcatacattgggcgcacggctgcctggaggggtggaatgcaggtttaggcggggtccagcaatggcctgggaaggggaacccatgaggcacaatctcggcggcaatctcggggacccccgcgctagagctgtgtccgtgcccttgggcgggcgagttgcccgattcctccagtgtcgctttcttttcgccgggccatggttattgttcagcgaaattagcttcataagcgacgttgtgaacaatagctcaccggccctcggcggcacttttccacctgcaccttggtggccacctggtccccccccaacgaatttcagctccctggagctagagccccgcggccaacagcccgtcgccaaggctgaaggtagtccaaccgccattctcatagggtgcctggtcgctattattctgcttcttttgctgatcattgccttaatgttatggagattacactggcggcggttgctatccaaagcagaaagacgcgtcctcgaggaggagctgacggtgcacttgagtgttccgggtgatactatcttgattaataacagacccggcccccgagagcccccaccctatcaggagcctcggccaaggggcaatcctcctcattctgcaccttgcgtgcccaacggaagtgcttactctggagactacatggaacctgaaaaacctggggctcccctactgccaccgcccccccaaaacagtgtgcctcactatgcagaagcagacattgtgacattgcagggcgtgacaggcgggaacacctatgcggtgcctgcgctacctcctggggcagtcggagacggcccgcccagagtggactttcctagaagccggctaaggttcaaggagaagctcggagagggccagtttggagaggtgcacttatgtgaggttgacagtccgcaggatctcgtaagtctggacttcccccttaacgtaaggaaggggcaccccttgctggtcgcagttaagatcctgcgcccagacgccacaaaaaatgcccggaacgactttttgaaggaagtgaagattatgagcagactaaaagatcctaatattatccggctgctgggagtctgcgtacaagacgaccctttgtgtatgattacggattacatggagaacggcgatcttaaccagttcttatctgcgcaccaattggaggataaagccgccgaaggggcaccgggcgacggacaggcggctcaggggcccaccatttcataccccatgttactccatgtggcagcacagattgcctcgggcatgcggtacctcgcaacacttaactttgttcatcgtgacctcgctacacgaaattgcctggtgggcgagaatttcacgataaaaatcgcagattttggaatgtcccggaacctctacgccggcgactactacagagtgcagggccgcgcagtgttgccaattcgatggatggcttgggaatgcatcctcatgggaaaattcactaccgcttccgacgtttgggcctttggcgtgaccctttgggaagtgctgatgctgtgtcgggcccagccatttggtcaactcaccgatgagcaagtgatcgagaatgccggcgaatttttcagagatcagggcagacaggtatatctctcaaggcccccggcatgcccgcagggactctatgagctgatgctgcggtgttggagcagggagtctgagcaacgcccaccattcagccaattgcacaggttcctcgcagaagacgctttgaacacagtgtag

SEQ ID NO: 5840 - DNA, 2742 bp, Artificial Sequence
  Description of Artificial Sequence: Synthetic coding sequence
atgggacctgaggcactctcaagcctgctgctgttgttgctcgtggctagtggggacgctgatatgaagggccacttcgaccccgcgaagtgcaggtacgctctagggatgcaggaccgaaccatccctgactccgatatcagtgcttccagcagctggagcgactcgacggcggcccgccacagtcgcctagagagcagcgacggcgatggcgcctggtgccccgccggcagcgtgtttcccaaggaggaggagtatcttcaggtggacctgcagcggctgcacttggtggcgttggtgggcacacagggccgacacgccggtggattagggaaagagttctcgagatcttatcggctcaggtacagccgcgacggccggagatggatgggatggaaggaccgttggggtcaggaggttatctccgggaatgaggaccccgagggcgtcgtgttaaaggacttgggtcctccaatggtcgcgaggctagtcaggttttatccccgtgcagatcgggtaatgtccgtgtgcctgcgcgtcgaactctacggttgcttgtggcgagatgggctcttgagttacacagcacccgtcggtcagaccatgtatttaagcgaagcagtgtatctgaacgatagtacctatgacggccacacagtgggcgggctgcaatacggcggcctcggtcagcttgctgatggagtggtgggcctcgacgatttccgcaaatctcaggaactgcgagtgtggcccggttacgattacgtgggctggagcaatcatagtttttcatcgggatatgtcgaaatggagtttgagtttgatcgcttacgggcttttcaagctatgcaggtccattgcaacaatatgcataccctcggtgcaagattaccaggtggcgtcgagtgcagattcagaagaggccccgctatggcttgggagggggagccaatgaggcataatctgggcggaaacctgggggaccctagggctcgcgcagtatcggtccctctgggagggagagtagccaggtttctgcagtgccggtttctgtttgccggaccgtggctactgtttagcgagatctcttttatttcagatgttgttaataactcctcgccagcactcgggggcactttcccacccgccccttggtggccaccggggcccccccccactaatttttccagtctcgaactggagccacgtggccagcagcctgttgcgaaagctgaggggtcccctacggctatcttgattggctgtctggttgccattatcttgctgctgctgctgatcattgccctgatgttgtggagattacactggagaagactcttgtccaaggccgagcgccgcgtcttggaggaagaattaactgtccacctgtccgtgccaggggatactattcttatcaataatcggccaggacctcgcgaacctcctccgtaccaggagccacggccgagaggtaaccccccgcactccgctccatgtgtgccaaacgggagtgccctcctcctttctaacccggcctaccgcctactattagccacctacgcccgtcctcctagagggccagggcccccaactcccgcctgggccaagcccacaaatacgcaggcgtactccggggactacatggagcccgagaagcccggtgcaccattgctccctccacccccccagaactctgtgcctcattatgctgaggccgatatcgttacgctgcagggggtcacggggggaaacacttatgcagtacccgctctgccaccaggtgccgtcggagatggtccccctagggtggatttcccccggtctaggttgcggttcaaggagaagttgggggagggccaattcggggaggttcacctctgcgaggtggactctcctcaggatttggtaagcctggacttccccctgaatgtgcggaagggccaccctctactagtggccgtgaagatcctgagacctgacgccaccaaaaacgcccgaaacgatttccttaaggaagtgaaaatcatgtcacggcttaaggacccaaacatcattcgactgcttggcgtctgcgtccaggatgatccactgtgtatgataactgattatatggaaaacggtgacctcaaccagtttctgtccgcccaccaactggaagacaaggccgccgaaggagcccctggcgacgggcaggcagcacaaggacccacgatcagttaccccatgctgctgcacgttgcagcccagatcgcctcgggcatgaggtaccttgcaactctaaatttcgtgcacagagacttagccacgaggaattgtctggttggggagaactttacgatcaaaattgccgacttcggcatgtccagaaacctgtacgctggagactactaccgggttcaggggcgcgctgtgctcccaatccggtggatggcatgggaatgcatcctgatgggcaaattcactaccgccagcgatgtctgggcatttggggtgacactgtgggaggtactaatgctgtgtcgtgcacaaccgttcggccagttaacagatgaacaggtgattgaaaatgccggcgagttcttccgggaccagggtcgtcaggtttacttgagccgccctcccgcctgtccccagggactgtacgagcttatgctgagatgctggtctagagagagcgagcagagacctccattttcacagctgcacagatttctggcggaagacgcccttaataccgtatag

SEQ ID NO: 5841 - DNA, 2631 bp, Artificial Sequence
  Description of Artificial Sequence: Synthetic coding sequence
atgggaccagaggccctgtcctctctcttacttctactactcgtggcctcaggagacgcagatatgaagggtcatttcgaccccgctaagtgcaggtacgcattagggatgcaggacaggactattccagattcagatatctctgcctcatcctcctggtcagactcaaccgctgcgaggcattcgaggctggaaagcagcgatggcgacggggcttggtgtccagccggatctgttttcccaaaggaggaagagtaccttcaggttgatctgcagcggctccacttggttgctcttgtgggcacacagggtcgacatgctggcggcttgggaaaagagttcagccgttcctaccgccttcgatacagccgcgatgggcgcaggtggatggggtggaaggaccgctggggacaggaggttatctctggaaacgaagaccctgagggtgtggtgttgaaagaccttggtcctcctatggttgcccgcctggtgcggttctaccctagggctgaccgggtgatgtccgtctgcttacgggtcgaactatacgggtgtctgtggagagacggtctcctgagctacaccgcgcccgtcgggcagacaatgtacctcagtgaggctgtttatttgaatgactctacttacgatggtcacaccgtcggcggtctgcagtatgggggactcggacaactcgccgatggagttgtggggcttgacgacttcaggaagtcacaggagctaagggtctggcctgggtatgactacgtggggtggagcaatcattccttctccagtggttacgtggagatggagtttgagttcgacaggctccgcgcatttcaggccatgcaggtgcactgcaataatatgcacacactaggggctcgactgcccggaggggtggaatgtagatttcgaagagggccggctatggcttgggagggtgaaccaatgcgtcataacctgggtggcaacctgggtgatccacgtgcacgggccgtaagcgtgcctctcggtggccgcgtagccagatttctgcagtgcaggtttctgttcgccggcccctggttactgttcagtgagatctcattcatcagcgatgtagtcaacaacagctcccctgcccttggcggcacctttcccccagccccctggtggcccccaggaccccctcccacaaacttcagttccctagagcttgaaccccgcgggcaacaacccgtcgccaaagctgaagggtccccaaccgccattttgatagggtgcctggtggccattatactattgttattgctgatcatcgccttaatgctgtggaggctccattggagaaggctgctatcaaaggctgaacgcagggttttggaagaggaactgactgtgcacttgtccgtccctggggatactattctgattaataatcggcctggtccacgtgagccccctccgtaccaggagcctagaccgcgaggaaaccccccccacagtgcaccatgtgtgcccaacggcagtgcttacagtggagattatatggaacccgagaagcccggggcacccctgctccctccaccacctcagaattcagtgccgcactatgcggaagcagatatcgtaaccctccagggagtgaccgggggcaacacatatgcagtgcccgctctgccaccaggggccgttggagatggcccccctcgcgtggattttccacgctcccgacttcgtttcaaggaaaagctgggtgagggccagttcggagaggtgcacctgtgcgaggtggatagtccgcaagacctggtgtcgctggatttccccctgaatgtgcgcaaaggacaccccctcctagttgccgttaagatcttgcggcccgatgctactaagaacgcacgtaacgatttccttaaagaagtgaagatcatgtcaagacttaaagacccaaatataatccgcctcctaggcgtgtgcgttcaggacgatccactctgcatgatcaccgattacatggaaaatggagacctcaatcagtttctgagcgcacatcagcttgaggacaaagccgcagagggagcgcctggagatggacaggctgcccaaggtcccactatctcatacccaatgttattgcacgtcgccgcccagatcgccagtggtatgcgatacctggctacattgaactttgtgcaccgagatctggcgactaggaattgcctcgttggcgagaacttcaccatcaaaattgccgactttggcatgtctcgcaatctgtacgccggcgactactatcgcgtgcagggaagggctgtcctacccatccggtggatggcttgggaatgcattctgatgggaaagtttaccacagcctctgacgtttgggcttttggagtcactctctgggaggtgctcatgctgtgtcgcgctcagcccttcggtcagctaactgatgaacaggtaattgagaacgcaggcgagttcttccgggatcagggtagacaggtgtatctgagccgccctcccgcatgcccgcagggactgtatgaattaatgctccggtgttggtctcgggagagtgagcaacgccctcccttctcacagctgcacaggtttctcgccgaggatgccctcaatactgtgtag

SEQ ID NO: 5842 - DNA, 2631 bp, Artificial Sequence
  Description of Artificial Sequence: Synthetic coding sequence
atggggccggaagcattgagctccttacttctgctgctgctggtggccagtggagacgctgacatgaaagggcacttcgatcccgctaaatgtaggtatgcattggggatgcaggacagaacaattcccgactcagacatttcagctagttcctcctggagcgactccactgccgccagacacagccggcttgagtcatccgatggtgacggggcgtggtgtccagctgggtccgtttttcctaaggaagaagaatacctgcaggtggacttgcaacggttacacctggtcgcattggttgggactcagggaaggcatgcaggagggttaggaaaggagttttcaaggtcatatcggctcagatattctagagatggtcgcagatggatgggctggaaagatagatggggtcaggaggtgatctccggtaatgaggaccctgagggtgtggtcttgaaagatctcgggcctcctatggttgctcggctggtgcggttttatcctcgggccgatcgggtaatgtcagtgtgtctccgggttgagctctatggatgtctgtggcgggatggattactgtcctataccgcgccggtgggtcagaccatgtacctcagcgaggcagtttatcttaatgactcaacctacgacggccacaccgttggcggactgcagtatggagggttgggacagctggctgacggggttgtcgggttagacgatttccgcaagtcacaggaactccgcgtatggcccgggtacgactatgtcggctggtctaatcactctttctcatcgggttacgtcgaaatggaattcgaattcgaccggctgcgagccttccaggccatgcaggtccattgcaacaacatgcatactctgggcgccaggctccctggcggtgtggagtgtcgctttagacgggggcccgcaatggcctgggagggggaacccatgagacacaatctcggaggtaatttaggagaccctcgtgcaagggcggttagtgtgcctctgggcggtagagttgcccgctttctgcagtgcaggttcctgttcgcagggccttggttattgttctccgaaattagcttcatctctgatgtcgtgaataactccagtcctgctctgggcgggaccttccccccggctccctggtggccaccagggccgccgccaacaaacttcagcagcctcgaattggaacctaggggacaacaaccagtggctaaggcagagggaagccctacagccattctcatcggctgcctggtggcaattatcttgctcctcctgctgatcattgctctcatgctgtggcgcctgcattggaggcgtcttcttagcaaggctgaaagacgggtgctcgaagaggagttgacagtgcacttgtctgtgcccggggacacaattctcatcaataatagaccaggaccccgagaaccccctccttatcaggagccaagaccgagaggcaatccgccccattctgccccgtgcgtgcccaatggaagcgcctattccggcgattacatggaacccgagaaacctggagccccacttctgccacctcccccccagaatagcgtaccacactatgccgaggcagatattgtgacgctgcaaggcgtcactggaggcaacacttatgccgtgcccgcactgccccccggggctgtcggtgatggccccccccgtgtggattttcctaggagcaggctgaggttcaaggagaaactcggggagggccagtttggagaggttcacctatgcgaggtggacagtcctcaggatctagtaagcttggactttccattaaatgtgcgtaaaggacacccactgcttgtggccgtgaagatactcagacccgacgccaccaagaacgcacgaaatgatttcctgaaagaagtgaagatcatgtcccggttgaaggacccaaatataatcagactgctaggagtttgtgtccaggatgaccccttatgtatgatcaccgattacatggagaatggagaccttaatcagtttctgagcgcccaccagctggaggataaagcagcggagggggcccctggagatggacaggccgcacaggggcctactatctcttaccccatgctgctccacgtagccgcccagatagcctctgggatgcgatacctcgccactctcaattttgtgcaccgggatctggcaactaggaattgcctggtgggtgaaaacttcactattaagattgccgatttcgggatgagtaggaacctctacgcaggagactattacagagtgcaggggagggccgtgctgcccatcagatggatggcctgggaatgcattctaatggggaaatttacaacagcctctgatgtctgggccttcggagtgactctctgggaggtattgatgctttgtcgcgctcagcccttcggccagctgacggacgaacaggttattgaaaacgcaggggaattctttagggatcagggacgtcaagtatacctctcccggccccctgcctgcccccagggactttacgagcttatgcttagatgctggagccgagagagtgagcaaaggcccccgttttcccagcttcatagattcttagccgaggatgctctgaacacggtctag

SEQ ID NO: 5843 - DNA, 2760 bp, Artificial Sequence
  Description of Artificial Sequence: Synthetic coding sequence
atggggcccgaagccttgagtagcctcctgctgttgctgctggtcgcttctggggatgccgacatgaagggtcactttgatccggcaaaatgtaggtatgcgctcggtatgcaggaccgcacaattcctgattcagatatttcagcgtcatcctcatggtcagattccaccgctgcaaggcactcgagattggaatcatcagacggcgacggagcctggtgccccgcgggcagtgtattcccaaaagaggaggagtacttgcaggtcgacctccaacgcctgcaccttgtggctcttgtcggcacccaaggcaggcatgctggcggactggggaaggagttcagtcgcagttatcggctgagatacagccgcgacgggagacggtggatgggttggaaggaccgatggggccaggaagttattagtggaaacgaagaccccgaaggcgttgttttaaaggacctcgggcctcccatggtagcaaggctggtgagattctatccacgggcggacagggttatgtctgtgtgtctgagggtggagttatatggatgcctctggcgcgacggactgctgtcttatacggcccctgtggggcagaccatgtatctctcggaagccgtgtatctcaacgactctacatacgatgggcatactgtgggcggactccaatacggaggccttggccagctagcagacggcgtcgtggggctggatgatttcagaaagagtcaggaactgagagtgtggcctggatacgattacgtgggctggagcaatcactcattcagcagtggctacgtcgagatggaattcgagttcgacaggctgcgcgcattccaggctatgcaggttcactgcaacaatatgcatactctgggggcgcggctgcctgggggggtggaatgccgtttcagaaggggtccagcgatggcctgggagggagaacccatgaggcacaacctgggtgggaacctgggggaccccagggcccgggccgtttccgttccacttggcggtcgcgtcgcccgtttcttgcaatgccgttttctgttcgcgggcccctggctcttattcagtgaaatctcatttatatcggatgtcgtgaacaacagtagtcccgcccttggtgggacattcccacccgcaccctggtggcccccgggtccaccccctactaactttagtagcctggaacttgagcctcgcggacaacagcctgtagccaaggctgaaggatcccctaccgcaatcttaattggctgtctggtcgccattatcctgctgctcctgctgatcatagctctaatgttatggcgcctgcactggaggcgattgctatccaaagccgaacgtagggtgctcgaggaggagctcactgtccacctgtcagttccaggggacacaatcctgattaacaaccgccccggcccccgcgagcctccaccttatcaggaaccacgccctcggggtaatcctccccacagcgccccgtgtgtgcccaacggcagcgctcttcttctgtccaacccagcctaccggctgctactagccacctatgccaggcctcctcgcggccctggccctccaacgcccgcctgggcgaaaccaacaaacacccaggcatacagtggtgactacatggaaccagagaaaccgggcgcgcctctgctccctccaccgccccagaatagtgtaccacactacgcagaagcagacattgttactctgcagggagtgacgggtgggaatacttacgctgtccccgctctgccacccggggcggtgggcgatggacccccacgagtcgattttccaaggtctcggctgcgtttcaaggaaaaactgggcgagggtcagtttggcgaggtccacctttgtgaagtagattctccgcaggatctggtcagtctggactttccactgaacgtgcgaaagggtcaccctttactggtggccgtcaagattctgcggcctgacgctacgaaaaacgccagcttctccctgtttagcaggaacgattttcttaaagaggtgaaaattatgtccaggctcaaggatccaaatatcatccgtctccttggagtttgtgttcaagacgaccctctctgcatgattactgattacatggagaatggggaccttaatcaatttttatcagcccatcagttggaggataaggccgctgaaggcgcgccgggtgatggccaggccgctcagggacccacgattagttatcctatgcttctgcacgtggcagcgcagatagctagcgggatgcgctacctggcaactctgaacttcgttcacagggacctagccacccgcaactgcctggtgggagaaaattttaccatcaagattgctgacttcgggatgtccagaaacctctacgcgggtgactactatagagtacaggggcgcgctgtgctccccattcgctggatggcgtgggagtgcatccttatgggaaaattcactacggcaagcgacgtgtgggctttcggagtaacgctgtgggaggtactgatgttgtgccgggctcaaccatttggccagctgactgacgaacaggtcatcgagaatgccggggagtttttcagagaccaagggagacaggtgtatctgtctagacctcctgcgtgtcctcagggcctctatgagctgatgctgcggtgttggagccgcgaatccgagcagcgcccccccttctctcagcttcaccgattcctggctgaagacgccctgaacaccgtttag

SEQ ID NO: 5844 - DNA, 1041 bp, Artificial Sequence
  Description of Artificial Sequence: Synthetic coding sequence
atgctcaagaaacctctcagcgctgtgacatggctttgcatcttcatcgtagcattcgtctctcacccagcatggctgcagaagttgtctaagcataagacgccagcacaaccacagctaaaagcagcaaattgttgcgaggaggtcaaagagctgaaagcccaggttgctaatttatcctctcttctgagtgaactcaacaagaaacaggaacgggattgggtgtccgtagttatgcaggtcatggagttagagtctaactctaagcggatggagagtagactaaccgatgctgagtcaaaatatagtgaaatgaacaatcagatcgatatcatgcaactgcaggccgcgcaaacagttactcagacatctgcggatgcgatctacgattgctcctcactttaccagaagaattataggatctctggcgtctataaattgcctccagacgattttctgggttccccagaactggaggtattctgtgatatggagacatcaggtggcggctggaccatcattcagcgacgcaagagcgggctggtctcgttctacagagattggaaacagtataaacagggattcggctctattagaggagatttctggctcgggaatgagcacatccataggctgtcacggcagcctacacgccttcgcgttgagatggaagactgggaaggcaatctccgctacgccgaatattcccacttcgtgctggggaatgagctcaatagctaccggctgttcctggggaattacactggaaatgtgggtaacgatgcactccagtaccacaataacaccgctttcagtactaaggataaagacaatgataattgtctagataagtgtgcccaactgagaaaaggcgggtactggtataactgctgtactgacagcaacttgaacggggtctactacagactcggcgagcataacaagcatcttgacggcatcacctggtacggatggcacggatctacatattccctgaaacgtgtggagatgaaaatcagacccgaagacttcaagccatag

SEQ ID NO: 5845 - DNA, 1056 bp, Artificial Sequence
  Description of Artificial Sequence: Synthetic coding sequence
atgaagggaagggcagtttcttttgaccctctcgcatgccagggactgaacgcttctcccggctcactcacgagccctttaaggaggatcaggagtctgacaggccgggaagtcttgacaccattcccgggactggggaccgcagccgccccagcacaaggaggtgcccacctaaaaccccatagcctagtccttccaattacagctttgccccccccacctttggcattacgagggagacaggcaactagcaaactgcctccttttttgtcttcccctttccctccaagcctttgtccttgggtgccagatcccgggtttaaggagactgcatttctgtacgctgtttctagtgccgctctaacccataccctggcccgcgcttgctcagccgggcgcatggaacgttgtacctgcgatgattccccaggactcgagtctcggcaagcttggcaatggggcgtttgtggggataatctaaaatattctacaaaatttttaagcaatttcctggggtctaagcgaggcaacaaggatcttcgagcccgtgcagatgctcacaacacgcatgtgggtataaaagccgtgaaaagcgggctgcgaacgacttgtaagtgtcacggcgtgtcaggttcctgcgctgtcagaacatgctggaagcagctgagcccattccgcgaaaccgggcaagtgctgaaacttcgatatgacagcgcagttaaagttagtagcgcaacgaacgaggctcttggccggctcgaactctgggccccagccagacagggctccttgaccaagggactggctcccaggagcggagacctagtgtatatggaagattccccgtctttttgcaggccgtccaaatactcccccggtaccgccggcagagtgtgtagccgcgaggccagttgttcctccctttgttgtggacggggatacgacacacagagccgcctcgtggcctttagctgtcactgtcaggtgcagtggtgctgttacgttgaatgtcagcagtgcgtgcaagaggagctggtctacacctgcaagcactag

SEQ ID NO: 5846 - DNA, 462 bp, Artificial Sequence
  Description of Artificial Sequence: Synthetic coding sequence
atgaagcacctccgcccccaattcccattgatcctggccatttattgcttctgcatgctgcagattcccagcagcgggtttccccagccactcgccgaccctagcgatggacttgatatcgtacagttagaacagctggcctattgcctgtcacaatgggcccctttaagcaggcagcccaaagataatcaggacatttacaagagatttctatttcactacagtcggactcaggaagctacgcaccccgtgaaaaccggtttccctcctgtccaccccctgatgcatctagccgcgaagctcgcgaatcggcgcatgaaacgtatcctgcagcgggggtcggggactgctgccgtcgatttcactaagaaggatcatacggccacctggggcagacccttcttcctgtttcggcccagaaatggccgcaatatcgaggatgaagctcaaattcagtggtag

SEQ ID NO: 5847 - DNA, 765 bp, Artificial Sequence
  Description of Artificial Sequence: Synthetic coding sequence
atggcggcagcaagcgctggcgcaacaagacttctgctgctcctgttgatggcagtggcggcgcccagcagggcaaggggctcaggttgtagggcggggacgggcgcacggggcgccggcgcggagggtagagagggtgaggcctgcggcacagtgggcctcctcctggagcattccttcgaaatcgacgatagcgccaattttagaaaaagaggatcacttctctggaaccagcaagatggtaccctgagcctttcccagcgacagttatcggaggaggagcggggtagactgcgcgacgtggcagcattgaacggactttaccgtgtgcggattccgagaaggcctggagcactggatggcctggaagcgggggggtacgtctctagcttcgtgcccgcttgcagcctcgttgaatctcacctaagcgatcagttgacactgcatgtggacgttgcgggaaacgtggtgggggtgagcgtcgtgactcacccaggaggatgtcgtggacatgaagtcgaggatgttgacctggagctgtttaatacctcagtacaactccagcccccaacgaccgccccggggcctgaaactgctgcattcatcgaaagactggagatggagcaagcccagaaggcaaaaaatcctcaggagcaaaaaagttttttcgccaagtattggcatataatcctgggcggagcagtactgttgacagcactgcgccccgctgcccctggccccgccccccccccccaggaggcctag

SEQ ID NO: 5848 - DNA, 810 bp, Artificial Sequence
  Description of Artificial Sequence: Synthetic coding sequence
atggccgctgctagcgctggcgcaactcgcctcctcttacttctcttgatggctgtggctgctccctcaagagcgcgtggttccggctgtagagccggaacaggcgctagaggagccggcgccgagggtcgagagggggaggcatgcggaactgttggcctgctcctggagcattcattcgagatcgatgactccgccaatttcagaaaacgcggtagcctgctgtggaaccaacaagacgggacactgagcctgtcccagcgtcagctgagcgaggaggaacgcggacgcctaagggacgtcgctgctctcaacggtctctatcgggtgaggatccccagacgccctggggccctggacggtctggaggcaggggggtatgtttcctccttcgtgcctgcatgctccctggtcgaatcccatctctctgatcagctgacgctgcacgtggacgttgcaggtaacgtcgtgggcgtgtccgtggttacccacccaggaggctgcagaggccacgaggtcgaagatgtcgacctggagctgttcaatacctccgttcaattgcagccccccactacggcacccggtcccgaaaccgccgccttcatcgaacggttagaaatggagcaagcccagaaggcaaagaatccccaagagcaaaaatccttcttcgcaaaatactggatgtatatcattcctgtggtgctattcctcatgatgagcggagctcccgacacaggcggtcagggtggcggcggtggcggcggcggaggagggggctctgggagatgctgcgttcctccttcactctag

SEQ ID NO: 5849 - DNA, 480 bp, Artificial Sequence
  Description of Artificial Sequence: Synthetic coding sequence
atgagttccccccagcgacgcaaggccatgccatgggccctttctcttctgctaatgggttttcagcttctcgtgacttacgcctggtgctccgaagaagaaatgggcggtaataataagatagtgcaggaccccatgttcctggccaccgttgagttcgccctaaacaccttcaatgttcaatccaaagaagagcacgcttatcgccttcttcgcgtactgagctcatggagggaggactccatggaccggaaatggcgcggtaaaatggtgttcagtatgaacctacagttgcgacaaaccgtgtgcagaaagttcgaggatgacattgacaattgccccttccaggagagcctggaactgaacaatgtacgccagggcatcagtttcccccaggtacattcctgtggctgctgtatgggctgcggcgtgggtacaggtgcagcagacaaggccatcccccgtgacaaagggaaatag

SEQ ID NO: 5850 - DNA, 1737 bp, Artificial Sequence
  Description of Artificial Sequence: Synthetic coding sequence
atgctgctgttgctcttgctcgcgcccctgttcctgagaccgccaggtgccggaggtgcccagactcctaatgccacaagcgagggttgccagataatccatcctccttgggaaggcgggatcagatatcgcggactgacgagggatcaagttaaagcaatcaattttcttccagtggattatgagatcgaatacgtctgcagaggagagagggaggtcgtggggccaaaggtgcggaagtgcctggcaaacgggtcttggaccgacatggatactccctcaagatgtgtgaggatttgctctaaatcctatctgactcttgagaatggtaaagtgtttctcaccggaggggatctccctgccctggacggggctagggtcgacttcaggtgtgaccctgacttccacctggtgggaagtagccgcagcatctgctcacagggacagtggagcactcctaagccccattgtcaggtgaacaggactcctcacagcgaaaggagggccgtctacattggagctctgtttcccatgtccggcggatggcctggaggccaggcgtgccaacctgccgttgaaatggctttggaagatgttaacagccgtcgcgacatcctgcctgactacgagttaaaattaatacaccacgacagcaaatgtgatcctggacaggctaccaaatacctctatgagttactgtacaatgatcctatcaagatcatcttgatgcctggatgctcaagcgtctcaaccctcgtagctgaagccgccaggatgtggaaccttatcgtgctgtcttacggtagttcttcacctgccctgtcaaacaggcaaaggtttcccacattcttcagaacacaccccagcgccacattacacaacccaacacgggtcaaattgttcgaaaagtgggggtggaagaagatcgctactatccagcaaacaactgaagtctttactagcaccttagacgacctggaggagagggtcaaggaagcaggaatcgagattacatttcgacagtcttttttttcagaccctgctgtgcctgtgaaaaacctgaaacgccaagatgcgcggatcattgttggtttgttttacgaaactgaagcacggaaagtcttctgcgaggtgtacaaagaacgcctcttcggaaagaagtacgtctggttcttgattggttggtatgccgataattggttcaaaatctatgatccttctattaactgcaccgtggacgaaatgactgaagcagtggagggccacatcactaccgagatcgtgatgctgaaccccgcaaatacacgcagtatcagtaacatgacatcacaggaatttgtagaaaagctcaccaagcgcctcaaacgacatcccgaagaaaccggtggattccaggaagcacccctcgcttacgatgccatctgggcacttgccttggccttaaacaagaccagcggtggcggtggtagatcaggcgtgcggctcgaggattttaactataataaccaaacaatcacagatcagatctatagagctatgaacagtagttctttcgagggtgtctccggacacgtcgtgtttgacgcctctggttccagaatggcctggacgcttatcgagcagctgcagggaggcagttacaaaaagatcggatactacgactcaacgaaagacgacctgagctggtcaaagacagataaatggatagtcatcagccgtacccacagcccaacctag

SEQ ID NO: 5851 - DNA, 444 bp, Artificial Sequence
  Description of Artificial Sequence: Synthetic coding sequence
atgctcggattgccctggaaaggtggactgagttgggcattacttttgctcctacttggcagccagattctgctcatttacgcatggcacttccatgaacaaagggactgcgacgaacataacgtaatggctcgttatcttccagctacagtagagttcgctgtccacacattcaatcagcagtccaaggactactacgcataccgtctcggtcacattctcaattcctggaaggagcaggtagagtccaagaccgtcttcagtatggaactgcttttagggcggacccgctgtgggaaatttgaagatgatattgacaattgtcacttccaggagtctaccgagctgaacaacacatttacctgctttttcacaatttccacgcggccctggatgacacaattcagtttgctcaacaagacgtgcttagaaggtttccactag

SEQ ID NO: 5852 - DNA, 444 bp, Artificial Sequence
  Description of Artificial Sequence: Synthetic coding sequence
atgtggagtttgccaccatctcgtgcactatcatgcgcccctttactactgcttttctctttccagttcctcgttacatatgcctggagatttcaggaagaggaggagtggaatgaccagaagcagatagctgtttaccttcctccaaccctggagtttgctgtctatacctttaacaaacagagcaaggactggtacgcttacaagctggtccctgtgttagcaagctggaaggaacagggctatgacaaaatgacatttagtatgaacctacagctgggccgaactatgtgcgggaagttcgaagacgacatcgataattgtccttttcaggagagccctgaacttaacaacacatgcacctgtttttttaccattggaattgagccatggagaaccaggttcgatctgtggaacaagacatgtagcggaggtcatagctag

SEQ ID NO: 5853 - DNA, 2535 bp, Artificial Sequence
  Description of Artificial Sequence: Synthetic coding sequence
atgggacccggtgctccattcgcacgggttggttggcctctccccttattggtggttatggccgcaggcgtcgcccccgtgtgggcctctcatagccctcatttgccccgcccgcatagccgggtgccgccacatccaagttcagagaggcgcgcagtctatatcggagctctgttccctatgtctggcggttggcccgggggtcaggcttgccaacctgccgtggagatggctttagaggacgtgaattctcggagggacatcctgccagactacgagttaaagctgatccaccatgactccaaatgtgacccaggccaggctaccaagtacctctatgagctgctctataatgacccaatcaagattatcttaatgcctggatgttcaagcgttagcaccctggtcgcagaagctgccaggatgtggaatctcattgtgttatcctacggctccagttcgcccgcactatctaatcgccagagattcccaacatttttcagaacgcacccgagcgccactctgcataaccccacccgcgtcaaactttttgaaaaatggggatggaaaaagatcgctaccatacaacagactacagaggtgttcacctccactttagacgacctcgaagagcgagtgaaagaggctggcatcgagattacatttagacagagcttcttcagtgaccccgccgtgcccgttaaaaacctcaagcggcaagacgcacgaataatagtcggcctgttctatgaaaccgaagcacgcaaggtcttctgtgaggtctacaaggagaggctcttcggcaaaaaatatgtatggtttctgatcggatggtacgctgacaactggtttaaaatctacgaccctagtatcaattgcaccgtggatgagatgacggaagctgtggaaggccatattacaaccgagatagttatgctgaatcccgctaatacccgctctatctcgaacatgacttctcaggagtttgtggagaaattaactaaaaggttgaagaggcaccccgaggaaaccggcggcttccaggaggcacccctggcgtacgatgccatctgggctctggctttggccctgaacaaaacaagcggaggaggcgggcgctctggtgttaggctggaagatttcaactacaataaccagactattaccgaccagatctacagagcaatgaattcttccagctttgaaggggtgtctgggcacgtggttttcgacgcttcaggaagcaggatggcttggactttgattgaacagctgcagggggggtcatacaaaaagataggctactatgacagcacaaaggatgatctttcctggtccaaaacagataaatggataggaggatcacccccagcagaccaaactctggttattaagacatttaggttcttgtcacaaaaactctttatatctgtgtccgtgctttcgagcttgggtattgtactggccgtggtctgcctgtctttcaacatttacaattctcacgtcaggtatatccagaactcccagccgaacctcaataatctcacagcagtgggctgtagcttggctctggctgcagtttttcccttaggattggacggttaccatattggaaggaaccagttcccttttgtctgtcaggcacggctgtggctcctaggtcttgggttctcacttgggtatgggagcatgtttactaagatttggtgggttcacaccgtgtttacaaaaaaggaggagaagaaggagtggagaaaaactctcgaaccttggaaattgtacgccaccgtcggactactagtgggaatggacgttctgacccttgctatttggcagatcgtggatcctttacacaggaccatcgaaacgttcgcaaaggaggaaccaaaggaggatatcgacgtgagcatcctgcctcagcttgagcattgctcttcaaggaagatgaacacatggcttgggattttctacgggtacaaagggctcctgctgctgctcgggatcttcttggcttacgaaactaaatcagtaagcaccgaaaaaataaacgatcacagagccgtcggaatggcaatttacaatgtagctgtcctctgtttgatcacagcaccggtgactatgatccttagttcccagcaggatgctgcgttcgcttttgccagcctggccatcgttttcagttcttacatcactctggtcgtgctgttcgtgccgaaaatgagacgcctcattactcgcggggagtggcagtccgaggctcaggataccatgaagactgggagctctacaaataacaatgaggaggagaaatcccgcctgttggagaaagagaacagagaattggagaagataatcgccgagaaggaagagagagtgagcgaactgcgccatcagctgcagagccgccagcagctgcgttcccgtcgccaccctcccacaccgcctgaacccagcggaggcctccctcgcggtccgccagagccgcctgacaggctctcttgcgacggatctagggtccacttgctgtacaaatag

SEQ ID NO: 5854 - DNA, 2700 bp, Artificial Sequence
  Description of Artificial Sequence: Synthetic coding sequence
atgctgcttctacttttactcgcgccactgtttcttcgtcccccaggcgctggaggagcccaaactcccaacgcaacaagtgagggttgccagattatacatccaccttgggaggggggcatccgttaccggggtcttacccgcgaccaggtgaaggccataaatttccttccagtcgattacgagatagaatacgtgtgccgtggggagcgagaagtggtgggtcccaaagtccgcaagtgcctggccaacggcagttggaccgatatggataccccctcacggtgtgtcaaccgtacccctcattccgaacggagggccgtttatatcggtgcccttttccccatgtcgggaggttggccgggtggtcaagcgtgtcagcctgctgtagagatggctctcgaggacgttaactccaggagggacatactgccggattatgagctgaaactgattcaccacgattctaaatgcgatccgggccaagccactaaatatctgtacgaactgctgtataatgaccctatcaagatcatcttgatgcccgggtgcagctccgtgtccacactagtcgcggaggccgcgaggatgtggaatcttatcgtgttatcctacggatcaagctcccctgcgctctccaacaggcagcggttccctactttcttcaggacccacccttctgctacccttcataatcctacacgtgttaagctctttgaaaaatgggggtggaagaaaattgcaacgatacaacagaccacagaggtgtttaccagtaccctcgatgatttagaggaacgcgtgaaagaagcaggcatagaaattacctttagacagagctttttctcagatcctgccgttcccgtaaaaaatctgaaacgtcaggacgcacgcattatcgttgggcttttctatgaaaccgaagctcgcaaggtcttttgcgaggtgtataaggagcgcctttttggtaagaaatacgtctggtttctgattggttggtacgcggacaactggttcaagatctacgatccgtcaatcaactgcactgtggatgaaatgactgaggccgtagaaggccacataactacagagatagtaatgctgaacccagccaatactcggtcaatctccaacatgacctcccaagagttcgtggagaaactgactaagcgtcttaaacggcatcctgaagaaaccggaggcttccaggaggcccccttggcctatgacgcgatttgggctctggccctggcccttaataaaacatccggtggaggtggaagatctggcgttagactagaggacttcaattacaataatcaaaccatcactgaccagatttacagggccatgaacagctcttcttttgagggagtcagcggacacgtggtgttcgacgcctcagggtcgcgaatggcttggaccctcatcgagcagttgcagggcggtagttacaagaaaataggctattacgattccaccaaagacgatctgagttggtctaaaactgataagtggattggcggtagcccaccagcggatcagacgttggtgatcaagacttttcgtttcctctctcaaaaactgtttataagcgtttctgtgctatctagcctaggtatagtgctggccgtggtgtgtctgtccttcaacatctacaacagtcacgtgcgttacattcagaattctcagcccaacctgaataatctgacagctgtgggatgttctctggcactagcagccgtgttccccctgggcttagacggctaccatattggccgaaaccaatttcccttcgtgtgtcaggctcgattgtggcttcttgggctagggttttcgcttggctacggatcgatgtttaccaagatctggtgggtgcacactgtcttcactaaaaaggaagagaaaaaggagtggaggaagaccttagaaccctggaaactgtatgccaccgtgggattgctcgttgggatggatgttctgacactcgcaatttggcaaatcgtggaccctctccaccgcaccattgaaaccttcgcaaaagaggagccgaaggaagacatcgacgtgtcgattctgccccaacttgagcactgctctagcaggaaaatgaatacttggctggggattttctacggctacaagggattgctgctgttattgggcatcttcctcgcctacgaaacaaaaagcgtgtcaacagaaaagatcaatgatcatagggctgtgggaatggcaatctataatgtggcggtcctgtgtctgataactgcgccagtgacgatgattctgagtagtcagcaggatgccgcgtttgctttcgcgtctcttgcaatcgttttcagctcatacataacactggtggtcctctttgtgccaaagatgaggcggctgatcactaggggagaatggcagtcagaagcccaggacactatgaaaaccggctccagtacaaacaataacgaggaggaaaaatcccggcttctggagaaagagaaccgggagctggagaaaatcattgctgagaaggaggagcgcgtgtctgagcttaggcaccagctgcagtcacgacagcagcttaggagtaggagacatcccccaactcctcctgaaccttccgggggcctgccgagaggccccccggagcccccagaccgcctttcttgcgatggaagccgagtgcacctgctgtacaagtag

SEQ ID NO: 5855 - DNA, 2886 bp, Artificial Sequence
  Description of Artificial Sequence: Synthetic coding sequence
atgctcctgctcctgttgctggctcccctctttcttaggcccccaggagcaggcggcgcccagactcccaatgccacctctgaaggctgccagatcatacacccaccatgggaggggggtatcagatacagaggtctaacccgagaccaggtaaaggccataaattttctccctgttgactacgagattgagtacgtctgtaggggcgagcgagaggtcgtaggaccaaaggttcgaaaatgtctggctaatgggtcctggacagacatggacactcccagtcgctgcgtacgaatttgcagcaagtcttacttgaccctggagaacggcaaggtttttctcacgggcggcgacttaccagccctggacggggcccgagtggacttcaggtgtgaccctgacttccatctggtcggatcatctcgtagtatatgctcgcaaggtcaatggagcactccgaaaccacactgccaggtgaacaggactcctcactcagagcggagagctgtgtacatcggtgccttattccctatgagtggcgggtggccaggaggacaggcgtgtcaaccagcagtagaaatggccttggaggacgtgaattctcgaagggacatcttgcctgactacgaattgaagcttattcatcacgattctaagtgcgatccaggacaggccacaaagtatctctatgaactcttgtacaatgatcctatcaagataattctgatgcctggttgttcctctgtgagcactctcgtggccgaagccgcaagaatgtggaacctgatcgtgttgtcctacgggtcctcctctcctgccctcagtaatcgccagcgctttccgaccttcttcagaacccacccttcagccactctgcataaccctaccagagtcaagctcttcgaaaaatggggttggaagaagattgccaccatccagcagaccacagaagtttttactagcacactggatgacttagaggaacgcgtaaaagaagccggaattgagataacatttcgacaatccttcttttcagacccagctgtgcctgtaaagaatctgaagcggcaggacgcacgaatcatcgtgggactgttttatgaaaccgaggcgcggaaagtgttttgcgaggtgtacaaggagcgcttgtttggaaagaagtacgtttggttcttaatcggctggtacgcagacaattggttcaaaatttacgatcccagtataaactgtaccgtggacgagatgacagaggctgtggaaggccacattactacagagattgttatgttaaatcctgcgaatacccgttcaatctccaacatgacctctcaggagtttgtcgaaaaattgaccaagcggctgaaacgacatcctgaggaaactggcggcttccaagaggcccccttggcctatgatgctatttgggcactcgcccttgcccttaataagacctctggcggaggcggtcggtcaggcgtgcgtctagaagactttaactacaataaccagactattaccgaccaaatctaccgggccatgaactctagctccttcgagggagtgtcagggcatgtcgtgtttgatgcaagcggctcacggatggcctggaccctcatagagcagctgcagggcggctcttataagaagatcggctactatgacagtacgaaggatgacctgagctggtctaagactgacaagtggatcggggggagccccccagctgatcagactctggtcatcaaaacattccgctttctgagccagaagctattcatctctgtgagtgtgctgtccagcctcgggattgtgctggcagtggtctgtctttcattcaacatatacaacagccacgttaggtacatccagaactcccagccgaacctgaataacttgactgctgtaggatgttctctggcccttgcagccgtgtttccactgggcctggatggatatcacatcggccgcaaccagtttccctttgtatgtcaggctaggctctggctgctgggactagggttctctctcggatatggcagcatgttcacaaagatttggtgggttcacaccgtttttaccaaaaaggaggagaaaaaggagtggagaaaaacactcgagccttggaaactctacgcaactgttgggcttctggtggggatggacgtactaacactcgcaatttggcagattgtcgaccctctccatcgtaccattgaaaccttcgcgaaagaggaacccaaggaagatattgacgtctcaatacttccccagctcgagcattgcagtagcagaaaaatgaatacctggcttggcatcttctacgggtacaaggggctgctacttctgctcgggatttttctcgcctatgagacgaagtccgtctccacagagaagataaatgaccatcgtgctgttggaatggctatttataacgtagccgtgctctgtctcataacagccccggtgacaatgattctgtcttctcagcaggacgcagctttcgcatttgcatctctcgccattgtcttctcgtcctatattaccctcgtggtgttatttgtgccgaagatgaggagacttattacccgaggggagtggcagagcgaggcccaggacaccatgaagacagggagctccaccaacaataacgaagaagaaaagagccgtctgttggaaaaggagaaccgagagctcgagaagatcattgccgaaaaggaagagcgtgttagtgagttgagacaccaactccagtcaagacagcagctaaggtctagaaggcatccaccaaccccccccgagccatctggtggtttaccacgcggcccccctgagccaccagatcgcctgtcctgcgacgggtccagggtgcatctgctttataagtag

SEQ ID NO: 5856 - DNA, 882 bp, Artificial Sequence
  Description of Artificial Sequence: Synthetic coding sequence
atgaacaacttgagttttagtgaactttgttgcttgttttgctgtccaccatgccccgggaagattgcctccaaactcgcctttctcccaccagatcccacgtacaccctaatgtgtgatgaatctgggtcacggtggacgctacacctatccgagcgggccgactggcagtactcttcacgcgaaaaggatgcgattgaatgcttcatgacacggacttctaaaggaaatagaatcgcctgcatgtttgtgcgttgtagtccaaatgctaaatacacactgctatttagtcacgggaacgctgtggacctgggacagatgtcttccttctacatcggtctcggctcacgaattaattgtaacatcttctcctatgactacagcggctacggtgcatctagtgggaagcctacagagaagaatctgtacgcagacattgaggctgcctggttggcactgcgcacgcgttatggtattaggcccgaaaacgtcatcatttatgggcaatctatcgggactgtgccctctgtggatcttgctgctaggtacgagtcggccgcagtcatcctgcatagcccattaacgtcaggtatgcgcgtggccttccctgacactaagaagacatactgttttgacgccttcccaaatattgacaaaatcagcaaaattacctcccctgtcctgatcattcatggtactgaggatgaggtgatcgacttttcacatgggctcgccctgtttgagaggtgtcagagaccggtggaacccttgtgggtggagggtgcaggccacaacgatgtggagctgtacggccagtacctggagaggctgaagcagtttgtctctcaggaactggtccaaaagcataaggagggcaaatag

SEQ ID NO: 5857 - DNA, 1155 bp, Artificial Sequence
  Description of Artificial Sequence: Synthetic coding sequence
atgtggtatgtaagcacccggggagtggcccctagagtgaactttgaaggggcactattttctgggtacgcccctgatggaggtctattcatgccggaggagttgccacaattggatcgcggcaccctctgtcagtggtccaccctgagctaccctggactcgttaaagaactctgcgcattgtttatcggttctgagctgttgccaaaggatgagctgaatgatttgatagacagggccttttcccgatttcggcaccgggaggtagtgcacctatcccggctacgaaacggacttaatgtgctggaactctggcacggtgtgacgtacgctttcaaggatttaagtctatcctgcaccacccagtttcttcagtactttctggaaaagagggagaagcacgtaacagtggtcgttggtacgtccggcgacacaggctccgccgctatcgagtcagtccaaggcgcaaaaaacatggatatcatcgtcctgctgccaaagggacactgcacaaagatacaggagctacagatgacaactgtgctcaagcagaacgtgcacgtgttcggtgtcgagggaaactccgatgagctggatgagccaatcaagacggtgttcgctgacgtcgccttcgtgaagaagcacaatcttatgtctttgaattctatcaattggtcacgagtccttgtccaaatggcccaccatttttttgcctatttccagtgcactccttcacttgatacgcaccctctgcccttggtggaggttgtggtgccgacgggcgctgccggtaatctcgcagcggggtatatcgcgcaaaaaatcggtctccctatcaggttggttgtcgccgtgaacagaaacgatataatccaccgcactgtgcagcagggggacttctcactctctgaggccgtgaagtcaacacttgcatcagccatggacatacaggtgccgtataacatggagcgggtgttctggctcttatcaggttcggattcacaggttactcgcgccctgatggagcagttcgaacgtacccagagcgtcaacctccccaaggagctgcattctaagcattcaccagttctgcctagaccctgcctctgctctcaggtccccggttcatgccctggctgttggcccgatccctag

SEQ ID NO: 5858 - DNA, 2889 bp, Artificial Sequence
  Description of Artificial Sequence: Synthetic coding sequence
atgctgcggcgtcctgctccggccctcgcgcccgccgcgcggctactcctggctgggctgctgtgcggcggcggtgtatgggctgcaagagtgaataagcataaaccctggttagagcctacctatcacggtattgtaacggaaaatgacaatacagtgctcctcgacccccccctgatcgcactggacaaagatgcccctctaaggttcgccgagagcttcgaagtcaccgtgactaaagaaggagagatttgcggcttcaagatccatgggcaaaatgtgccgtttgatgccgtggtcgtcgacaagtcgaccggagaaggagtcatccgtagcaaagagaaactggattgcgagctgcaaaaggactactcattcacaatccaggcttatgactgtggcaaaggccccgacggtaccaatgttaagaagagtcacaaggctaccgtccatattcaggttaacgatgtcaacgagtatgcacccgtttttaaagaaaagagctacaaagccacagttatagagggcaagcagtacgacagtatcctccgggttgaagcagtggatgctgattgtagccctcagttttcccagatctgttcctacgagattatcactcctgatgtccctttcacagtggataaagacggatatatcaaaaacaccgagaaattgaactatggaaaagaacaccagtataagctgaccgtcaccgcgtacgactgcggaaagaaacgcgcgactgaagacgtgctggttaagatcagtattaaacctacgtgcactcccggatggcagggctggaacaacagaatcgagtatgaacccggaaccggcgccttagccgtatttcctaatatccacttggaaacctgcgacgagccagtggcatctgtgcaagctacagtggagctggagacatctcacatcggtaagggctgtgatcgtgacacatatagcgagaagtcacttcatcgcttatgtggcgccgctgccgggactgctgaactcttgccatcaccatccggttccctcaattggaccatgggcttgcctactgacaatggacatgactcagatcaggtcttcgagttcaatggtacccaggcagtccgtattcccgatggggtggtgagcgttagcccaaaggagcccttcacaatctctgtgtggatgcgccacgggccatttgggcgcaagaaagagacgattctctgttcctctgacaaaaccgacatgaacagacaccactacagcctgtacgttcacggctgcagactgatcttcctgttcagacaggatccttctgaagagaagaagtacagaccggcggagttccactggaaattaaaccaggtctgtgacgaagaatggcaccactatgtgcttaatgtggaattccccagcgtgaccctctacgtggatggtaccagccatgagcccttctccgtgacagaagactaccccttacacccatctaagatcgaaactcagctggtggtgggcgcgtgctggcaaggaggagacctgcacatgacacagtttttccggggtaacctggccggtctgacactgcggtctgggaagctggcagataaaaaagtgatcgattgtctgtatacttgcaaggaaggcctcgatctgcaggtcctcgaagactcaggtcggggggtgcagattcaggctcaccctagccaactggtgcttacgctcgagggagaggatttgggtgaattggataaagccatgcagcacattagctacctgaactcccgacaattccctacaccaggcatcagacgcctgaaaattacatcaacaattaaatgtttcaatgaggccacgtgtatttccgtgccaccagtggatggttacgtgatggtgctgcagcccgaggaaccgaaaatctccctgtcaggcgtacaccatttcgcccgggctgctagcgagtttgagtcatcagagggcgtgttcctcttccctgagctgagaatcatctcaacaattacaagggaggttgaacctgagggcgacggggccgaagatccgacagtccaggagtccctggtcagtgaggagatcgtgcatgatctggacacctgcgaggtgaccgtcgaaggggaagagctcaaccacgaacaggagtctcttgaggtcgatatggcccggcttcagcaaaagggcatcgaggtaagcagtagcgaactggggatgaccttcaccggggtggacaccatggcttcatacgaagaggtcctgcacctgctcagatatcggaactggcacgcgaggagcttgctagacagaaagtttaagctgatctgctcagagctaaacgggcgctatattagcaatgagttcaaggtggaagtcaatgttatacataccgcgaatcccatggagcacgccaaccacatggccgcccagccccagttcgtgcatccagaacatagaagctttgtcgacctctccggccacaacctcgccaaccctcatccttttgccgtggttccttctacggcaaccgttgttattgtagtttgcgtgtcattcctggtattcatgataattttaggagtgtttagaattcgagccgctcatcgcagaacgatgcgcgaccaggacacaggtaaggaaaacgaaatggactgggatgactccgccctcactatcacagtcaatcccatggagacttacgaagaccaacattcctccgaggaggaagaagaggaggaagaggaggaggaaagcgaggatggggaagaggaggatgatataacaagtgccgaaagcgagtcctccgaggaagaagagggggagcagggagaccctcaaaatgcaactcgtcagcaacagctggagtgggatgatagtaccttgtcttactag

SEQ ID NO: 5859 - DNA, 2946 bp, Artificial Sequence
  Description of Artificial Sequence: Synthetic coding sequence
atgcttcggagacctgccccagcactcgcccccgcggcccggctcctgcttgctgggctgctctgcggcgggggggtttgggctgcccgcgtgaacaagcataagccatggttggagccaacatatcacggcattgttactgagaatgataataccgttctcttggaccccccattgatcgcgctcgacaaagacgcccccttgagatttgccgagtcgtttgaagtgaccgtgaccaaggaaggagaaatatgcggcttcaaaatacatggccagaacgttccatttgatgcagtggtggtagataaatctacgggggaaggggtgatccgaagcaaagaaaagctggactgtgaacttcagaaggattacagcttcaccatccaggcatacgactgcggcaaagggcctgatggcacaaatgtgaaaaagtcccacaaggcaaccgttcatattcaggtaaacgatgtcaacgaatacgcgcctgtgttcaaagagaaatcttacaaggctactgttattgagggcaagcagtatgactccattctccgggttgaggccgtggatgcagattgcagtccacaattctcccaaatttgtagctacgaaattattactcccgacgtcccattcacagtagataaagatggttacataaagaataccgaaaagttgaactatggaaaagagcatcagtacaagttgaccgtgactgcatatgattgcggtaaaaaacgggccaccgaggatgtgctggtgaaaatttcaatcaaacccacttgcacaccaggctggcagggctggaacaataggatcgagtatgaacccggtaccggcgcgctggctgtgttccccaatatccacttagagacctgcgacgagcccgtggcatctgtccaggccaccgtcgagctagaaacttctcatatcgggaaaggctgtgacagagacacgtactccgagaagtctttgcatagattgtgtggggctgccgctgggacggccgagttgttgccgtcgccctctgggagtcttaactggaccatgggactgcccactgacaacggacacgacagcgatcaggtattcgaattcaatggaacgcaggcagtacgtatacccgacggtgtggtatctgtgtcccctaaagaaccctttaccatcagcgtctggatgcggcacggaccgtttggccgaaagaaggagactattctgtgttcctccgacaaaacagacatgaataggcatcactatagcctgtacgtccatggttgcagactgatatttctgtttagacaggacccctccgaagaaaagaaataccggccggccgaattccattggaagcttaatcaggtatgtgacgaagagtggcatcactacgtacttaatgttgagttcccaagcgtgactctttacgtggatggcaccagccatgaaccattctcagtgactgaggactatccccttcatccaagtaagattgagactcaactcgtggttggtgcatgctggcaagagttttccggagtggagaatgataatgagaccgaaccagtgacagtggcctcggccgggggcgaccttcacatgacacagttcttccgaggtaatttagcagggctaacgttaaggtcaggcaagttggccgacaaaaaagtgatagattgcctctatacctgcaaggagggcttggatctgcaggttctggaagattcagggagaggagtgcaaatccaggcccacccaagtcagttggtcctgactcttgaaggcgaagaccttggtgaactcgacaaggccatgcagcacatttcctatctgaacagccggcaattccccacaccaggaattaggaggctgaaaataacatcgaccatcaagtgttttaacgaggccacttgtattagcgtcccacccgtggacgggtatgtcatggtcctccagccagaggagccgaaaatatccctgtcgggcgtgcaccacttcgcacgagccgcgagcgagttcgaatccagtgaaggggtgtttctgtttccggagctgcgcatcatttccactatcactagagaggtggaacccgagggtgatggggccgaggaccccaccgtgcaagaaagccttgtctctgaagagattgtacatgatctggacacatgtgaagtcacggtagagggcgaggagttgaaccatgaacaagagtctctggaggtcgacatggcccgcctccagcaaaaagggatcgaggtgagcagcagcgaactgggcatgacgttcactggggtggacactatggcatcatacgaagaagttcttcacctcttgaggtacaggaactggcacgcccggagtcttctggataggaagtttaagctaatttgcagcgagttgaacggtagatatatttccaatgagttcaaggtagaggtgaacgttatccacactgctaaccccatggaacacgccaaccacatggcggctcagccccagtttgtccacccagaacacagaagctttgttgacctgtcggggcacaacctcgccaacccacatccctttgccgtggtcccatccactgccacagtcgtgattgtggtatgtgtcagtttcctggtattcatgattatcctgggggtttttaggatcagggctgcacacaggcgcacaatgagggaccaggatacgggaaaggagaacgagatggattgggatgacagtgcactgacaatcacagtgaatccaatggagacctacgaggatcagcattctagtgaggaggaagaggaggaggaggaggaggaagagtctgaagatggcgaggaagaagatgacatcacttcagctgagtcagaaagctcggaggaggaggagggagagcagggagatcctcagaacgccactcgccagcagcagctggaatgggatgactccactctaagctactag

SEQ ID NO: 5860 - DNA, 678 bp, Artificial Sequence
  Description of Artificial Sequence: Synthetic coding sequence
atgtccggatgctccaaacgatgcaaattggggttcgtcaaattcgcccagactatttttaaacttataacgggaacactgtccaaggacaaaatcgaggacgagcttgaaatgaccatggtatgtcatagacccgaggggctcgagcagcttgaggcacaaaccaatttcacgaagagagaactgcaagtactgtatcgcggcttcaagaatgaatgtcctagtggcgtcgtgaacgaagacacattcaagcaaatttatgctcaattttttccacacggcgatgcaagtacgtacgcccactatctgttcaacgcgttcgacacaactcagacaggttctgttaaattcgaggacttcgtgaccgccctcagcattctcctgcgcggcaccgtccacgaaaaactgcgctggacttttaacttgtacgacatcaacaaagatggttatataaataaggaggaaatgatggacatcgtgaaggctatctacgacatgatggggaagtatacctaccccgtactgaaagaagacaccccccgccagcacgtagatgtgtttttccagaagatggataagaataaagatggtatcgtaacactagacgaatttttggaaagttgtcaagaggatgacaatattatgaggtccctgcaactttttcagaatgtgatgtag

SEQ ID NO: 5861 - DNA, 420 bp, Artificial Sequence
  Description of Artificial Sequence: Synthetic coding sequence
atgtataagctggcatcttgctgcctgttattcatcggcttcctgaatcctctgttatcactgcctctgctggatagccgcgagatctcttttcagctttctgccccccacgaagacgcccgcctaacccccgaagagctagagagagccagtctgttgcagattctccccgaaatgctcggcgcggagagaggtgatatccttcggaaagccgatagttcgactaatattttcaatcccaggggaaaccttcgcaagttccaggatttcagcggtcaagaccctaacattctgctgtctcatctcctcgccagaatctggaaaccctacaaaaaacagaggcgcaaacttcgacaggacctgcgtctgtggaaaaaagagccggggctgcgaatatttaagaactacgtgtgggtctag

SEQ ID NO: 5862 - DNA, 879 bp, Artificial Sequence
  Description of Artificial Sequence: Synthetic coding sequence
atggaagtgacagctgtggcaacacagggaggatacggtagttcagactgggtgacctcctatctgctcatgttcagcgacggcgggagaaactggaaacagtacagacgggaagaatccatttgggggttccccggaaacacaaacgctgattccgttgtgcattatagactccagccgccttttgaagcccggttcctcagattcctgcctttagcttggaacccacggggtagaattgggatgcgaatcgaggtgtatggttgcgcctacaagtctgaagttgtctacttcgacggacagtctgccttgctctatagattggataagaagcccttgaaacctatccgggatgtgatctccctgaagtttaaggctatgcaatccaacggaatcctcctgcaccgagaaggacaacatggtaaccatataacactcgagttaataaagggcaagctggttttcttccttaactctggaaatgctaaactgccgtcaacaatcgccccggtaaccctaactcttgggagcctgctagacgatcagcattggcattctgtcctgattgagctgcttgacacgcaggtgaatttcaccgtggacaagcacacacatcacttccaagctaaaggcgactccagctacctggatctaaatttcgaaattagcttcggcggtattcccactccaggacggagcagggcgtttcggcggaaatcttttcacggctgcttggagaacctctactacaatggggtggacgtgaccgagttagctaaaaagcataagccacagattttgatgatggagctcgcacatgggctccaagatcagaatttgaaaatttccttgactgtctgtcaccagactacccagtag

SEQ ID NO: 5863 - DNA, 783 bp, Artificial Sequence
  Description of Artificial Sequence: Synthetic coding sequence
atgaaaacttccgacggattcaccctgaacgccgaaagttatgttagcttcaccaccaaactagacatccctacagcagctaaatatgagtacggggtgcctctccagacctctgacagtttcttgagatttccaagttcattgacctcgtcactgtgtacagacaacaaccctgcagcttttctagttaaccaggctgtcaaatgtacgcgcaagataaatctcgaacagtgcgaggagatcgaagcactcagcatggcgttctacagcagccccgagattctgagagtccctgactccaggaaaaaagtgcccataacagtgcaaagcatcgtgattcaatcgcttaacaaaaccctgacaaggcgtgaggataccgacgtgcttcaacccactctggtgaatgccggacattttagcttgtgtgtaaacgtcgtgttggaggtcaagtacagcctgacttacacagatgccggggaagtgactaaggcggacctgagtttcgttctgggaaccgtgagctcggtggtggtgcctcttcagcagaaatttgaaatccattttctgcagactgattggtcctctccagtgagcgctcgctctaccgaaggagaagaacccgctgtgggacctgggctgccaaggctcagagggccgttctggaaattccctggacctgggcacgccggtcttggcgctcacccactgcatcatccagttattcagcaagagggctttctgccagccccccgcggctttggctacaggtccgaggtcgattag

SEQ ID NO: 5864 - DNA, 3624 bp, Artificial Sequence
  Description of Artificial Sequence: Synthetic coding sequence
atggcatcagtggcctgggccgtcctcaaagtgctcctactgctgcctacacaaacttggagcccggtcggggctggtaaccctcccgattgcgacgcgccactggcctctgcactgccccggtctagcttttcttcttcttccgaactgtccagctctcatggaccaggcttctccaggcttaaccgcagagacggcgccggtggttggacccccctggtttctaataaataccagtggctccagatagacctaggggagaggatggaagtgactgcagttgccacccagggcggctacgggtcttccgattgggtcaccagctatctgctgatgttttcggacggcgggaggaactggaagcagtaccggcgcgaggagtcaatttggggcttcccgggcaacactaacgcggattcagtcgtgcattaccgtctgcaacctcccttcgaagcgcgctttcttagatttcttcccctcgcatggaaccccaggggaaggattggaatgcggatagaagtctatgggtgtgcatataagtcagaagtagtgtactttgacggtcagagcgctctcctataccgcttggacaaaaagccgctcaagccaatcagggatgtaatttccctgaagtttaaagcgatgcagagcaatggaatcctcttacatcgggagggacagcacgggaatcacatcaccttagagctgatcaagggtaagctggtgttcttcctcaattccggaaacgccaaactgccatctaccatcgcgccggtcacactcactctcggtagcctcctggatgaccagcactggcactcagtcctcatcgagctgctcgacactcaagtgaatttcacagttgataaacatacccatcacttccaggcaaaaggggacagttcctaccttgacctgaacttcgagatcagcttcggcggcatcccaaccccaggacggtcgagagcctttcggaggaagtcctttcacgggtgtctggaaaacctttattacaacggggttgacgttacagaacttgccaaaaagcataaaccacaaatcctgatgatgggcaacgtatcattctcgtgcccacaaccgcagacagtgcccgtaacgttcctgtcatcgcggagttacctggcactgcccgggaattctggcgaagataaagtaagcgtgaccttccagtttagaacctggaatagggccggacacctgttatttggggaattaagacggggaagcgggagcttcgtcctgtttctgaaagacgggaaactgaagttatctctattccagcccggacagagcccacgaaacgtgactgcaggagctggtctgaacgacggacagtggcactcggttagtttctctgcaaaatggagccacatgaacgtggtggtggatgacgacaccgccgtacagcctttagtggctgtccttattgatagtggggatacctattactttggggggtgtctcgataattcatccggttccggttgcaagagcccgttaggcggatttcaaggatgccttcgactgatcaccatcggcgacaaagcagtggatcccatcctggtccagcaaggcgcacttggatcatttagggacttgcaaatcgactcctgtgggatcacagaccgatgcctgccaagctactgtgaacacggaggcgagtgtagccaatcctgggataccttctcgtgtgactgcctcggtacagggtacaccggcgaaacttgccacagctctctctacgagcagagctgcgaggcccataaacacagaggaaatcctagcgggctatactacatcgatgcagacgggtcagggcccctggggccctttttagtttactgtaatatgacagacgcagcgtggaccgtagtccaacacggaggtccggatgctgtcaccctgagaggcgctcccagcgggcatccgcggtccgcagtatcctttgcctatgccgctggagcgggccagctgaggagcgcagtcaacctagccgaacgttgtgaacagcgccttgcacttcgttgcggtaccgcccggcgccctgattccagggacggtacgcccctatcctggtgggtggggcggaccaacgagacacacacctcctgggggggctcactccccgacgcccagaagtgcacatgcggtctagagggaaattgtatcgactctcagtactattgcaattgtgacgccggcagaaatgagtggacctctgacactatcgtactgtcgcaaaaagagcacctccccgtaacccagattgttatgaccgatgcaggtcgcccacactctgaggctgcctatactctgggacctctactatgcagaggagatcaatccttctggaactctgcttctttcaataccgagacaagctatttgcacttcccagctttccacggtgaattgaccgcggatgtatgtttttttttcaaaactaccgtcagctcgggtgtgtttatggagaatttaggaatcacagattttattaggatcgagctccgcgctcccactgaggtgactttctcgttcgacgtaggtaacggcccctgtgaggtgacggttcagagcccaacgccctttaacgacaatcagtggcaccatgttcgcgctgagcgcaatgtgaagggtgccagtctccaagtggaccagctcccccaaaagatgcagccagccccggcagacggtcatgtgcgcctgcaactgaacagtcagctgttcatcgagatcagtgcctattttgccactggcagttcaatgacataccattttcaggaacactatacactgagtgagaactcctcttcactggtgtcttccctccatagagacgtcaccttgacccgagaaatgattactctgagcttccgaacaacccgtactccctcgcttctgctgtacgtatcctcgttctatgaagagtacctgagcgtgatattagccaataacggctcgctgcagatccgatataagttagaccgccaccagaatcctgacgcatttacttttgattttaaaaatatggcagacggtcaacttcaccaggtcaaaatcaatcgggaggaagctgtggtgatggtggaagtgaaccagtctaccaagaaacaagttattctctcctccggaactgaattcaatgccgtcaagtcactgattttgggaaaagtgctggaagcggcaggcgccgatccagacacccgccgggcagccacgtcagggttcacaggctgcctcagtgctgttaggttcggccgcgcagcaccactcaaagccgctctgagaccatcaggtccatcacgggtgaccgtccggggccatgtcgcccctatggctcgctgcgccgccggtgccgcatcaggatcgcctgctcgggagctcgctccacggctggccggtggggccggccggagcggccctgcagacgaaggtgaacccttagttaacgctgaccgaagggatagtgccgttataggaggggtcattgccgtggtgatttttatccttctctgtatcaccgcaatagccattaggatttatcagcagcgcaagttaagaaaagaaaatgagtccaaagtgagcaaaaaggaagaatgctag

SEQ ID NO: 5865 - DNA, 2238 bp, Artificial Sequence
  Description of Artificial Sequence: Synthetic coding sequence
atggccagtgtagcgtgggctgtcctcaaggttctactgctcctaccaacccaaacctggtcaccagtgggagccgggaaccctccagactgcgacgcccccctggcctccgccctgccaaggtcgtcattttccagttcatcagaactttcgtcctcacatggacctggcttcagtcggctaaataggcgggacggcgccggcgggtggactcctttagtctcaaacaagtaccagtggctgcagattgatctcggggagcgcatggaggtgactgccgtggctacacaggggggttacggctcatcagactgggttacctcctatttactgatgttttccgatggtggccggaactggaagcagtatcgccgcgaggagagcatttggggatttcccgggaacacaaacgcagactccgtggttcactacaggctccagcctcccttcgaggcgaggtttctgagattcctgcctctggcctggaatcccagaggccggatcggaatgcgtattgaagtatatggctgtgcttataagtcagaggttgtctactttgacggtcaatccgcactcctgtacaggctggacaagaagccgctgaaacctatacgggacgtgatctctctcaagtttaaggcaatgcaaagtaatggaatcctcctgcatcgcgaaggacaacacggaaatcacataacgctggaactgatcaagggaaagcttgttttttttcttaactcaggcaatgcaaagttgcctagtaccattgccccagtgaccctgactctgggctccctgttggacgaccagcactggcacagcgtgttgattgaacttctggatactcaagtgaattttaccgttgacaagcatacccaccatttccaggccaaaggggacagctcatacctggatttaaacttcgagatcagcttcgggggaattccgacccctgggcgcagccgggccttccggaggaagtcctttcacggatgcttggaaaacctctactataacggggtcgacgtcaccgaactggccaagaagcataaaccccaaatcctaatgatgggtaacgtgtccttttcctgcccccagccacaaacggttcctgtcacattcctcagctcacggtcttatctcgccctgcccggcaacagcggggaggataaggttagtgttacatttcagtttcgaacctggaacagagccgggcacctgctcttcggggagctccgcaggggttcaggtagtttcgtcttgtttctgaaggatggcaagctcaaacttagcctcttccagcccgggcagagcccccgaaacgttaccgccggtgctgggcttaacgatggacagtggcattctgtgtcgttctcggccaagtggagtcacatgaacgttgtcgtagatgatgacactgccgtccagcctcttgtggcggtgcttatcgactcaggtgacacttactacttcggtggttgccttgataattcgtcaggttcaggctgcaagtcgcctctgggtggatttcaaggatgtttgagattgataacgatcggggacaaggcagtggacccaatactggtgcaacaaggtgcactgggaagcttccgcgaccttcagattgactcttgtgggatcacggaccgttgccttccttcctactgtgagcacggaggagaatgcagtcagtcctgggacactttctcttgcgattgtctgggcacaggctacactggcgagacatgccactcttccctgtatgaacagagctgcgaagcccataagcacagaggaaacccctctgggctctattatatcgacgccgacggctcagggcccctgggccctttcttggtctactgtaacatgaccgatgccgcctggacagttgttcagcacggcggacccgacgcagtgacactgcgcggggctcctagtggccaccctaggtctgccgtaagttttgcctacgctgcaggtgcaggtcagctccggtcagccgtcaatctggcggaaaggtgcgagcagcgtctggccttgcgttgcggtactgctaggaggccggatagccgcgatggtacccctctgtcatggtgggtaggacggacaaacgaaacccatactagttgggggggatcgctccctgatgcacaaaaatgcacctgcggcctggagggcaattgtatcgatagccagtattactgtaactgtgatgcaggaaggaatgagtggtag

SEQ ID NO: 5866 - DNA, 549 bp, Artificial Sequence
  Description of Artificial Sequence: Synthetic coding sequence
atggagcctcagctgggacccgaagctgccgcactcagacccgggtggctggccctattactttgggtatctgccctctcctgctcatttagcttgcccgcctcctcgttatcttctttagtcccacaggttcgaacttcatataatttcgggaggacttttctgggcctcgataagtgcaatgcctgtattgggacgtctatttgcaaaaagttctttaaagaggagattaggagcgacaattggttggcgagtcaccttggattgccccccgactccttgttatcctatcccgctaattactctgacgattccaaaatctggcgccccgtggagatctttcggctggtgtccaagtaccagaacgaaatctcggatagacggatctgtgcctcggctagtgcgcccaaaacttgtagcattgagagagttctgagaaagacagagcgttttcagaaatggttacaggcaaagagactgacacctgacctcgtccaagactgtcatcaagggcagcgggaactcaagttcttgtgcatgcttcggtag

SEQ ID NO: 5867 - DNA, 282 bp, Artificial Sequence
  Description of Artificial Sequence: Synthetic coding sequence
atggactccctgagaaagatgttgattagcgttgcgatgttgggtgccggagccggagtgggatacgccctcctagtgattgtgacgccgggagaacgcagaaagcaggagatgctgaaagagatgcccctccaggacccgcgcagtagggaggaagccgcccgaacccagcagcttcttttggcgacattacaggaagcagccacgacccaagagaatgtagcttggcgaaagaattggatggttggaggagagggtggagccggaggccggtctccctag

SEQ ID NO: 5868 - DNA, 387 bp, Artificial Sequence
  Description of Artificial Sequence: Synthetic coding sequence
atgggcaaatctgcctctaagcaatttcacaacgaagtgttaaaagcccacaacgagtacaggcagaaacacggggtccccccattaaagctctgcaagaacctaaacagagaggcccagcaatatagtgaggccttagcttctacaagaatcctgaaacacagccctgaatcgagcaggggccagtgtggcgagaatcttgcctgggcttcctacgaccagacgggccacttcactgccatggtctggaaaaacactaagaagatgggcgtcgggaaagcatctgccagtgatggttcctcctttgtggttgcaagatacttccctgcaggaaacgtggttaatgaagggttctttgaagaaaatgtccttccccctaagaaatag

SEQ ID NO: 5869 - DNA, 465 bp, Artificial Sequence
  Description of Artificial Sequence: Synthetic coding sequence
atgggcaaaagcgcttccaagcagtttcacaatgaagtgctgaaggctcacaatgagtatcgacagaaacacggagtgcctcccctcaagctctgcaagaatctgaatcgggaggctcagcagtattctgaagcactggcctccaccagaatattaaaacattctccagagtcctctagagggcaatgcggggaaaaccttgcctgggcatcttacgatcagacaggcaaggaggtagcagatagatggtactccgaaattaaaaattacaacttccagcagcccggtttcacatccggcaccggtcatttcaccgccatggtgtggaagaacacaaaaaaaatgggagttgggaaggctagtgcttccgatggctcatcattcgtggtggcccgctactttccggccggcaatgtggtcaatgaaggcttcttcgaagagaacgttcttcctccaaagaagtag

SEQ ID NO: 5870 - DNA, 831 bp, Artificial Sequence
  Description of Artificial Sequence: Synthetic coding sequence
atggattcttcacgagaacctacattgggccgacttgacgccgccggtttctggcaggtgtggcagagatttgatgctgatgagaagggatacatcgaggaaaaagagctggacgcctttttcctgcacatgctgatgaaactgggaaccgatgataccgtaatgaaggcaaacctccacaaagtcaagcagcagtttatgaccacacaggacgcctccaaggacggtcgcatccgtatgaaggaacttgcaggcatgttcttatccgaggatgagaatttcctgctcttgtttcgccgcgagaaccccctagactcaagcgtggaatttatgcaaatttggcgtaagtatgatgccgattcttccggtttcatatccgctgctgagcttcgcaactttctgcgagatctctttcttcaccataagaaagcaatttcagaagccaagctagaggaatatacagggaccatgatgaagatctttgatcggaataaggacggtagattagatctaaatgacctggccaggattctggctctccaggagaacttccttctgcagtttaagatggacgcctgctccacagaggagcggaagagggactttgagaaaatctttgcatactacgatgtaagcaaaactggagccttggaaggtcccgaggtggatggttttgtgaaagacatgatggagctggtccagcccagtattagcggggtggaccttgacaagtttcgggagatcttgctccgacactgtgacgtgaataaagatggaaaaatccagaagagtgaacttgctctgtgtttgggcctgaagattaatccatag

SEQ ID NO: 5871 - DNA, 216 bp, Artificial Sequence
  Description of Artificial Sequence: Synthetic coding sequence
atgcctgctggggtccccatgtccacctacctgaaaatgttcgctgcttctttgctcgctatgtgcgccggtgccgaagtggtgcaccgctactaccggccagatttgacaatcccagaaatccccccaaaacgcggtgagttaaaaactgagttgctcggactgaaagaacgtaagcataaaccgcaggtgtcccagcaggaagaactgaagtag

SEQ ID NO: 5872 - DNA, 1287 bp, Artificial Sequence
  Description of Artificial Sequence: Synthetic coding sequence
atgaaacctatgctgaaagacttctctaacctgttgttggtcgttctttgtgactatgtgctcggtgaggcggagtatctactattacgggagcccggccatgtggctctgagcaatgacacggtctacgtggattttcagtatttcgatggcgcaaatggcactctgagaaacgtgtccgtgctcctactagaagcaaataccaatcagacggttaccacaaagtatttgctcacaaatcagagccagggcactttgaagttcgaatgtttctacttcaaggaagctggtgactattggttcactatgaccccagaggccactgataactccacaccatttccttggtgggagaagagtgccttcctgaaagtggagtggcccgtgttccacgtagacttaaatagaagcgctaaagcagcggagggcacttttcaggttggactgtttacgtctcaaccgctgtgtccttttcctgtagataagccaaacatagtggtggatgttatcttcacaaatagcttaccagaggctcggcgcaatagcaggcagcccctggagatcagaaccagcaagaggaccgaactggcgcaaggacagtgggtcgaatttggatgtgccccactggggcctgaagcttatgtgacagtcgtactgaaacttttgggtcgagactccgtgattacctccactggcccgatcgacctggcgcaaaagtttgggtacaagcttgtaatggtgccagagttgacttgtgaatcaggcgtggaggtcaccgtgctcccacccccctgcacgttcgtacagggtgtggtgacagtgttcaaggaggcgccacgctatcccggcaaacggaccattcatctcgcagagaattcgttgcctctgggtgagcgtcgtactatctttaactgcactctctttgatatgggaaaaaacaagtattgctttgacttcggtatctcttcaagaagccactttagcgctaaagaagagtgtatgttgatccaacgcaatacagagacttggggtctgtggcaaccatggtcccaatgttccgctacctgtggtgatggcgtgagggaacggcggagggtatgcttgacatcattccctagctcaccagtatgccctggaatgtccttagaggcctccctgtgctctctcgaggaatgcgctggccggtttcggagctgctgtcccggttggtcagcaatggttcgatccaggctgactaactctgcttcacgggtgcaggccattctgctccctcagccccttgcatag

SEQ ID NO: 5873 - DNA, 312 bp, Artificial Sequence
  Description of Artificial Sequence: Synthetic coding sequence
atgaaactctgtgtgacggtcctgtccctacttgtgttggtggctgccttttgcagtctggcgttaagcgcacctatggggagcgacccgcctaccgcctgttgcttttcttatacagctagaaagctacccagaaactttgtggtggattattacgaaactagctcactgtgttctcaacctgcggttgtctacagggagtccgcatcctcggcagcacctggcaggataccgtccacgcgagctgctcctcacggaccctggtccggtcgtggtaggtgcctgccccaggcacgggataaggccagatag

SEQ ID NO: 5874 - DNA, 279 bp, Artificial Sequence
  Description of Artificial Sequence: Synthetic coding sequence
atgaaactgtgcgtgacagtcctcagcctcttagttctcgtcgccgccttttgctcactagcactctcagcgccaatgggctcagacccacccactgcttgctgtttcagctacacagccaggaagctcccccgcaatttcgttgtggattattacgagacatcgagcctatgctcccaaccagctgtgccctgggatagcaacctgggaaagcaggtgtgcgcagatccttcggaaagctgggtacaggagtacgtttatgacctcgagctaaattag

SEQ ID NO: 5875 - DNA, 282 bp, Artificial Sequence
  Description of Artificial Sequence: Synthetic coding sequence
atgcaggtcagcacagcagccctggcagtgctgttatgtacgatggccttgtgcaatcaggttttatctgctccactggctgctgatactccaaccgcttgctgtttctcatatacatctcggcaaatcccacagaactttatagccgattatttcgagaccagttcccaatgtagtaagccttccgtgattttcttaacgaagagagggcgacaagtctgtgcggatcccagtgaggagtgggtgcagaaatatgtgtccgatttggagctgagcgcttag

SEQ ID NO: 5876 - DNA, 1869 bp, Artificial Sequence
  Description of Artificial Sequence: Synthetic coding sequence
atgggaaaatccgagggacccgtgggtatggtggaaagcgccggccgcgcgggacaaaaaaggccaggctttttagaggggggcttactcttgctgctgctgctggtcacagccgcgttagtagcactgggagtgctctatgccgatcgccggggaaagcagctgccacggttggcctcacggttatgtttcctgcaggaggaacggacctttgtgaagaggaagcctagaggaatcccggaggcccaggaggtgagcgaagtgtgcacaactccaggttgcgtaatcgcagctgcacgaatactacagaacatggatcccactacagagccatgtgatgacttctaccagttcgcgtgtggtggatggctgagacgccacgtgatcccagagacgaatagccgctactccatctttgacgtgctgcgggatgaactggaagttatactgaaagtggagttagagacccagctagccaaggccactgttccacaggaggagaggcatgatgtaattgccctgtatcataggatgggtctcgaagagctgcaatcacagttcggcctaaagggatttaattggacactgtttatccaaaccgtgttatctagcgtcaaaattaaattactgcccgacgaggaggtggttgtgtatggcatcccctacctgcagaacttggagaacattatcgacacctacagtgctagaaccatacagaattacttagtttggcggctagtactcgaccgcattgggtctctttcccaacgctttaaggatactagggttaactaccgcaaggcccttttcggaaccatggtagaggaggtccgttggagggaatgcgtggggtacgtgaattcaaatatggaaaacgccgtggggtcactgtacgttcgtgaagcattcccgggggactccaaatcgatggtccgggaactcattgataaggtccgcactgtgttcgtggagaccctggacgaactggggtggatggatgaagagtccaagaagaaagcgcaagaaaaggcgatgagtatccgcgagcagattggccacccagattacattctcgaggaaatgaatcggaggctagatgaagagtactctaatctgaatttttcggaggatttgtattttgaaaacagcttgcagaatttaaaggtgggggcacagcgctctctgaggaaactaagggagaaagtcgatcccaacctgtggatcatcggcgccgctgtcgtgaatgccttctactccccaaaccgaaaccagatcgtgtttcccgcagggatacttcagcctccctttttcagcaaggagcagccccaggcactgaactttggcggcatcggtatggtcataggacacgaaatcactcacggcttcgacgataatggaagaaactttgataaaaatggaaatatgatggactggtggtccaatttcagtacacagcattttcgtgaacaatcagagtgcatgatctaccagtacggcaactattcatgggatctcgccgacgagcagaatgtgaatggcttcaataccctaggcgaaaatattgcagataacgggggagtgcgtcaggcctacaaggcttacttgaagtggatggccgaaggcgggaaagatcaacagctgccaggcctagacctcacccatgagcagctgtttttcatcaactacgcacaggtctggtgcggttcctacaggccagaatttgcaattcagagcataaaaactgatgtgcattcgcctttgaaatatcgcgttctcggttctttgcaaaaccttgcggcatttgccgacacattccattgcgcccgggggacccctatgcatccaaaggagcggtgcagagtatggtag

SEQ ID NO: 5877 - DNA, 2340 bp, Artificial Sequence
  Description of Artificial Sequence: Synthetic coding sequence
atggggaagtccgaaggacccgtagggatggtggagtcagcagggcgggctggccagaagagaccagggttcttggaaggcggactccttcttctcctgctgctcgtcacagcagccctagtggccctgggggtcctttatgccgacagacggggcaaacagcttcccagactggcgagccggctgtgctttctccaagaggagaggaccttcgtgaaaagaaaaccaagaggcatcccagaggcccaggaggtctccgaggtatgtacaactcctggatgtgtcattgctgcggctcgaatccttcagaacatggacccaaccacagagccctgtgatgacttctatcagtttgcttgcggtggctggctccgtcgtcatgtcatccccgaaaccaatagccgctattccattttcgatgtacttcgcgatgagctggaggtgattctcaaggctgtgttggaaaattctaccgcaaaggacaggccggctgtcgaaaaagcccgcacgctgtaccggtcttgtatgaaccagtccgtgatagaaaagcgtggtagtcagccactgcttgacattctggaggtggtgggcgggtggcccgtagcaatggatagatggaacgaaacagttggtctcgagtgggagctggagagacagttagcccttatgaactctcagtttaaccggagagtgttgatcgacctgttcatatggaatgatgaccagaacagctccagacacatcatctatattgatcaacccacactgggtatgcccagtcgggagtattattttaacggcggtagcaatagaaaagtgcgggaagcttatctgcaattcatggtttctgtcgccacattgctgcgcgaggacgccaatctaccccgggacagctgcctggttcaggaagatatggtacaggtactggaactcgaaacacagcttgccaaagctacagtgcctcaggaggagaggcatgatgtcattgccctctatcataggatgggattggaagagctgcagtctcagtttgggcttaagggcttcaattggaccctgttcatccagacagtactgtcatccgtcaagatcaagctccttcccgatgaagaggtggtggtctatgggataccgtacctacagaatctggaaaacattattgacacctattcagcgcggactattcaaaattacctggtctggcgccttgtgcttgatcggattgggtcccttagtcagagattcaaagacacgcgggtgaactatagaaaagccttgtttggaacgatggtagaggaagttcgctggagggaatgtgttgggtatgtgaattcaaatatggagaatgcagtaggaagcctctatgtcagggaggcatttcctggggatagcaagagtatggtgagggaactgattgacaaagttcgcacggttttcgtggaaactctggacgagttgggctggatggatgaggagagcaaaaagaaggctcaagaaaaagccatgtcaattagggagcagattggacatcccgattacatcctggaagagatgaaccgccggctggatgaagagtactccaatctgaacttttccgaggatctgtacttcgagaactcgttgcaaaatctcaaggtgggtgcccagaggagcctgcgcaagctccgagagaaagtggatccaaatctgtggataattggagcggccgtggtcaatgccttctactctccaaacagaaatcagatagttttccctgccggcatcctgcagccacctttcttttccaaggaacagccccaggcacttaactttgggggcatcggtatggtgataggacacgagataacgcacggattcgacgacaatgggaggaacttcgacaaaaacggaaacatgatggattggtggagcaattttagtacccaacactttagagaacagtcagagtgcatgatctaccagtacggaaactactcttgggatctggccgacgagcagaatgtgaatggctttaatactctgggagagaacattgctgataatggtggagtccgacaggcatataaggcctatttgaagtggatggccgagggcggtaaagaccagcaactgcccggtttggacctgacccacgaacagctgttcttcataaattacgctcaggtgtggtgtggaagctaccggcccgagtttgccatccagagtataaagaccgacgtgcacagtcccctaaaataccgggtgctgggcagccttcagaatctggctgcgtttgctgacacctttcactgcgcccggggaacccctatgcaccctaaggaacggtgtagagtctggtag

SEQ ID NO: 5878 - DNA, 258 bp, Artificial Sequence
  Description of Artificial Sequence: Synthetic coding sequence
atgtccgtacacatgcctgctatgaaaatctgcgagaaactcaaaaagctggattcgcaaatctgtgaacttaagtatgaaaaaacgctggaccttgctagtgtggacctccggaaaatgagagtcgcggagctcaaacagatcctacactcatggggggaagagtgcagggcctgcgccgagaagaccgactacgtaaaccttattcaggagctcgccccaaagtatgctgccacacatcctaaaacagaactgtag

SEQ ID NO: 5879 - DNA, 657 bp, Artificial Sequence
  Description of Artificial Sequence: Synthetic coding sequence
atgggcagggtattcctgacaggcgagaaagccaacagcatcttgaagcggtaccctagagccaatggattttttgaagaaattaggcagggcaatatcgaacgggaatgcaaagaggagttttgcacatttgaggaggcgagagaagctttcgagaacaatgaaaaaactaaagagttctggagcacttatacaaaggcccaacagggagagtccaatcgcggctccgactggttccagttctacctgactttccctctcatatttggactgttcataatcctgctggtgattttcctgatttggcggtgctttctgagaaacaaaaccaggcggcagactgtgaccgagggacacataccctttcctcagcacctgaatatcattacaccgcccccacctcctgatgaggtctttgattccagcggcctgagccccggttttctgggttacgtggtcggccgcagcgacagtgtgtccacgagactgtccaactgtgaccccccacccacctacgaggaggccacaggtcaggtgaatctacaacgctccgagactgaaccacacttggatcctccgcctgagtatgaagacatcgttaatagcaatagcgcttctgccatacctatggttcctgtggtcactactatcaagtag

SEQ ID NO: 5880 - DNA, 1365 bp, Artificial Sequence
  Description of Artificial Sequence: Synthetic coding sequence
atggctcggcctaacaaattcctgttgtggttttgctgcttcgcctggctatgctttcccatttctctgggctctcaggcgagtggcggggaagcccagatcgccgcctccgcagaactggagagtggagctatgccatggtcactgttgcagcacatcgatgaacgcgacagagccggcctcctgcctgctctattcaaagtgctgagcgttggacggggtggttctccacgcctgcagccggattcaagggccctacattacatgaagaaattatataagacatatgcaactaaggaaggcatccccaagtcgaatcgaagccatctgtataacactgtcaggctgtttaccccctgcacaagacataaacaggctccaggagaccaagtgacaggtatactcccaagcgtggagttactgttcaatctcgacaggatcacgaccgtggagcaccttttaaaatccgttctgctgtacaatatcaacaacagcgtttccttctcctctgcagtaaaatgtgtgtgtaatctaatgatcaaagagcccaagtctagctcacgcacgctcggacgggctccatactcttttactttcaatagtcaatttgagtttgggaagaagcataaatggatacagatcgacgtgacctctctgttgcagcccctagtcgcaagcaacaagaggtcaattcacatgagtataaactttacatgcatgaaagatcagctcgaacacccgtccgctcagaatggcctcttcaatatgactctagttagtccctctctaatcctttacctgaacgacacgagtgcgcaggcatatcactcctggtattccttgcattataagcgccgccctagccagggcccggaccaggagcgttccctgtccgcttatcctgtcggcgaagaggccgctgaggacggaaggtcatcgcatcatcgacacagacgaggccaggagacggtgagttcagaactgaaaaaacctctgggccccgcctccttcaacctgagcgagtactttaggcagtttttgctgcctcagaatgaatgtgagctgcacgatttccggctgagttttagccagctgaaatgggataattggattgtggccccacaccggtataaccctaggtattgtaagggtgattgtcctagggccgtgggccataggtatggtagtccggttcacactatggtccagaacatcatttacgagaagctagatagctctgtcccccggcccagctgcgtccccgctaagtactctccactcagcgttcttaccatagaaccggatggttcaatcgcctacaaagagtacgaagatatgattgctactaagtgcacctgccggtag

SEQ ID NO: 5881 - DNA, 417 bp, Artificial Sequence
  Description of Artificial Sequence: Synthetic coding sequence
atgacatggaggcaggccgttctgctgtcttgtttctcagcagttgtactactgtccatgctccgagaggggactagtgttagtgtgggtaccatgcagatggctggggaggaggcctcagaggacgcgaaacaaaaaatcttcatgcaggagtcagatgccagcaatttcttaaaaagacgaggtaaaagaagccctaagtcccgtgacgaggtgaatgtggaaaacaggcagaaactgcgggtcgatgagctgaggcgggagtattatgaggaacaaagaaacgaatttgaaaacttcgtcgaggaacaaaacgatgaacaggaagagcgatcaagggaggctgtggaacaatggcgtcagtggcactatgatggcctgcaccccagctatctctacaacaggcaccacacctag

SEQ ID NO: 5882 - DNA, 729 bp, Artificial Sequence
  Description of Artificial Sequence: Synthetic coding sequence
atggctctgaagaacaagtttagctgcctctggattcttggcctgtgtcttgtagccacgacctcgtccaaaattccgagcataactgatccacattttatagacaactgcattgaagctcacaatgagtggcgcggaaaggtaaatcctccagccgcagatatgaaatacatgatctgggacaaaggattagctaagatggcaaaagcttgggccaatcaatgtaaattcgaacacaatgattgcctcgacaagtcctacaagtgctacgcggcctttgaatacgtcggtgaaaatatttggctgggggggattaagagtttcacgccacgccatgctataactgcctggtacaacgaaactcagttttatgatttcgactctctgagctgtagtcgagtttgtggccattatacccagttagtgtgggcgaattcattttacgtaggttgtgccgtggcaatgtgtcccaacttaggcggagcaagcactgcaatttttgtgtgtaactacggccccgcaggcaattttgcgaacatgcccccgtacgtgagaggggaaagctgtagtttgtgctcgaaggaagaaaaatgtgtaaaaaacctgtgtcggactcctcaactcattatccccaatcagaatccttttttaaaaccgaccggcagggccccacagcagactgctttcaacccgtttagcttgggattcctccttctgcgtatcttctag

SEQ ID NO: 5883 - DNA, 813 bp, Artificial Sequence
  Description of Artificial Sequence: Synthetic coding sequence
atgctgaggcaattgctgctcgcagctctctgtttagccggccccccagcacctgctcgtgcttgtcagctgcccagtgagtggcgaccccttagcgaaggctgccgcgccgagctcgctgagactatcgtatacgcacgcgtgctcgcacttcacccagaggctccgggtctctacaaccacctaccctggcagtatcacgctggccagggcgggttattctactccgccgaggtcgagatgttatgcgatcaagcgtggggatctatgctggaagttcccgctggttcacgtcttaatctgacgggtctgggatacttctcatgccattcacatacagtggtgcaggattactcgtatttcttcttcctcaggatggatgagaactataacctcttgcctcatggcgtgaactttcaggacgccatcttcccggatacacaggagaatcgccgcatgttctcctccctgtttcagttttccaattgcagtcagggccagcaacttgcgaccttcagcagcgactgggagatccaggaggattcccgccttatgtgttctagcgtccagaaggctctgtttgaagaagaggatcacgtgaaaaagctccagcaaaaagtcgccaccctggagaagcgaaatcgtcagttacgcgaacgggtcaagaaggtcaagagaagccttagacaggcccgtaagaaaggacggcacctggagttagcaaaccagaagctgtctgagaagcttgcggcaggagcgctgccccacatcaacgccagagggccggtgcgaccaccgtacttgcgcggctag

SEQ ID NO: 5884 - DNA, 438 bp, Artificial Sequence
  Description of Artificial Sequence: Synthetic coding sequence
atggacgagaactacaatctgttaccacacggcgttaactttcaggacgcaattttccccgacactcaggaaaataggcgaatgttttctagtctcttccagttctcgaattgcagccaaggacagcaactagccacctttagttccgactgggaaattcaagaagatagtcggcttatgtgctcatcggtgcagaaagcactgtttgaggaggaagatcacgtgaagaagctgcagcaaaaagtggccactttggagaaacgcaatcggcagctccgtgagagggtcaagaaggtgaagcggtcactgcgccaagcaaggaagaaaggccggcacttggaactggcgaaccagaagctgagcgaaaaactggcagcaggtgcactaccgcatattaacgccagaggtcctgtgaggccaccttatctgcgtggctag

SEQ ID NO: 5885 - DNA, 1830 bp, Artificial Sequence
  Description of Artificial Sequence: Synthetic coding sequence
atggagttgggctgctggacacagcttggtctcaccttcctccagctcctgctgatcagctcgctccctagagagtacacagtgataaacgaagcatgccccggggccgagtggaatatcatgtgccgggagtgttgcgaatatgaccaaatcgaatgtgtgtgtcccggaaaacgagaagttgtcggctacacgatcccatgctgccgaaatgaggaaaatgaatgcgacagttgtttgatccacccaggatgcaccatctttgagaattgtaaaagctgtcgtaacgggtcgtggggcggcaccttagacgatttttatgtaaaggggttttattgcgcagaatgccgcgctggatggtatggaggggattgtatgccctgctcttcatctccttgtttccatgacggtacctgtgtcctggacaaagccggcagctataagtgtgcctgcttagccggctacacaggccaacggtgcgagaatctgctggaggagcggaactgcagtgatcccggcggtccagtgaatggctaccaaaaaatcaccggaggtcccggactcattaacgggagacacgcaaaaattggcaccgttgtctcattcttctgtaacaatagttacgttctaagcggaaatgaaaagagaacctgtcagcaaaatggagagtggagcggaaagcagcccatatgtataaaagcgtgtcgcgagcctaaaatttcagacctggtacgacggcgcgttctgccaatgcaggtgcagtccagggagactccgctacaccagctttatagtgccgccttcagcaaacagaaacttcagagcgcccccaccaaaaagcccgccctgcccttcggggatttacctatgggataccaacacctccacacccagctgcaatatgaatgcatttctcccttctaccgcaggctcggctcaagccgcagaacctgcctaaggactggaaaatggagcggcagggctccttcatgcatccccatttgcgggaagatcgaaaatattacagcccctaaaacccagggtctccgatggccttggcaggctgctatctaccgcaggacaagtggcgtgcacgatgggagtctccacaaaggagcctggttccttgtgtgttccggcgcccttgtcaatgaaagaactgtcgtggtcgccgcccattgcgttaccgacctgggcaaggtaacaatgatcaagaccgccgacctgaaggtcgtgttagggaaattttacagagatgatgatcgcgacgagaagaccattcaatccctgcaaatttctgccattatactgcacccaaattatgaccccattctcctcgatgccgacatcgctatcctgaaattgctagacaaggccaggatcagtacaagggtacagccaatttgcctggcagcatcccgcgatctgtcaacctcgttccaggagtcacacatcacagtggccggttggaacgtgctagcagatgtgcgttcacccggcttcaagaacgataccctgcgtagcggagtggtgagcgtggttgacagcctgctctgtgaagagcaacacgaagatcacggtattcccgtatccgtgacagacaatatgttctgcgcctcttgggaacctactgcaccttctgacatctgtactgctgagacaggcggaattgctgcggtgagctttcccggccgcgcttctccggaaccgcggtggcatctgatggggttagtgagctggtcttatgataaaacatgcagccaccgcctcagtaccgcctttacaaaagtcctgcccttcaaggattggatcgagcgcaacatgaagtag

SEQ ID NO: 5886 - DNA, 2163 bp, Artificial Sequence
  Description of Artificial Sequence: Synthetic coding sequence
atggaactgggttgctggacacagctgggcctgacctttttgcaactcctgctaatctcatcccttccaagagagtatacagtgatcaatgaagcctgtcctggagccgagtggaatataatgtgccgggaatgttgtgagtacgatcaaatagaatgcgtgtgccccggcaaacgggaagtggttggatacacgataccgtgctgcagaaacgaagaaaatgaatgcgattcatgcctcattcatccaggatgcaccatctttgaaaattgcaagagctgtcggaatggtagttggggcggaacgctggatgatttctatgtgaaggggttctattgcgccgaatgccgcgcaggttggtatggcggtgactgcatgagatgcggacaagtcctccgcgcaccaaagggacagatcctgctcgaaagttatccactgaacgctcactgcgagtggaccatccatgctaagcctggctttgtaatacaactcaggtttgtcatgctttctctggaatttgactacatgtgccaatatgactatgtggaggttcgcgatggagacaatcgggatgggcaaatcatcaagcgggtgtgcggaaacgaaaggcccgctcctatccaatccatcggaagttctctgcacgtgctcttccacagcgacgggtcaaaaaatttcgacggattccacgcgatatacgaagaaattactgcctgctcttcttcaccatgctttcacgacggcacctgtgtgctggacaaagctgggtcttacaaatgtgcctgcttagccggatatacaggccagcggtgcgagaacctccttgaagagaggaattgttctgatcctggcggccctgttaacgggtaccagaagattacggggggccctggattgatcaatggccggcacgcaaagatcggaaccgttgtttcattcttctgcaacaacagctacgtcctgtcaggaaatgagaaaagaacctgccagcaaaacggcgagtggtcaggcaagcagccaatttgcattaaagcatgcagggaacctaagatatcagacctcgtgcggcgcagagtgctcccaatgcaggttcagagccgtgaaacccccctgcaccagttgtactcagctgctttctctaagcaaaagctacagagcgcgccaacaaagaagcccgccctgcctttcggcgatctacctatgggctaccagcacctacatacacagctgcaatacgaatgcatctccccattctacaggcgcttggggtcatcccggaggacctgcctgagaacgggcaagtggtcagggagagctccaagttgtataccaatttgcgggaagattgaaaacatcacagctcctaagacacagggcctgaggtggccctggcaggcagcgatatatagaaggacttccggcgtccatgatggaagcctgcataaaggtgcatggttcctggtgtgctccggcgctctggttaacgaaaggactgtagtagtggccgctcactgtgtaacggaccttggaaaggtcacaatgattaagactgccgacttgaaagtcgtgctcggcaaattctaccgggatgatgatagggacgaaaagactatccaatccctgcaaatctctgccattatcctgcaccctaactacgaccccatcctccttgatgctgacattgcaattttgaagctcctcgataaagctaggatcagcaccagggttcaacccatttgtctggcagctagccgagacttgagtacctccttccaggaaagccacatcaccgtcgctggatggaacgtgctcgccgacgtgcgttcccctggcttcaagaacgatactctacgctctggcgttgtgtccgtggttgactccctcctgtgtgaagaacagcatgaagaccatgggatacctgtgtccgtgaccgataatatgttctgtgccagctgggaaccgaccgccccctctgacatctgtacggctgagacgggcggcatcgccgctgtgtcgttccccggaagagccagccccgaacccaggtggcacttgatgggcctcgtgagttggtcctacgacaagacatgttctcacagactgtctactgcttttaccaaagtccttccctttaaggactggatcgagcggaacatgaagtag

SEQ ID NO: 5887 - DNA, 1134 bp, Artificial Sequence
  Description of Artificial Sequence: Synthetic coding sequence
atggaggctctcctcttaggcgccggcttactgttaggggcgtatgtgctggtgtattacaaccttgttaaggctccaccttgcgggggtatgggaaatctgagaggaaggaccgcagtcgtgaccggtgcaaacagtggaatcggtaaaatgactgcgctggagctggccaggcgcggagcgagagtggtactggcttgcagatcacaagagaggggcgaagccgcggcttttgacttacgccaggaaagcggtaacaacgaggtcattttcatggcactggacctggctagcctcgcctctgtgcgagccttcgctacagccttcttaagctccgaacccaggttggatatactaatacataacgcaggcattagtagttgcggacggacccgggaagcttttaacctgcttctgcgcgtcaatcatatcggaccgtttctgctcactcacttgctccttccttgtctcaaagcttgcgcccccagccgggtcgtcgtcgtcgcttctgccgcacattgcaggggccgcttggactttaagagattagaccggcccgttgtgggatggaggcaggagctccgggcttatgctgataccaagctggccaacgtgttgttcgcccgtgaactggctaaccagctggaagccacgggtgtaacctgttacgccgcccatccgggacccgttaatagcgaactcttcctccggcacgtgccagggtggctacggcctttgttaaggcccctggcatggttagtgctgcgggccccaagagggggagcacaaacacccctctattgtgccttgcaagaggggattgagccactctctggtaggtacttcgccaactgccacgttgaagaagtaccccccgctgccagagacgatcgtgccgcccaccgattgtgggaggccagcaagcgtttagccgggctcggacccggggaagatgcggagcccgatgaagatccccagagcgaggatagcgaggcaccaagcagcctgtctacacctcaccctgaggagccgacagtatctcagccctacccatctccccagtcaagtccagatttaagtaagatgacacatcggattcaggcaaaggtagagccagaaattcagttaagttag

SEQ ID NO: 5888 - DNA, 381 bp, Artificial Sequence
  Description of Artificial Sequence: Synthetic coding sequence
atgatcagtttccatgtgatctttctgagcctgggtagagggaagctcttcctacctgtcaacttctgcttcctgaaactgaaaaatagccaggttcggatacctaaagattttacatgcaacttgcacgtcttatttcggaccgtacagggcgaagaccgaaacacaatgttccggggccactggtccatttatagtcggaattttccattggctgtagtgccagcctatgtgaccgaagatgggaagaacacaagtcaccgggcgagcggccaattctgtaatgctttgtcccaaggtgagatacctagcagtctgcagctggtgaatagctacgccctggaaccccgcacggatatgccatgcaatttccttacgtag

SEQ ID NO: 5889 - DNA, 876 bp, Artificial Sequence
  Description of Artificial Sequence: Synthetic coding sequence
atggccgtcacactgtccctattgctggggggccgagtttgtgccgctgttacaagatgcggctttgctacgcggggggtagctggtccaggacctattggcagagaacccgaccctgatagtgattgggaaccggaagagagagaacttcaagaggtggagagtacacttaaacgccagaagcaagccattcgatttcaaaagattcgccgacagatggaggcaccaggggcccccccaagaacactcacctgggaagccatggagcagatccgataccttcatgaggagttcccagagtcatggagtgtcccccgcctggctgagggatttgatgtttcaaccgatgtaattcgaagggttctcaagagtaaatttctaccaacgctagagcagaagctcaaacaggatcagaaagtgctgaagaaggctggtctcgcccactcccttcagcatttgcggggctctggcaatacgagtaaactgttgcccgccggccacagtgtatcgggcagcttgttaatgccgggccacgaagcaagtagtaaagatccaaaccactctaccgccttaaaagtcattgagagtgatacccatcgcaccaatacaccgcgccggcggaagggccggaacaaagaaatccaggacctcgaggagtctttcgtcccagtggccgccccactgggccatccccgagagctccagaaatacagctctgacagcgaatccccacgcggcaccggctccggcgctcttccttcaggtcagaagctggaagagctaaaggccgaggagccagacaacttctcttcgaaagtggttcagcgtgggcgcgaattttttgatagcaacggtaatttcctgtatcggatttag

SEQ ID NO: 5890 - DNA, 2541 bp, Artificial Sequence
  Description of Artificial Sequence: Synthetic coding sequence
atgttcaagtgttggagtgtcgtgttggtcttggggttcattttcctggaaagtgagggtagacctactaaggagggcggatacggtctgaaatcttatcaacctctgatgagactacgccataaggagaaaaatcaggaatcttcccgtgtcaagggcttcatgattcaagacggtccattcggaagctgcgagaacaaatattgtggccttgggaggcattgcgtgacttcccgggagaccgggcaggccgagtgtgcttgtatggatctttgtaaacgccactacaagccagtctgcggttcagacggtgaattttacgagaaccactgcgaggtgcatagagctgcctgcctcaagaagcagaagattaccatcgtgcacaatgaggattgtttttttaaaggagacaaatgcaagacaacagaatattccaaaatgaaaaatatgctccttgaccttcagaaccagaaatatattatgcaggaaaacgaaaatccaaatggggatgatatcagtaggaagaagctgctagtggaccagatgtttaagtattttgacgcagatagcaacgggctagtggacattaacgagcttacacaggtgattaagcaggaagagctgggcaaggatctgttcgattgcacgttgtacgttctgctgaagtacgacgattttaatgctgacaaacaccttgccctggaggaattctatagagcatttcaggtgatccaattgtcattgcctgaggaccagaagttgtcaatcacggccgctacagttggccagtcagcagtgctttcctgtgccatccaggggacactccgcccccccataatttggaaacggaacaacatcatcttgaacaacctcgacttagaggatataaatgatttcggcgacgacgggtctctgtatattacaaaagtcaccacgactcatgtgggaaattacacttgttacgctgatggttacgagcaggtttatcaaacacatatcttccaggtgaacgtgccccccgtgatcagagtctatcccgaaagtcaggccagagagcctggcgtgactgccagcttgcgctgtcacgctgaagggattcctaaacctcagctgggctggctgaagaacggcatagatattacaccaaagctgtccaaacaactcaccctgcaggccaatgggtcggaggtccacatttcaaacgtgaggtacgaggatactggggcttacacatgcatcgcaaaaaacgaagccggcgtggatgaggacatctctagtctgttcgtggaggattccgctcggaagacactggcaaacatcctgtggagggaggaaggactgggcatcggtaatatgttttacgtgttttatgaagacggcatcaaagttattcagccaatcgagtgcgaattccaaaggcacatcaagcccagtgagaagctgttgggctttcaggacgaggtgtgtccaaaagctgagggagacgaggtccagaggtgcgtctgggcttctgccgtaaacgtgaaggacaagttcatttacgtagctcagcctaccctggatagagttctgatagtcgacgtgcaatcccaaaaggtcgtgcaggctgtatctactgacccggtcccagttaagctccactacgacaagtcccacgatcaagtgtgggtgctcagctggggcaccctggagaagacctcacctactctgcaggtgatcacactcgcctcaggaaacgtgccacaccacacgattcacacacaaccagtgggcaaacaattcgacagagtagatgatttttttattcccacaacaactctaattatcacccatatgcggttcggatttatattacataaggacgaagcggcacttcaaaagatagatttggagacaatgtcctatattaagacaatcaatctcaaagactataaatgcgtaccgcagtctctggcttacactcatcttggcgggtactacttcatcggctgcaaacctgattccacgggggccgtgagtccccaagtgatggtggatggagtgaccgattccgttatcgggtttaattcagacgttacaggcaccccatatgtcagccccgatgggcactacttagtgtcaattaatgacgtaaaggggctggtgcgtgttcaatacatcactattcggggcgagattcaggaggccttcgacatctacaccaacctgcatatatcggacttagctttccagccatccttcaccgaggcacaccagtataacatctacggctcaagctctactcagactgatgtgctgtttgtggaattgtccagcgggaaagtcaagatgatcaaatctctcaaagagcctctcaaagccgaggagtggccttggaacagaaaaaatcgtcagatccaggatagcggtctctttggacagtacctgatgaccccttctaaagacagcctgttcattctggatggcaggctgaacaagcttaactgtgaaattacggaggtcgagaaaggtaacaccgttatatgggtcggcgatgcttag

SEQ ID NO: 5891 - DNA, 291 bp, Artificial Sequence
  Description of Artificial Sequence: Synthetic coding sequence
atgagggtcaccagcgccacatgtgcattactgttggccctgatatgctcagtgcagctgggggacgcatgcctggacatagacaaactgttagccaacgtggtgttcgacgtgagtcaggacctgctgaaggaggagctcgctcggtataaccccagtcccctcaccgaggaatctttcctgaacgtgcagcagtgcttcgctaatgtctctgtgacggagagattcgcccactcagtagtgattaagaaaatcctacagagtaacgattgtattgaagctgcattctag

SEQ ID NO: 5892 - DNA, 1971 bp, Artificial Sequence
  Description of Artificial Sequence: Synthetic coding sequence
atgcgcacagttgtgctgactatgaaggcatctgtgatcgagatgttcctggtgttgcttgttacaggcgtgcactcaaacaaagagacagctaagaagatcaagcgacctaagttcaccgtgccacagattaactgtgatgtgaaagccggaaaaattatcgacccagagttcatcgtgaaatgtcccgcaggctgccaagatcctaagtaccacgtgtatggtacagatgtctatgcctcgtactccagcgtgtgcggcgccgctgtccattccggtgtccttgataactccggtggaaaaattcttgtgcggaaagtggctgggcagagtggatacaagggaagctactctaatggagtgcagagccttagtctgccgagatggcgggagagtttcatcgtcctggagagtaaacccaaaaagggcgtgacttatccatctgcccttacctattcctctagcaagtctccggcggcccaggcaggggagacaaccaaagcctatcagcgcccccccataccaggcacaacggcccagccagtaacccttatgcagctcctcgccgtgactgtagctgtcgcgacaccaacgactctcccaaggccatctccaagtgcggcatcaaccacctccatcccaaggccacagtccgtcggccataggtcccaagagatggacttgtggagcactgcaacttatacctcctctcagaacagacctagggccgaccctggactagtgcccaaagaagaattaagcactcagagtctggagccagtatcactcggtgatccaaattgcaagatcgacctttctttcctgattgacggctctacatcaattggaaagcgcagattcaggatccaaaagcagcttcttgccgatgtggcccaagcactcgacattggaccggccggaccattgatgggagtcgtacagtatggggacaacccagctactcatttcaacttgaaaacacacacgaatagtcgcgacctcaagaccgccatcgagaagattacacagcgcggcggcctctcaaatgtgggccgagcgatttccttcgtaacaaagaactttttctccaaggccaacgggaatcgtagtggagccccaaacgtcgtcgtggtgatggtggacggctggcccacagataaggttgaggaggcttcacggctggcccgcgaatctggcattaatatcttttttataaccatcgaaggagctgcagagaacgaaaagcaatatgtggttgagcctaatttcgccaataaagctgtgtgccgcactaacgggttctatagcttgcatgtgcagtcatggttcggcctccataaaaccctccagccattggtcaagcgggtctgcgacaccgatcggttggcctgtagcaagacgtgtctaaatagcgccgacatcggtttcgtgatcgatggctccagttctgtgggcaccggaaattttaggactgttctgcaattcgtgacgaacctgacgaaagagttcgagatctctgatacagatacccggatcggtgccgttcaatatacgtatgagcagagactggagtttgggtttgacaagtatagtagcaagcctgatatattaaatgccatcaagcgagtcggctactggagtggaggcacgtcgacaggtgcggccattaattttgcgctagagcagctttttaagaagtcgaagccgaacaaacgcaagctgatgatactgattaccgatggtcgctcttacgacgatgtccggatccccgccatggctgcccatctcaagggtgtgattacatatgccattggagtcgcttgggccgcacaggaagaattggaagtgattgctacccaccccgccagggaccattcgttcttcgtcgatgaattcgataatctccaccagtacgtgccacgtattatccagaacatatgcacggagtttaattcacagccacgaaattag

SEQ ID NO: 5893 - DNA, 2082 bp, Artificial Sequence
  Description of Artificial Sequence: Synthetic coding sequence
atgcgaaccgtggtcctgactatgaaggcatccgttatcgagatgtttctcgtcctgctggttactggagtccacagtaataaggaaacagctaagaaaattaagcgtcccaaatttactgtgccacagataaattgtgatgttaaagccggcaagattatcgacccggagtttattgttaaatgtccagcaggctgccaggatcctaagtaccacgtttacgggactgacgtctatgctagctactcaagcgtgtgcggggcagccgtgcattcaggcgtgctcgacaattcaggaggaaaaatcttagttcgaaaggtggcgggacaaagtggctataagggttcttacagtaacggcgtccagtcactaagccttccccggtggcgagagagctttattgttctggagtcaaagcctaaaaaaggagttacttatcctagcgctctcacatatagcagctcaaaatctcctgccgcacaggcaggcgagacgaccaaagcttatcaaaggcctcctatacctggtacgacagctcagccagttactttgatgcagctcctggccgtgactgtggccgtagctacaccaactacgctgcctaggcctagcccaagcgctgcgtccacaacctccatcccccgacctcagtcagtgggccatagatcccaagaaatggatctctggagcaccgccacttatacctctagtcaaaaccgtccaagggcagatcccggcatccagcggcaggacccctccggtgccgcgttccagaagccggtcggagccgacgtttctctgggcgaaatggacagctggaagcctggttcagttctgctggatgagggcctggttccaaaagaggagttgtcgacacagtctctcgaaccggtcagccttggtgaccccaattgcaaaatcgatctttcgttcctgatagatggttccactagcataggcaaacgacgatttaggatacaaaaacagcttctggccgacgtggcacaggcactggacataggacctgcaggccctttgatgggcgtcgttcagtacggagacaatcccgctacccattttaatctgaagactcacactaattccagggacctcaagacagccatcgagaagatcacccagcgtggggggttgagcaacgtggggcgcgccattagctttgttacgaaaaattttttttccaaagccaacggcaaccgaagcggagccccaaatgtagtggtggtgatggtggatggctggcccacagataaagtcgaggaggcatctagactggcccgggagtcaggtattaatattttttttattacaattgagggagcagccgagaatgaaaagcagtacgtcgtagaaccgaacttcgcgaataaagccgtgtgcaggaccaacggcttttactcgttacatgtgcagtcctggttcggtttgcacaagactttacagcccctggtgaaacgtgtgtgcgacacagaccgcctggcatgttcaaaaacctgcttgaattctgcagacatcggcttcgttattgacggctcaagctctgtgggcactgggaattttcgcaccgtgctccagttcgtgactaatctgacgaaggagttcgaaatttcggacactgacacgcggatcggagctgtccagtacacgtatgagcagcggctggaatttggcttcgacaagtattctagtaagcccgacatcctgaatgccataaagagagttggatattggtcaggagggactagcaccggagctgccatcaattttgccctggaacagctgttcaaaaaatctaaaccaaacaaacggaaactgatgatcttgatcactgatggaagaagctacgatgacgtccggatcccggctatggcagcgcacctgaagggtgtgattacttatgcaataggtgttgcatgggcagcgcaggaagagctggaggtgattgctacgcatcctgcaagggatcactcttttttcgtcgacgagttcgacaacctccaccagtacgtccctcgaatcatacagaatatttgcaccgaattcaacagccagccgcgaaattag

SEQ ID NO: 5894 - DNA, 555 bp, Artificial Sequence
  Description of Artificial Sequence: Synthetic coding sequence
atgttttgtttactgcatctttgcttctatctcgccaattttgctagcagtatcaagaggacacatgctgtaaatggttgttgcggcttacagatgatagccctctgggcccagtcttcaggaaatgccgacgcacgagttgaggagatactcgccggagaagagcgcaggctggccgcgctcttgggctctcaaggaatgaggttctgggtctgcttggccgcctgccgcgcaatgtggggcctggctgccaggaggggtagagccgaagattcttccagttcccctgtggatgcttcaaaattcccctggaggggcggacaacatagaaccacgatgatgccatgtctgctgcgagtaggggtgtttagaccgtgccatgtcagaccgaccggagatccatcatgtgacgtccagccaccaagactaggatttagtcgggtacctgatacccaggttgccttttatgggagcgggcactgggatcctacgccattctccgtacactcatgcttcttcaactttcaagttcggaaaatcattttcctcctatag

SEQ ID NO: 5895 - DNA, 864 bp, Artificial Sequence
  Description of Artificial Sequence: Synthetic coding sequence
atgactagtgcggcacactattatcctaagctgatgagtataatggggaatgtgctccgattcctcccagcctttgtgcgcatgaagcagctgatagaagaaggttacgtcggcgagccactcgtgtgtgaagttcaagtgcatgggggttcgttactgggtaagaaatataattggagctgcgacgacctcatgggagggggggggctacattctgttggaacatacattatcgatctgctgacatttctgacagggcagaaggctgtcaaggtacatggtctgttgaagaccttcgtgaaacagactgatcacatcaagggaattaggcagataacatccgatgacttttgcacttttcagatggtcctggagggtggcgtatgttgtactgtcactctcaattttaatgttccaggcgagttcaaacaagatgtaacggttgtcggcagcgccggtcgtctgttggctgtcggaacggatctttatggacagcgtaactccgctcccgaacaggaacttctagtgcaggatgcaactccagttagcaacagcctattacctgagaaagcttttagtgacataccgagtccatacctacgcggaactatcaagatgatgcaggccgtcagacaagctttccaggaccaggatgaccgacgaacatgggatgggagacctctgacaatggctgctactttcgacgactgcctttacgccctttgcgttgtggacacgatcaaacggagtagccagacaggcgaatggcagaatattgccattatgaccgaagaaccggaattatcccccgcatatctgatttccgaagcaatgcggcgctccaggatgagtttatactgctag

SEQ ID NO: 5896 - DNA, 1173 bp, Artificial Sequence
  Description of Artificial Sequence: Synthetic coding sequence
atgttacccggcgttggcgtgttcgggactagccttacggctagggtgatcattcccctgctgaaagacgaaggcttcgccgtcaaagccctgtggggccgcacccaggaggaagctgaggaactcgccaaagagatgtcagtgcccttttacacctcacggatcgacgaagtgctgctccatcaggacgtcgacctcgtgtgtataaaccttccgcctcctcttacacgtcaaattgccgtcaaaaccctcggcatcggcaagaacgtgatttgtgacaggacggccacgcccttagatgcattccgcatgacaagtgctgcccactactatcccaaattaatgagtatcatgggcaacgtgctacggttcctccctgcattcgtaaggatgaaacaactcatagaggagggatacgtgggggagcctttggtatgtgaagtgcaggtccacggtggtagcttgcttggtaaaaagtacaactggagctgcgacgatttaatgggaggaggtggcctgcatagcgtgggaacatacattatcgatctgcttacgttcctgactggacaaaaagctgttaaagtgcacggtctgcttaaaactttcgtcaagcaaacagaccacatcaaaggaataaggcagataactagcgacgatttctgcacgtttcagatggtcctcgaagggggtgtatgctgcacagtcacattgaatttcaatgtcccgggcgaatttaaacaggacgtgactgtggtggggtccgcaggacgcctgttggccgtgggaaccgacctatatggacaacgtaacagcgcccccgaacaggaactgctcgtgcaggacgccacgccggtctcaaattctctactccctgaaaaggcattctcagacatcccaagcccgtacttgcggggcacaatcaaaatgatgcaggcggtccggcaagcgttccaggatcaagatgaccgcaggacatgggacgggaggccattgaccatggcagcaacattcgacgattgcctatatgccctgtgcgtcgttgacacgattaaaaggagctcccagacaggcgaatggcagaacatagcgattatgaccgaggagcccgaattgtcacccgcctatttaatcagcgaggcaatgagaaggtccaggatgtctctctattgttag

SEQ ID NO: 5897 - DNA, 5718 bp, Artificial Sequence
  Description of Artificial Sequence: Synthetic coding sequence
atgcagtctcgcttgctgctcctcggagcacctggaggacacggagggccggcatccagaaggatgcgtctcctgctgagacaggtggtgcagaggagaccaggcggtgaccgacagcggccagaagtccgccttttgcacgcaggtagtggcgcggacactggagacacggtaaatataggggatgtgtcttataagttgaaaatccccaagaaccctgaattggtgccacaaaattatattagcgattcccttgcccaaagcgtagtacagcatctgcggtggatcatgcaaaaagacctgctggggcaggacgttttcttaatcgggcccccaggtcctctccgccgcagcatcgcaatgcaatacttagagctcacaaaacgggaggttgaatatatagccctgtcccgcgataccaccgagacagacctgaagcagcgcagggagatccgagcaggtaccgccttctacatagaccagtgcgctgtgagagccgccaccgagggacggacactgatcctggaggggctcgaaaaggcggagaggaacgttctccctgttctgaataatttattggagaatagagagatgcagctggaagacggacgattcctgatgtctgctgagcgctatgacaaactgctgcgggaccacaccaagaaggaactggattcctggaagatcgtgcgtgtgtcagagaatttcagagtgatcgccttgggcctgcccgtgcctcgctactcaggtaaccccctggatccccctctgagatcacgtttccaggccagggatatttattacttaccatttaaggatcaactcaagctgctgtattcaattggagccaatgtgtctgctgagaaggtttcacagcttcttagttttgcaactactctgtgtagtcaagaaagttcaacactcggcttaccagacttccctctggatagcctggccgccgccgtacagatcttggactcttttcctatgatgccaattaaacacgccatccagtggctgtacccctactctatcctgctcggccacgaggggaagatggctgtagagggtgttctcaaacgattcgagctccaggactcaggctcctcgctcctcccaaaggagatagtgaaggtagagaagatgatggaaaatcatgtctctcaagcttcggtgactattcgtatagccgataaagaagtcacaataaaagtgcccgccggtactcgactgttgtctcagccttgcgcatcagaccgatttatccagactctgagccataaacagctgcaggccgaaatgatgcagagccacatggtgaaggacatctgcctaatcggcggcaaaggatgtggcaaaacggtcattgctaagaacttcgcagatacacttggatataatattgaaccaatcatgttgtatcaggacatgactgcaagagacttactgcagcagcgttatactctcccaaacggagatacagcttggaggagcagcccacttgtgaatgctgccctggaggggaagttggtcctcctcgatggcattcacagggttaatgcgggcaccctggccgttcttcaaagacttatccacgaccgggaactgagtctttatgatgggtcaagactcctgcgtgaggacagatacatgcgtctcaaggaagagctccagctaagcgacgagcaactgcaaaaacgaagcattttcccaattcacccctcgttccgcatcatcgccctggctgaacccccagtgataggaagtacagcgcatcagtggttgggccccgagttcctcaccatgttcttttttcattacatgaagcccttggtaaagtccgaggagatccaggtcattaaggagaaagtgccaaacgtgccccaggaggcgctggacaagttgttgagcttcactcataaactgagggagacacaagatcctactgcccagtctctcgccgcatccctgtcaactagacagttgctcagaatttcacgacgcttaagccagtaccccaatgagaacttgcattccgccgtgacaaaggcctgcctgagtagattcctaccttctctcgctcggtcagccttagagaaaaacctcgcagatgccaccatcgaaattaataccgatgataacttagagcctgagctgaaggactacaaatgcgaggtgacttctgggactctacgcatcggcgccgtgagcgcccctatttataatgcacatgagaaaatgaaagtccctgatgtcctgttttatgataacatccagcacgtaattgtgatggaggacatgctcaaggactttctccttggggaacacctgcttctggttggaaatcagggtgtcggaaagaacaagatcgtggaccgcttcctgcacctgttaaacagacccagggaatacattcaacttcatagagatacaaccgttcagactttgacactccaaccgtctgtcaaggacgggcttatcgtgtacgaagactcaccactggtgaaagctgtgaagctggggcacattttagtcgtagacgaagccgataaagcgcccaccaatgtgacgtgtatccttaaaaccctcgtagaaaatggcgaaatgatccttgctgatggacgtaggatcgtagctaacagcgccaatgtcaatggaagagagaatgttgtcgtgatacaccctgacttccggatgattgtgcttgccaaccgccctggctttcccttcctgggcaacgactttttcggcacactgggggacatatttagctgtcacgcggtggataacccaaagcctcactctgagctggagatgcttaggcagtatggcccaaacgttcccgagccgatactgcagaaattagtggctgcttttggggaactcaggtcactcgctgatcagggtataattaactacccttatagcacaagagaagtggtgaacatagttaagcacttgcagaaatttcctaccgaggggctgagctcagtggtacgtaacgtttttgatttcgactcttataataacgacatgagagaaattctgatcaatacgctccataaatatgggattccaattggtgcgaaacctacgtctgttcagctcgcgaaagagctaacactccccgagcaaacctttatgggttattggaccattggccaggccagaagcggcatgcagaagctcctttgccccgtcgagacacatcacatcgatatcaaaggacccgccctcataaatattcaggagtaccccatcgagaggcacgaagagaggagcctaaacttcactgaggagtgtgcttcttggcgcatcccgttagatgagataaacattatctgtgatattgccacaagccacgaaaacgagcagaataccctttatgtcgttacctgtaaccctgcgtctctctattttatgaatatgacaggaaaaagcggattttttgtggacttctttgacatttttccacggacagccaacggcgtgtggcacccttttgtaaccgtggcccctcttggtagcccacttaagggtcaagtggtgctgcatgagcagcaatccaatgtgatcctgctactcgacactacaggtcgcgcactgcaccgcctgattcttcctagcgagaaattcacctctaagaaaccattttggtggaacaaggaggaggccgagacctacaagatgtgcaaggaattttcacacaagaactggttggtgttctacaaagagaaggggaattccttgacggtactcgatgtcttggagggacgaacacacaccatttccctccccataaacctcaaaaccgtgttccttgttgcggaggacaaatggctcttggttgaaagcaaaaccaatcaaaaatacctgctgactaagccagctcacattgaatccgaggggtcaggagtgtgtcaactgtatgtcctaaaggaggaaccccccagcacgggctttggcgtcacccaggagactgagttcagcatcccgcacaagatctcaagcgatcaactatctagtgagcatctctcaagcgcagtggagcagaaaatcgcctctcccaaccgaatcctttccgacgagaagaattacgccacaattgtcgttggctttcctgacctgatgagccctagcgaagtgtattcttggaaacgccccagctctctacacaagagatccggaacagacacctctttttatcgtggaaaaaagaagaggggcaccccaaaacagtctaactgcgtgacgctgctcgacactaatcaggtggtgcgtatcttgcccccgggcgaagtgccgctgaaggatatctatcctaaggacgttacgccacctcagacaagtggctacattgaagttaccgaccttcagagtaagaagctacgttatattcccatcccgcggagtgagtctttgtcaccctacaccacctggttatctaccatcagtgataccgatgcattacttgctgagtgggacaagtccggggtggtgacagtcgacatgggggggcatatccgcctttgggagacgggcctcgagcggctacaacgatccctaatggagtggcggaacatgatcggacaggacgaccgaaacatgcagattacgatcaatcgggattctggagaagacgtgagttctcccaagcacgggaaagaggaccccgacaatatgcctcatgtcggcgggaacacatgggcaggaggaaccgggggccgggatactgccgggttgggtggcaaaggtggtccgtaccgactcgatgctgggcacactgtctaccaggtcagtcaggctgagaaggacgccgtccctgaggaagtgaaacgcgctgcccgggagatgggacagcgtgcttttcagcagagattgaaggaaatccagatgagtgagtatgatgctgctacctatgagcgattttcaggggctgtgagacgccaggtgcacagtttgcgaatcattctcgataatttgcaggcaaagggcaaggaaaggcaatggcttcgccatcaggccactggagagcttgacgacgcaaaaatcattgatggactgaccggtgagaaggccatctacaagaggcggggcgagctggagccgcagcttggcagcccgcaacagaagcctaagagactcaggttggtggtggatgtcagcggttccatgtataggtttaacagaatggacgggcgactggaaaggactatggaagccgtgtgcatggttatggaggcgttcgagaactatgaggagaaatttcagtacgatatcgtcggccactctggcgatggctacaatatcggactcgttcccatgaacaagattccgaaggataacaagcaaaggttagagatacttaaaactatgcacgcccacagtcaattttgcatgtccggagatcacactttggaaggcaccgagcacgccataaaagagatcgtgaaggaggaagctgacgaatacttcgtgatcgtgctgtctgacgcaaatctcagtcgctatggaatccaccccgcaaagttcgcacagattctcacccgggatccacaggtaaatgccttcgctatctttataggctccctcggcgatcaagctacgcgcctccagagaactctccctgcaggacggtctttcgttgctatggatacaaaagatattcctcagatcctccagcaaattttcacatcgacaatgctgagctccgtgtag

SEQ ID NO: 5898 - DNA, 561 bp, Artificial Sequence
  Description of Artificial Sequence: Synthetic coding sequence
atggaggccctgccacttctggccgccacgactcccgaccacggcaggcatcggcgcctgttactcctgcctcttttgctgttcctcttgccagcaggagcagttcagggctgggaaaccgaggagagaccaaggactcgggaagaggaatgccacttctatgcgggggggcaggtttacccaggcgaagcttctagagttagtgtggccgaccacagtttacacttgtcaaaagccaagatctcgaagccagctccatactgggaggggaccgcggtgatcgatggtgagttcaaggagctgaaactcacagactatcgcggtaaatacctggttttctttttttacccgctagactttaccttcgtctgtccgaccgagataatcgcattcggggaccgattagaagagttccggagcatcaacaccgaggtcgtggcctgctcagtcgacagccagttcacgcacctggcttggagcgtcagctatacctatatacggagaaagaaaagaatggatttactgctgaagcacgggcagataactcttgatatgatttag

SEQ ID NO: 5899 - DNA, 816 bp, Artificial Sequence
  Description of Artificial Sequence: Synthetic coding sequence
atggaagcactgcccttgctggctgccacaacccccgaccacggaaggcacagacgcctgctgcttctgccccttttattgttcttgctccccgccggcgccgttcagggctgggaaacggaggaaaggcccaggactcgcgaggaagaatgtcatttttacgccggtgggcaggtctaccctggggaagctagtagggtcagcgtggctgatcactcccttcatctgagcaaagctaaaatctctaaacccgccccctattgggagggaactgcagtgatcgatggcgaatttaaagagctcaagctcacggattaccgcggcaagtatctggtgttcttcttttaccccttggactttacatttgtttgcccaaccgagatcatcgcttttggcgacaggctggaggagttcaggtccatcaacaccgaggttgtagcctgcagcgtggactcccaatttactcatcttgcgtggattaacactccaagaaggcagggcgggctgggtcctattagaatccctctattgagcgacttaacacaccagatctctaaggactacggcgtttacctggaggacagtggtcataccctgcggggcctgttcattattgacgataaggggattctgcgccaaatcacgctgaatgatctgccagtgggccggtccgttgatgagactctgaggctggttcaggccttccagtacacagacaaacacggggaagtgtgcccagccggctggaaaccaggctcggaaactatcatcccagatccggccggcaaactcaagtattttgataagctaaactag

SEQ ID NO: 5900 - DNA, 558 bp, Artificial Sequence
  Description of Artificial Sequence: Synthetic coding sequence
atggaccacaggtccagactacgaggtacgggactcaaccgtattcccggaactcagtctcgtgccccccgggtaccactcccctttcacgtgcagcaggaggctagggaaggggaggattgggaacgagagcccccgcggcagaggcccccaatctatgaacctccagaatctgaggagcttccagataacgtgatggtgtcaaaaccagccccctactgggagggcacagccgtgatagatggagagtttaaggagttaaaactcacggactaccgtgggaaatacttggtattttttttctatccacttgatttcacatttgtgtgccctactgagataatcgccttcggagaccggctagaagagttcagatccataaatacagaggtggtggcctgttctgtcgacagccagtttacccacctagcctggatcaatacacccaggcggcagggtggtcttgggcccatccgcatccccctactcagcgatctgacccaccaaattagtaaggactatggggtgtacttagaggacagtggacatacattgtag

SEQ ID NO: 5901 - DNA, 843 bp, Artificial Sequence
  Description of Artificial Sequence: Synthetic coding sequence
atggcccggttttgggtgtgcgtggccggggccgggttctttctggcattcctggtgttgcacagcaggttttgtgggtcccccgtgcttcgcaactttacttttgctgtttcatggagaactgaaaaaattctctacagactagatgtgggatggcccaaacaccctgaatacttcaccggcaccactttctgtgttgccgtcgattcacttaacggattggtttatataggacagcgaggagataacattccgaaaatactggtgtttaccgaggacgggtacttcctgagggcctggaattatacagtggacacaccccacgggatcttcgccgccagtactctgtatgaacagtctgtgtggattaccgatgttggtagcgacttcatgattctgtggctgcacggcgaaaatggaaccggtccagcaaaatttaacatcccacactccgtgactctcgattctgctggccgcgtctgggtcgctgacaggggaaacaaaaggattcaggtattcgataaagacacaggtgagtggctgggggcctggaataactgtttcactgaggaaggacctagttccgtacgatttacccccgatgggaaatacctcatagttgcccagttgaatctgagcagactgtccgtggtggctgcccctcctgtcggaagcattggagagtgctcagtgatcagcaccattcagctggccgaccaggttttacctcacctgctggaggtggatcggaagacaggcgccgtctatgtggccgaaattggtgctaaacaagttcaaaagtatgttcctctgaactcctacgtgcccagtttcggaagctag

SEQ ID NO: 5902 - DNA, 1044 bp, Artificial Sequence
  Description of Artificial Sequence: Synthetic coding sequence
atggccagattttgggtctgtgtcgccggcgcgggcttttttctggcctttctggtgctgcactcccgcttctgcgggagccccgtgctgagaaacttcacgttcgctgtgagctggcggaccgaaaaaattctttaccggttagacgtggggtggccaaagcaccccgaatatttcactggcaccaccttttgcgtcgctgtggactcactgaatggactagtctatattggccagagaggagataatatcccaaagatcctggtgttcacagaagatgggtacttcttgcgggcttggaactacaccgtcgatacacctcacgggatcttcgctgcgtctaccctctacgaacagagcgtttggatcaccgatgtgggctccggcttctttggacatactgtaaagaaatactcttccttcggcgacctcgtgcaggtccttggcacccctggcaaaaaaggaacatctctaaacccactgcagttcgacaaccccgcagaactgtacgtggaagacacaggtgacatctacatagtcgatggtgatggtggcttaaataaccggctgattaagctcagtcaggattttatgattttatggctgcacggtgagaatggcacgggccctgcaaaattcaatattccccattccgtcacactggactccgccggtcgcgtatgggttgcagaccgtggaaataagcgaattcaagtattcgataaggacaccggagagtggctgggagcctggaacaactgctttactgaagaaggccccagcagcgtgcgattcacacctgatgggaagtaccttatcgtcgctcagcttaaccttagtcgtctgagcgtggtcgcagcaccacccgtcgggtctattggggaatgtagcgtcatctctactattcaactggctgatcaggtcctcccccacctcttagaagtcgacaggaaaaccggagcggtgtatgtggccgagatcggcgccaagcaagtccagaaatacgtcccactcaatagctacgtgccctcctttggaagctag

SEQ ID NO: 5903 - DNA, 1707 bp, Artificial Sequence
  Description of Artificial Sequence: Synthetic coding sequence
atggtgcttttgcattggtgtctgctgtggttgctctttccattatccagccggacccagaaacttcctaccagggacgaagagttgtttcagatgcagatacgcgacaaggcatttttccacgactcatccgtgatccctgacggggctgagatctcttcctacctttttagggatactcccaagcgttacttcttcgtggtggaagaagataatacacccctgagtgtgacagtgacaccatgcgacgcccccctggagtggaagctctccctgcaagaattgcctgaggaccgatccggtgagggatctggggacctggagccactcgagcaacagaaacagcagatcataaatgaagagggcacagaacttttctcttataagggcaacgacgtcgagtattttatttcttcttcttcacctagtggcctatatcaactggacctgttaagcacagaaaaagatactcatttcaaagtatacgctaccacgactcctgagagcgaccagccttatccggaattgccatacgacccgcgcgtggacgttacttccctcggtagaactacagtgacacttgcctggaagccgtcgcccacagcctctctactgaaacagcccatccagtattgcgtggtgatcaacaaagaacacaatttcaaaagtctatgtgcagtggaagctaagctatcagccgatgacgccttcatgatggctcctaagcccgggttggactttagcccatttgatttcgcacacttcggctttccctccgataattcaggcaaagaacggagcttccaggctaagccctcccccaagctgggcaggcacgtctactctagacctaaagttgacatacagaaaatctgtatcggtaataaaaacatcttcactgtgagcgatctgaaaccggacacccagtactacttcgatgtgttcgtggtgaatatcaattccaacatgtccactgcttacgttgggacatttgccagaacaaaagaagaggccaagcagaaaactgtggagctcaaggacgggaagatcaccgatgtttttgtcaagcgcaagggagcaaaatttcttcgtttcgctccggtcagttcacatcagaaggtgaccttttttatccacagttgtctggatgccgtgcaaatacaggtgcgaagagatgggaaattgctgttgtcccagaacgtagaggggatccaacagttccaattaaggggcaagcccaaggctaagtacctcgtgcggctcaagggaaataagaagggggcctccatgcttaagatcctagccacgacgaggccaactaaacagtccttccccagcctccccgaagacacccgaattaaagcctttgacaagctacggacttgtagttcagctacagtggcctggctagggacccaagagcgaaacaagttctgcatttataaaaaggaggtggatgacaactacaatgaagaccagaagaaaagagaacagaatcaatgcctgggccccgatattcgcaaaaagtctgagaaggtgctctgtaaatattttcactcgcagaatctgcagaaggccgtgacaacggagacaataaaaggactgcagccaggtaagtcatatctcctggatgtctacgtgattggacacgggggccattctgtcaagtatcagtctaaggttgtgaaaacacggaaattctgttag

SEQ ID NO: 5904 - DNA, 489 bp, Artificial Sequence
  Description of Artificial Sequence: Synthetic coding sequence
atgaagggcttcacagctacattatttctctggaccctgatcttcccatcctgttccggtggaggtggcggcaaagcatggccaacccacgtggtgtgttcagactctggcttggaggtgctctaccagtcatgtgatcctcttcaggactttgggttctcggtcgagaaatgctccaagcagctgaagtccaatattaatatccggttcggcattattttacgggaggatatcaaggagctcttcctggatctcgctttgatgtctcagggatctagtgtcctgaatttcagttatcctatatgcgaagctgctctgcccaaattttcgttttgtgggcggcgcaagggggagcaaatctactacgccggcccggtcaataaccctgagttcactatcccccagggagagtaccaggtgctgttggaactgtataccgaaaaaagatctacagtggcctgtgccaacgcaacgattatgtgcagttag

SEQ ID NO: 5905 - DNA, 1698 bp, Artificial Sequence
  Description of Artificial Sequence: Synthetic coding sequence
atggactttctgctcgctctggttctggtgtcatccctgtacctacaggctgccgccgagttcgatggccgctggcccagacagattgtgtcctcgatcggcctgtgccggtacggaggtcggattgattgctgttggggatgggcccgccagagttggggacagtgtcaacctgtctgccagccaaggtgtaaacatggggaatgtattggaccaaataagtgtaagtgccatcctggttacgccgggaagacatgtaatcaagacctgaatgagtgcgggttgaaaccgaggccctgtaagcaccggtgtatgaacacctacggctcttataagtgctactgccttaatggatacatgctgatgccagacggttcatgctcaagcgccctcacatgcagcatggccaattgtcagtacgggtgtgatgttgtgaagggacaaatccggtgccagtgtccttccccaggactgcagctagcacctgacgggagaacatgtgtggatgttgatgaatgtgccacagggagggcatcttgccctcgctttcgccagtgtgtcaataccttcggtagctatatatgtaaatgccacaaggggttcgacctaatgtatatcgggggcaaatatcagtgccacgacattgatgagtgttctctgggacagtatcaatgctcttccttcgcgcgctgctacaacattagaggaagctacaagtgtaaatgcaaggagggttatcagggagatggcctcacctgcgtatacattcctaaggtcatgatcgagccatctgggcctatacatgtgcccaaagggaatgggacaatcttgaagggtgataccgggaacaacaactggatccctgacgttggcagcacttggtggccccccaaaacaccatacatccccccgatcataaccaacaggccgacttccaaaccgactacaagacctactcctaagcctacacctattcccacccctccgccacccccaccactgcctactgaactgcggacccctttgccacccactaccccggagcgccccaccactggcctaacaaccattgcccctgcagcttcgacaccccccggcggtatcacagtggacaatcgagttcagacagatccacagaaaccccggggtgatgtgtttatcccaagacaaccttcaaacgacctgtttgagatctttgaaatcgagagaggagtcagcgctgatgatgaagctaaagatgacccgggagtgcttgtgcactcctgtaattttgaccacggactgtgtgggtggattcgcgaaaaggacaatgacctccattgggagccgatcagggatcccgccggcggacagtacctcactgtaagcgccgcaaaagcacctggtggaaaggccgctcgactggtcctccccttgggccgactgatgcacagcggagacttgtgcctcagctttaggcacaaggtgactggactccacagcggcactctgcaggttttcgtcagaaagcacggcgctcacggcgctgctttatggggccggaacgggggccatgggtggcggcagacacaaatcaccctacgaggtgctgacattaagtcagtagtcttcaaaggagagaagagaagaggtcatacaggggaaattggtctcgacgacgtcagcctaaaaaagggtcattgcagtgaggaaaggtag

SEQ ID NO: 5906 - DNA, 1413 bp, Artificial Sequence
  Description of Artificial Sequence: Synthetic coding sequence
atgaaacgaagcgtggctgtctggctcctggtggggttatccctcggagtgccccaattcggaaagggcgatatctgcgaccctaatccttgcgagaatggggggatctgtctgccaggtctggcagatgggtcgttctcttgtgaatgtcctgatggtttcaccgatcccaattgctccagcgtggtggaggtggggccgtgcacaccgaatccatgtcacaacggcgggacttgtgagatctccgaagcgtatcgcggtgatacttttatagggtatgtctgtaaatgccctaggggatttaatgggatccactgccagcacaatatcaatgagtgtgaagtggaaccttgtaaaaatggcggcatctgcactgacctggtggcaaactatagttgcgagtgcccaggagagttcatgggcaggaattgtcagtataagtgtagcggccccctgggaattgagggaggtatcatcagcaaccaacaaataactgcttctagcactcaccgggctttatttggcctgcagaagtggtatccctactacgcccggttaaacaagaaaggactaatcaatgcttggactgcggcagagaacgacaggtggccgtggatccagatcaatctacagcgcaagatgcgggtgaccggggtcattacccaaggagcaaaacggattgggagtccagaatatatcaagtcctataagatagcttactccaacgacggaaaaacatgggcaatgtacaaagtcaaaggcaccaacgaggatatggtgtttcgcggcaacattgataataacaccccttacgcgaatagtttcacacccccaattaaggcacaatacgtccggctttaccctcaggtgtgtaggcggcattgtactctgcgcatggaactgttagggtgcgaactttctgggtgctcagagccattgggaatgaaatcaggccacattcaagattaccagataacagcctcttccatattccggactctcaacatggatatgttcacttgggagccaagaaaggccaggcttgacaagcagggaaaggttaacgcatggacctcgggccacaacgatcagtcacagtggctacaagtagacctccttgtgcccactaaggtaacgggtatcatcacgcagggtgctaaggatttcggtcacgttcagtttgttgggagctacaagctggcctactctaacgacggggaacattggactgtctatcaggatgagaagcagcgcaaggataaggtgtttcaggggaattttgacaatgacacacaccgcaagaatgtcatcgatccccccatatatgccaggcacatcagaatccttccttggagttggtacggtcgtatcacgctgagatccgaactactcgggtgcacggaagaggaatag

SEQ ID NO: 5907 - DNA, 1254 bp, Artificial Sequence
  Description of Artificial Sequence: Synthetic coding sequence
atggcctcatatctgtatggggtgttatttgccgtggggttgtgcgcaccgatttattgtgtctctcctgctaacgctcctagtgcttatcctaggcccagctccaccaagagtacccctgcatcacaagtgtacagcctgaatacagactttgcttttagactgtatcgccggctcgtactggagacgccaagccagaacatcttcttttctcctgtgtctgtgagtacgtccttggcgatgctgtccctgggagcacatagtgtcaccaaaacacagattctccaggggctcggtttcaatctaactcatacacctgaaagcgccatccaccagggatttcaacaccttgttcacagtctgacggtgccgtccaaagatcttacgctgaaaatgggctcagctctgttcgtgaaaaaggaactgcagctacaggccaactttctgggcaatgtgaagcggctatatgaggccgaggttttctctactgatttctccaacccgtccatcgcacaagctcggatcaactctcatgttaagaaaaagacacagggtaaagtcgttgatatcattcagggacttgacctactgacggcaatggtcctggtgaaccatattttcttcaaagcgaagtgggaaaagcccttccaccctgaatatactcgaaagaattttcctttcctagtgggcgaacaggtgactgtgcacgtaccaatgatgcaccagaaggaacaatttgccttcggagtagatactgagctgaactgcttcgtgctacagatggattacaaaggggatgctgtcgctttctttgtgttaccctctaaaggtaagatgcggcagttggaacaggctttgtccgcccggaccttgagaaaatggagtcacagtcttcagaagagatggatcgaagtgtttatcccacgcttcagcattagtgcaagctataatctcgagactatcttacccaaaatgggaatccagaacgtgttcgataaaaatgcagattttagcggcatcgcgaagcgcgacagcctgcaggtctctaaggctacacacaaggctgtccttgatgtctcagaagaaggaaccgaggctacagctgcaaccactactaaattcattgtgagatctaaggatggaccaagctattttaccgtttcctttaatcgaacctttctgatgatgattaccaacaaggctactgacggaatactttttctcggaaaagtcgagaatccaacgaagtcctag

SEQ ID NO: 5908 - DNA, 486 bp, Artificial Sequence
  Description of Artificial Sequence: Synthetic coding sequence
atgctaatgcccgtacactttctcttgcttcttctgctcttactagggggccctcgcactgggcttccccataagttttacaaagccaagcctattttctcctgtctcaacactgccctgtccgaagctgaaaagggtcagtgggaagacgcttccttattgagcaagagatcattccattacctgcggtctcgggacgcaagtagcggagaagaggaggaaggcaaagaaaagaaaacctttcctataagtggagcccgtggaggagcccggggcactagatatcggtacgttagccaggcccagcccaggggaaaaccacgccaggataccgccaagtcaccacaccgcacgaagttcaccctctcgctggacgtgccaaccaatatcatgaacctcctgtttaacatcgccaaggccaaaaatcttcgcgctcaggcggccgccaatgcacatttgatggcccagatcggtagaaagaagtag

SEQ ID NO: 5909 - DNA, 2091 bp, Artificial Sequence
  Description of Artificial Sequence: Synthetic coding sequence
atggccatggccagacttggcagttggctcggggaagcccagtggttagctttggtgagcttgtttgtggcggccctggccaccgtgggtctgtacctcgcgcagtgggctctggcccgcgcccgccctcagcctcaaagacgcgccgtggagccgggggaaggacctcgtcctgggtctgacgctctcctgagctggattttaactttaggatcttggcgttcccaatggcaagctgcttgggttacagctctcaatgaggaggccgagcgcaaagggggaccgccatttctgagctttgaagaagaccctcgccagcaggctctggaactggtagttcaggaagtttcctccgtccttcgctccgccgaagagaaagtggtcgtctgtcacgtggtgggccaggctatccagtttctcgtgagcgaaacccccgccttaggcgccgggtgccggctctatgacatgcggctcagcccctttcacctgcaactggaatttcacatgaaggaaaaacgggaagatcttcaaatcagctggtcattcatcagcgtcccggagatggctgtcaacatccagccaaaggcactgggcgaggaccaggtggccgaaacatcagctatgtccgacgtgctgaaagacatactcaagcatctggcggggagcgcctcgccttcagtcgtactgatcacaaaaccgaccacggtgaaggaagcgcaaaatctgcagtgcgcggcaagtactgcccaagagagctgcccccccaagccaccacgtgcccacgagctgaagcttcttgttcgaaacatccacgttcttctgttgtctgaacctggggcaagtggacacataaacgccgtgtgcgtcgtgcaactcaacgacccagtgcagcgtttcagctctaccctgactaaaaatacccccgacctcatgtgggaggaggaatttacatttgaattgaacgcaaagtctaaggagctgcatctccagattagcgaggccggtcgaagctcagagggcctgctcgctaccgctaccgtgcctctcgatctgttcaagaagcagcccagcggcccccagtcattcacccttacaagcgggtctgcttgtggatctagcgtgttgggctcagtgaccgccgagttctcttatatggagccaggagagctgaagagttggcctattcctcccccagtccctgccgctaagatcgagaaggaccgtaccgtcatgccttgcgggactgtagtgacaactgttacagccgtaaaaactaagcccagggtcgacgtaggacgggcatctcccctgagttcagatagcccagtaaagaccccaattaaggtaaaagtaatcgagaaggacatcagcgtgcaagcaatcgcttgccgcagtgcccccgtctcaaaaacattatcaagcagcgacaccgagttattggttttgaatggatccgacccggtcgccgaggtagccatccgacagctgtccgagtcctccaaattgaagttgaaatcaccaagaaaaaagtcaaccatcatcatctccggcatctccaagacttcactctctcaggatcacgatgcagctctcatgcagggttacaccgccagtgttgacagcactcatcaggaggatgccccctcacacccagaacgtgctgcggcatcggcgccaccagaagaagccgagagcgctcaagcctcactcgcaccgaagcctcaggaggacgaattggacagctgggacctggaaaaggaaccccaggctgctgcctggagctctcaggtcctccttgatcccgacggggacgagctttcagaatcttccatgtctgtcctggaaccagggaccgcaaaaaagcacaagggcggaatactgcggaagggggccaagctgttcttcaggcggaggcaccagcagaaggatccaggaatgagccagtcccacaatgacctggtctttctagagcagcctgagggatctcgacggaagggcattactctgacacggattctcaacaagaagctcctctccaggcatagaaataaaaacaccatgaatggagccccagttgagccatgtacctag

SEQ ID NO: 5910 - DNA, 669 bp, Artificial Sequence
  Description of Artificial Sequence: Synthetic coding sequence
atgccagcctcatccccctttctcttggctccaaagggaccacccgggaatatgggcggccctgtcagagagcctgccctctccgttgccctgtggttgtcctggggagccgccttgggtgcagtcgcatgtgccatggctctgcttacgcaacagacggagctgcaaagccttcggcgggaggtctctaggctgcagggcaccggtggccccagtcagaatggcgaagggtacccatggcagagcctgcccgagcagcacagcgtgttacacctcgtgccaatcaatgccacttctaaagacgacagtgatgtgaccgaggtaatgtggcaaccagccttacgccgcgggagaggtttgcaggcacaagggtatggggtgcgaatacaggatgctggcgtgtacctgttgtactcccaagtcttatttcaggacgtcacattcaccatgggccaggtggttagcagggaaggacaaggcagacaggaaactttgtttaggtgtatacgatccatgccctcccaccccgaccgcgcatacaattcatgctacagcgccggagtctttcatttgcaccaaggcgacattctgtctgtgatcattccacgcgcccgcgccaagctcaacctgtcgcctcacgggacctttttaggattcgtgaaactctag

SEQ ID NO: 5911 - DNA, 2205 bp, Artificial Sequence
  Description of Artificial Sequence: Synthetic coding sequence
atgtggggactgctgctggctcttgccgccttcgccccagcagttggtccagctctgggtgcacccagaaactccgtgctcggattagcgcagcccgggaccacaaaggtgcctggaagtaccccagctttgcatagttccccggcacagccgccggccgagacggccaacggtacatcagagcaacacgtgcggatacgggtcatcaaaaaaaagaaggtgataatgaaaaaacggaaaaagctcacattgactcgcccgacgcctctcgtaactgccggccctcttgtgacccccaccccagccgggactctggaccccgccgagaagcaagagacaggatgtcctcctctcggactggaatctttacgggtcagtgattcccgtcttgaggcaagctcatcccagtcatttgggttgggtccacaccgcggacggctgaacatccagagcgggctggaggatggtgatttatatgatggggcctggtgcgcagaggagcaagacgcagatccttggtttcaagttgacgcaggccatcctacccgcttctctggggtgatcacccaggggagaaactcggtttggcggtacgattgggttacttcttacaaggtgcagttcagcaatgactccaggacttggtggggctctagaaatcatagcagtggtatggatgccgttttccccgcaaattcagaccccgaaactccagtccttaacctgcttcccgaaccacaggtggcacgttttattcgacttcttccccaaacctggctccagggaggggcaccttgtctgagagctgaaattctcgcttgtcctgtatccgacccgaatgacttgtttcttgaagcaccggcgtccggctcaagtgacccccttgattttcagcatcacaattataaggccatgcgcaagctgatgaaacaagtacaggagcagtgtcctaatatcactcgaatctattccatcggcaaaagttaccaaggcctgaaactgtatgtgatggaaatgtccgataagccaggagaacacgagcttggcgagccggaagtacgctatgtggctggcatgcatgggaatgaggctttggggagggagctcctgcttctgctcatgcagttcctctgccacgaatttctgcggggaaaccctagagtcactaggctgctctcagagatgaggatccacctactcccgagtatgaatcccgacggctatgaaattgcctaccatagaggatccgagttggtcgggtgggccgagggccggtggaacaatcagtcaatcgacctgaatcacaactttgccgatctgaacaccccactctgggaggctcaggatgacgggaaggttccgcacatcgtgcctaaccaccacttacccctcccgacttattacaccctaccaaatgccactgtggcgccggagacaagggccgtgattaagtggatgaaacgaattccatttgttctgagtgccaacctccatggcggcgagctggtggtgagttaccctttcgatatgacccgcaccccgtgggccgcacgcgaactaacccccacgcctgacgacgccgtgtttcgatggctgagtacagtgtacgctggttccaacctggctatgcaggacacttctcggagaccatgtcatagccaggacttctccgtgcacggcaatattatcaatggtgctgattggcatacggtccccggtagtatgaacgatttctcctacctgcacacaaattgctttgaagtgaccgtggagctatcttgtgataaattccctcacgagaacgaacttccccaggaatgggagaacaacaaggatgctcttttgacatatctcgagcaggtgaggatgggaatagccggcgtggttcgggacaaagacacggagctgggaatcgcggacgccgtcattgccgtcgatggaattaatcacgatgtcactacagcctggggcggcgactactggcggttgctgaccccaggggactacatggtcacggcatctgcggaagggtaccacagcgtgactcgcaactgtcgcgtgacgtttgaagagggtccattcccgtgcaacttcgttctgacaaagacaccgaagcagaggctgcgcgaactcctggcggcaggcgccaaggtgcctcctgacctcaggcggagattagagcgtctaaggggacagaaagactag

SEQ ID NO: 5912 - DNA, 759 bp, Artificial Sequence
  Description of Artificial Sequence: Synthetic coding sequence
atgcgtgccccactccttccacctgccccggtggttttaagtctgctgatactgggcagtgggcactatgccgccggtcttgatctgaatgacacatactctggaaaaagagagcctttttctggtgaccacagtgcagacgggtttgaggtgactagtcgaagtgagatgtctagtggaagtgagatctcccccgtgtcggagatgccctccagctccgagccatcttctggtgccgattatgactattccgaggagtacgacaacgaaccacaaatccctgggtacatcgtcgacgacagcgtacgcgttgaacaggttgtcaagccccctcagaataaaactgaatccgagaatacgagtgataaaccaaagcggaagaaaaaggggggaaaaaatggcaagaaccggaggaataggaagaagaaaaacccctgcaatgcagagttccagaacttttgtatccatggcgagtgcaaatacatcgagcacttggaagctgtgacatgtaaatgccaacaggagtacttcggggagcgctgcggggaaaaatcaatgaaaacgcactcgatgatcgatagcagcctgtctaagatcgcactagcagccatagcagcctttatgagcgctgttatcctcactgcggtcgctgtgataaccgttcaacttcggaggcagtacgtaagaaagtacgagggtgaagcagaggagagaaaaaaattgcggcaggagaatggtaacgtgcatgctattgcctag

SEQ ID NO: 5913 - DNA, 8487 bp, Artificial Sequence
  Description of Artificial Sequence: Synthetic coding sequence
atgcctaaacgagcacactggggcgccttgagtgttgtgcttatactgttatggggccaccccagagtagcactggcctgccctcacccatgcgcgtgttacgttcctagtgaggttcattgtacttttcggagcctagctagcgtgcctgcgggcatagctaaacacgtagagagaatcaacctgggttttaatagtatccaagcactttccgaaacaagctttgccggacttacgaagctcgagctcctgatgatccacggaaacgaaataccctccatccctgacggtgccctgcgagacctgtcatcgcttcaggtctttaagttttcctataataaactgagagtgattactgggcagacgctccagggcctgagcaaccttatgagactccacattgatcacaataagattgagtttatccatccacaggcctttaatgggctcactagtcttaggctcctccacctggaggggaatctgctgcaccagctgcatccttctaccttctcaacatttacgtttctggactatttcagactttctacgattagacacctgtatcttgccgagaacatggtgcggactcttcccgcgtctatgttaagaaacatgccacttctagagaatctctatctgcagggaaacccatggacctgtgactgtgaaatgcggtggttcctggagtgggacgccaaaagccgtggcattctgaaatgtaagaaggataaggcttatgagggggggcaactctgtgcaatgtgttttagccccaagaagctatataagcacgagatccataaacttaaggacatgacgtgtttaaagccttcaatcgagtctcccctgcgacagaatcgaagccgcagcatcgaggaggaacaggaacaggaggaagatggcgggtctcaactcattttggagaagtttcagctgccccagtggtctattagcctgaacatgacagatgagcacggaaacatggttaatctggtctgcgacatcaagaagccaatggacgtctacaagatccatctgaatcagacagatcctcccgacatcgatatcaacgcaacagtggccctcgactttgagtgccccatgacacgtgaaaattacgaaaaactatggaagctcattgcgtattactcggaggtccctgtcaagctccatagagagttaatgctgagtaaggatccccgtgtttcataccaatatcggcaggatgccgatgaggaggctctgtactacacgggcgtaagagctcagattctcgctgagcccgaatgggtcatgcagccatctatcgacattcagctgaatcggcgccagagcacagccaaaaaggtgctgctctcttattacacacagtattctcaaactatttcgaccaaagatactcgacaggcccgcgggcggtcttgggttatgatcgagccttcaggcgccgtccaaagagaccagactgttctcgagggcggtccttgccagctatcatgtaacgtgaaggctagtgagtcccctagtatattttgggtgctccccgatggctccattttaaaagctcctatggacgatcccgacagtaagttttctattctttcctcaggttggctcagaattaaatctatggagccttccgatagtgggctgtaccagtgtatcgcccaagtgcgagatgaaatggatcgcatggtttaccgggttctggtgcaatctccctccacgcagcctgccgagaaggatacggtgaccatcggcaaaaatcctggtgaaagcgtgacattaccttgtaacgccctggccattcctgaagctcacttgtcttggatccttcccaatcgccgtatcataaacgatctggcgaacactagccacgtttatatgctgcccaatggaaccctgtccatccccaaagtacaggtgagcgactctgggtactaccggtgcgtggccgtgaaccaacaaggcgctgatcatttcactgtcggtatcacggtaactaagaaaggaagcggacttccctctaagagggggagaagaccaggggcaaaggctttatcaagggtcagggaggacatagtggaggacgagggaggcagtggaatgggcgacgaagaaaatacttctcggaggttactgcacccgaaggatcaggaggtatttctgaagaccaaagacgatgctatcaacggcgacaagaaggctaagaaaggcagacgaaagctcaagctgtggaagcacagtgagaaggagcccgagaccaacgtcgctgaggggcgccgggtcttcgaatcacgtaggcggataaacatggcaaacaaacagattaaccccgagaggtgggcagatatattggctaaggtcagaggaaaaaatctgcctaaaggtaccgaggtgcctccactcatcaaaactacttcccctccttctctctcactggaagttacgcctcccttccccgctatttcaccgcctagcgcttcgcctgtccagacagtcacctccgcagaggagtccagcgccgatgtgccattattgggagaggaggagcatgtactgggcacaatcagctccgccagtatggggctggagcacaatcacaatggcgtgattctcgttgagccagaggtgacttcaacacccttggaggaagttgttgatgatctcagcgagaagactgaggagatcacatcaactgaaggcgaccttaagggcacggctgccccaaccttaatatctgaaccttatgagcctagccccacccttcacactctggatacagtgtatgaaaagccaacccatgaagagacagcgacagagggctggtccgctgccgatgttgggtccagtccggagccgacatcctcagaatacgagcccccactggatgctgtctctctggctgagagcgagccgatgcaatattttgatccggacttagagacaaaaagccagcccgacgaagataaaatgaaggaagacacctttgcccacctgacgcccactcccacaatctgggtcaatgactcttctacgagccaacttttcgaagactctaccattggcgaaccaggcgtgccaggtcagtcacacctgcagggcctgacagataacatacatctggtgaagtctagcctgtctacccaggacacacttctgatcaaaaagggaatgaaggagatgtctcagacactacagggaggcaatatgctagagggagaccccacacattcacgctcctcagagagcgagggccaggaatccaagagcatcaccctgcctgatagtactctgggcatcatgagttcgatgagcccagtgaagaagcctgcagagactaccgtgggtactcttctggacaaggatactacgaccgctactaccactcctcgccagaaagtggcacccagctccactatgtcgacccatcccagccggcggcgccccaacggaaggaggcgcttgcggcctaacaaattcagacatcggcacaagcaaaccccacctaccacatttgccccctcggagaccttttccacgcaaccaactcaagcccctgatattaagatttccagccaagttgagtcgtccctggtacccacagcatgggtggataatacagttaacactcccaagcagttagaaatggaaaagaacgctgaaccgacgagtaaggggaccccgcgacggaagcacgggaagaggcccaataaacacaggtacacaccaagcacggttagcagcagggcttctggaagcaagccctcgcctagtcccgaaaacaagcataggaatattgtaactccttcctccgagacaatattgctaccaagaaccgttagcttgaaaactgagggcccgtatgacagccttgactacatgacgactacacgaaaaatttactcaagctatcctaaagttcaagagacgctgcccgtgacctataagcctactagtgacggcaaagagattaaggacgacgtggctactaatgtggacaagcataaatccgacatcctcgtgactggtgagtctattaccaatgccattcctacgagtaggtctttggtgtccacgatgggtgagtttaaggaagagagttcacctgtggggttcccaggaacccccacttggaatccctcccggactgcccaacccgggagactgcagactggtattcctgtgacaacatccggagaaaatctgactgatcccccgctgttgaaagaactcgaagacgtagacttcaccagtgagtttttgtcctccctgaccgtttccacaccttttcatcaggaagaagccggatctagcacgaccctttctagcatcaaagtggaagtcgccagcagccaggctgagactacgacactggatcaggaccatttagaaactacggtggcaattctactgtccgaaacccgcccccagaatcatacccctaccgccgcccgtatgaaggaacctgctagctctagcccatcgactatactaatgagcctgggtcaaaccaccaccactaagcctgcattgccctcacctcgaatcagccaggcttcgagggatagcaaggaaaatgtatttctgaactatgtcgggaatcctgaaaccgaagcaaccccagtgaataacgaaggcactcaacatatgagtggtcccaacgaattgtctaccccatctagtgaccaggatgctttcaacctgtctacaaagctggagctcgaaaagcaggtttttggcagtagatcacttccacgtgggccagactctcagaggcaagacggacgagttcatgcctcacaccaactcaccagggttcccgcgaagcctattctgccaactgcgacagttcggctgccagagatgagcacacagagcgcatctaggtacttcgtgacaagccagagtccgcgccactggacaaataagccagagatcacaacatacccgagtggggccctccccgaaaacaagcagtttaccacgccacggctgagtagtaccaccatcccactccccctccacatgtctaagccttcaattcccagcaaattcacagatcgccggaccgatcaattcaatggatattccaaggtctttgggaataacaatatccctgaggctagaaaccccgtgggtaagcccccgtcccccaggatcccacattattccaacgggagactccccttttttaccaacaaaacgctgtcctttccgcagctcggcgtgaccaggcgaccccagatcccaacttcacccgcgcctgtcatgcgtgagagaaaggttattcccgggagttacaaccgcatccacagtcacagcacttttcacctggatttcgggccacctgcaccgccgctgctgcacacaccccagactacagggtcaccgagcacaaacctccaaaacattcctatggtgtcctcaacccagtccagcatcagcttcataacttcttcggtgcagagcagtggtagctttcaccaaagctcatcaaagttttttgcaggcggaccacctgcatcaaaattttggtccctgggagagaagccccagatcctcaccaagagccctcagaccgtgtctgtgacagcagaaacagacactgtcttcccatgcgaggccactggtaagcccaagccattcgttacctggacaaaagtttcgactggggcactcatgacgcctaatacacgcatccaacgcttcgaagtcctaaaaaatggtaccctagtgattcgcaaggtacaagtgcaagatcgcggccagtatatgtgtaccgcctcaaatctgcatggcctcgatcgcatggtcgtcctgctttccgtgacagtccagcagcctcagatcctggcctcccattaccaggatgtgacagtgtatttaggcgacactatagccatggaatgcctcgctaaagggacccccgccccgcagatatcatggatcttcccggataggagagtgtggcaaactgtgtctcccgtggagggaagaattaccctacacgagaataggacgctctcgatcaaagaagcctctttcagcgacagaggggtctacaaatgcgtggcgagcaatgcagccggcgccgactcactggctatccgattgcacgtggcggccctgccaccagttattcatcaagaaaaactggaaaacatttccctgcctcctggcctgagcatccacatacattgcactgccaaagccgctcctttgccttcagtccggtgggtactgggagatgggacccaaattcggccttctcagtttttgcatggtaatcttttcgtgttcccaaatggaactttatacatccgaaatctggctccaaaggattcaggacgttacgaatgcgtcgctgccaatctggtagggtcagctagacgcacagtccagctcaatgtgcagagagcagctgccaacgcacgcatcacaggcacttcccctaggcgaacggacgtccgttacggcgggactctgaaactggactgttccgccagcggcgacccgtggccaaggatcctatggcgcctgcccagcaaacgcatgattgacgccttgttctctttcgactcacgaatcaaagtctttgctaacggcacactcgtcgtgaaatccgtgacagacaaagatgcaggagactacttatgcgtcgccaggaataaggttggtgatgattacgttgtcttgaaggtggatgtggtcatgaaacctgccaagatagaacataaagaggaaaacgatcacaaggtgttttatgggggggacctgaaagtcgattgcgtggccaccggcctccccaatccagaaatctcctggtccttgccagatggttcactggtgaactcctttatgcagagcgacgactctggcggccgaacaaaacggtacgttgttttcaacaacggcacactatacttcaatgaggtgggaatgagggaggaaggcgactatacctgcttcgccgagaatcaggtaggcaaggacgaaatgcgggtcagagtgaaagttgtcaccgcccctgccacgattaggaacaagacttatctggccgtccaagtgccctatggagatgtggtcaccgtagcttgtgaagccaagggggagcctatgcctaaggtgacctggctgtctcctaccaataaggttattcccaccagctcggagaaataccagatctaccaagatgggaccctgttgatccagaaggctcagcgctcagactcaggaaactatacatgtttggtgaggaattctgcaggagaagacagaaagacagtgtggatccacgtcaatgttcaaccacccaaaataaatgggaacccgaacccaattaccaccgtgcgagagattgcagctggggggtcacggaagctcattgactgtaaggccgaaggaatccctacacctagggtgctgtgggccttccccgagggggtggtgctgccagctccatactacggcaatcgaatcacagtgcacggcaacgggtcactagacatccggagcttgcgtaagtcggactctgtacagctggtctgtatggcacgcaatgaagggggggaggcccgactgattttgcagctgacggtcctggagcccatggaaaaacccatctttcacgatcctatatcggaaaagatcaccgctatggccggtcatactataagtcttaattgttccgccgctggcaccccgacaccttcactggtatgggtccttccaaatggtaccgacctgcagagtggccagcagcttcagagattctaccacaaggcagacggtatgttgcacatcagtggactgtcctcagtggatgccggcgcctatcgctgcgtcgccagaaatgctgccggacacacagagaggctggtctctttaaaggttggactcaaacccgaggcgaacaagcagtaccataatttagtctccattatcaacggagagaccctgaaactgccttgtaccccaccaggggctgggcagggtcgtttttcctggaccctgccaaatggtatgcatttagaggggccacagaccctggggagggtgtcacttctggacaacggcaccctgacagtacgcgaagccagcgtgtttgaccgcggaacatatgtttgtagaatggagaccgagtacggccctagtgtgaccagcattcccgtgatcgtgatcgcttatcctcccaggataacaagtgagccaactccagttatttacacacgccccgggaatacggttaagctgaactgtatggctatggggattccaaaagccgatattacatgggaacttccggacaaatctcatttaaaagctggagtacaggcaagactgtatggaaaccggttcctacatccccagggctcgctgaccatacagcatgccacacagcgtgacgctggcttctataagtgtatggctaaaaacatactgggctcagattccaagacgacgtacatccacgtgttttag

SEQ ID NO: 5914 - DNA, 3330 bp, Artificial Sequence
  Description of Artificial Sequence: Synthetic coding sequence
atgaggttgctgttattagttccacttctgctagcccctgcacctgggtcaagtgccccgaaggtacggcggcaatcagatacttggggcccttggtcgcagtggtctccatgtagccgcacttgcggagggggagtgagctttcgggagagaccatgctatagccagcggcgagatggcggaagcagctgcgtgggtcctgctaggagccatcgctcctgcagaacggaaagctgccctgacggcgcccgtgatttccgggctgagcagtgtgcagaattcgatggagccgagttccagggccggcggtacagatggctcccctactattccgccccaaataagtgtgaactgaactgcatccccaaaggcgagaacttctactacaagcacagggaagctgttgtggatggcacaccatgcgagcccggaaaacgggacgtgtgcgtcgatggttcctgtcgggttgttggctgcgatcacgaacttgatagttccaaacaggaggataagtgcttgaggtgcggcggtgacgggaccacctgctatcccgttgccggaacattcgatgcaaatgatctgtccaggggatataaccagatattgattgtccccatgggcgccacttcaatcctcattgatgaggctgctgcttcacgtaacttcctagcggttaaaaatgtcaggggggaatactacctaaacggccactggactatcgaagctgccagagctctgcctgctgcgtctaccattctgcactatgaaaggggggccgagggtgatttagcgccggagcggctgcatgcgaggggccccacttcagagcccttggtaattgagctcatcagtcaagagccgaacccgggcgtccattacgagtatcatctccccctgcgaagaccgtctcccggattctcttggtcccacggcagttggagcgactgctccgcagagtgcggcggcggacatcagtcccgactggtattctgtacaattgaccacgaggcctaccccgatcacatgtgccagcgtcaaccgaggcccgccgatcgtcgctcctgcaatctccatccatgccccgagaccaagagatggaaagccggcccgtgggctccatgcagtgcttcttgtgggggagggtcccagtctcggtctgtgtactgcatctctagcgatggagccggcattcaagaagccgtggaggaggccgagtgtgctggtctgccaggcaagccgcctgcgatccaggcctgcaacctacagcggtgcgcagcctggagccctgaaccatggggtgagtgtagtgtttcctgtggggtgggagtgagaaaacgaagcgtcacatgcagaggcgaaaggggaagcctgctgcacacagccgcatgctccctggaagatcgccctccactgacagaaccttgtgttcacgaggactgtcccctgctgtcagaccaggcatggcacgtaggtacttggggcctttgctctaagtcatgctcctctgggacaaggaggagacaggtgatttgtgccattgggcccccatcacactgcggctctcttcagcactcgaagcccgtggacgtggaaccctgtaacacacagccatgccaccttccgcaagaagtcccttctatgcaggatgtgcataccccggcatccaacccttggatgcccctcggcccacaggagtcccctgccagtgactcgcgaggccagtggtgggctgcgcaggagcatccatccgcaagaggcgatcataggggcgagagaggggacccaagaggcgaccagggaacacatctcagtgccctcggaccagcccctagcctccagcagccaccgtaccaacaacccctccgttccggctcaggacctcacgattgtcggcacagcccacacggctgttgtcccgacggacacaccgcctctcttggcccccagtggcagggatgtcccggcgcgccttgtcagcagtccaggtacggctgttgtccagatcgggtgtccgtggccgaagggccacatcatgccggatgtacaaagagctacgggggcgacagtaccggcggaatgccaagaagtagagccgttgcatcgaccgtgcacaacacccaccaacctcaggctcagcagaacgagccttctgaatgccgcgggtcccagttcggctgctgctatgacaatgtcgctactgctgcaggacccctcggcgagggttgtgtgggccagcccagccacgcctaccccgtgcggtgtctcctgcccagtgcacacgggtcttgtgccgactgggcagcccggtggtactttgtcgctagtgttggtcagtgcaatagattttggtatggaggttgtcatgggaacgcaaacaatttcgcatccgaacaggaatgtatgtcatcctgtcaggggtccctgcacggcccccgaagaccgcagcccggcgcgtccgggagatccacccacactgacgggggaggcagttcccctgccggtgagcaggaacccagccagcacagaactggcgctgctgtccagcgaaaaccgtggccctcaggcggactctggcggcaagaccagcagccaggacctggggaagcaccacatactcaggctttcggcgagtggccatgggggcaggagctgggtagtcgcgctcctggactcggcggtgatgccggctcccccgcccccccctttcacagcagttcctatcggatctccttggctggagtggaacctagcctggtacaggcggcgctggggcagttagtgcgtttaagttgctcagatgatactgccccagagagtcaggccgcttggcagaaagatggacaacctatatcttctgataggcacagactgcagtttgacggcagcttgattatacaccctctacaggccgaggatgctggcacatacagctgcgggagtactagaccgggccgggattcccagaagatacagttacgcataattggtggtgatatggccgtgctctcggaagcagagctgtctcggtttccccagccccgcgaccccgctcaggattttggacaggccggggccgccggtcctttgggtgctatcccaagctcacaccctcagcccgctaaccggctgaggctcgaccagaaccagccaagagtggtagacgcctcccccggccaaagaatacggatgacttgcagagccgagggcttcccgccccccgcaattgagtggcagcgggacgggcaaccagtaagctcccctagcactcaccgtcccgcccaaggaccatggcagggactgcgacgaccagcaagagctggtcaactttag

SEQ ID NO: 5915 - DNA, 405 bp, Artificial Sequence
  Description of Artificial Sequence: Synthetic coding sequence
atgaagagcgtgctgttgttgacaaccctgctggtcccggcacacctggtggctgcatggagcaacaactatgcagttgactgcccgcagcactgtgactcgtcggaatgcaagtcaagtcctcgctgcaaaagaacggtgttggacgactgcgggtgctgtcgggtgtgcgctgctgggcggggagagacttgttataggacggtgtccggaatggacggcatgaaatgtggacctggactcaggtgccagccgagtaacggagaagatcctttcggggaagaatttggcatctgcaaggagcatgacatggcctctggggacggaaacatcgttagggaggaggttgttaaggaaaatgccgccggctctccggtcatgagaaagtggctgaatcctcgctag

SEQ ID NO: 5916 - DNA, 555 bp, Artificial Sequence
  Description of Artificial Sequence: Synthetic coding sequence
atgaagagtgtgctcctcctcactacactcctggtgcccgcgcatttggtcgccgcctggtccaacaactacgctgtggattgcccccaacactgtgatagctctgaatgtaagagctccccaagatgcaagaggaccgttctcgatgactgcggctgttgtagggtctgcgctgctggccgtggggaaacctgttatcggactgtctcagggatggacggaatgaaatgcgggccggggctaaggtgtcaaccctccaacggcgaagacccctttggggaagagtttggtatttgcaaagactgcccatatgggactttcgggatggattgcagggagacgtgcaattgtcagtccggcatatgcgaccgaggcacggggaagtgcttgaaattcccattcttccagtatagtgttactaaatcttccaatcgcttcgtgagcctgaccgagcatgatatggccagcggagatggaaatattgttcgggaagaggtagtgaaggaaaatgcggctgggtcacctgtcatgagaaagtggctgaacccccgctag

SEQ ID NO: 5917 - DNA, 597 bp, Artificial Sequence
  Description of Artificial Sequence: Synthetic coding sequence
atgcccatacctgcttctcctctgcatccacccctcccctctctcctgttatacctgctcttggaactcgcaggcgtcactcatgttttccacgtacagcaaacagagatgagccagaccgtttccacaggagagtctatcattctgtcctgctcggtgccgaacacgcttcccaacggacccgtgctgtggtttaaaggaaccggacctaacagaaagctgatctacaacttcaagcagggaaactttccaagggtcaaggagattggcgataccaccaaacctggcaacacagatttttctaccagaataagggagataagcctcgccgatgcaggcacctactattgtgtgaagttcattaaaggccgagcaattaaagaataccagtctggtagaggcacccaggtatttgtaaccgccgagcagaatcccagacccccgaagaaccggccagctggaagagccggaagcagagcgcaccacgatgcccatacgtgcctgtctgccctgcccgagaggaacagcaccaactattttgtgcaaccatgttgttgccttagactcttggggcttacaggtctgctgtcaaagtag

SEQ ID NO: 5918 - DNA, 594 bp, Artificial Sequence
  Description of Artificial Sequence: Synthetic coding sequence
atgccgatccctgcctcacccctgcaccctccccttcctagcctgctgttatacctgctgctcgagttagctggagtgacgcacgtattccacgtccagcaaacagagatgtcacagaccgtgagtactggcgagtctataatcctctcttgctctgtgcctaatacactccctaatgggccggtgttgtggttcaaaggtaccggcccaaaccgcaagctaatctacaattttaagcagggaaactttcccagagtaaaggaaattggcgataccacaaagcctggtaataccgacttcagcacccgcatccgcgagatatctctggcagacgccggaacttactactgcgtgaagttcatcaagggaagggccatcaaggagtaccagtctggacgcggcacgcaggtcttcgttaccgagcagaatccacgacctcccaagaaccgtccagctggcagggctgggtcccgtgcccaccatgacgcacatacttgcctgtcagcgcttccagagaggaatagtacaaactatttcgtccagccctgttgttgcctgcgtcttcttggattgaccggactcctgagtaagtag

SEQ ID NO: 5919 - DNA, 1563 bp, Artificial Sequence
  Description of Artificial Sequence: Synthetic coding sequence
atgaccacggatgataccgaggtgcccgcgatgacgcttgcacccggacatgcagctctggaaacacagactctctctgcggagacttcctcgagagccagtaccccagccggtccaatcccggaggctgagacccggggtgctaaaaggatctcgcccgcccgtgaaactcgatctttcaccaagacatctcctaacttcatggttctgattgctacatccgtggaaacttctgctgccagcggatcccccgagggagccggtatgacaacagtacagaccatcacggggtccgatccccgagaggcgatcttcgatacactctgcaccgacgacatatcagaagaggcaaaaaccctgacgatggatattctgacactggcacatacctccacagaggcaaagggcctttctagcgaatcttctgctagcagtgacggcccccacccagttattactccatcaagagcttccgagtctagtgcaagttccgacggaccccaccccgttattacgccttctcgcgccagcgagtccagtgcttcaagtgatggtccccatcccgttatcacgccttcgagggcctcagagtctagcgcttcatccgatggtccgcacccagttattacgccatcctggtccccgggatccgacgtcaccctcctggccgaggccctggtgacagtcacaaatattgaagtcatcaactgctcaattaccgagatcgaaaccactacaagcagcattccgggcgcttcagatacagatttgatccctaccgagggcgtcaaggcttcctcaacttcagacccgcccgcactccctgactctactaatactaaacctcacattactgaagtcaccgctagcgccgagacactctctactgcaggcacaaccgaatccgccgctccagacgcgacaatcggcacgcccctaccaactaattcaacaatagagcgcgaagtcactgcaccaggtgccactacattgagcggagccctggccaccggcaacccacttgaagagacctctgctctttctgttgaaactccctcctatgtcaaggtgtccggggccgcgccagtctcaattgaggcaggctccgcagtagggaaaaccacatcttttgccggctctagtgcttcctcgtactccccactcgaggcagcccttaaaaactttaccccctcagagacactcaccaccgacatcgccaccaaaggacctttccccacttctcgtgatcccctgccctctgttccccccactaccacaaactcctcgcgcggcacaaactctacccttgccaagataactacgtccgccaagaccactatgaagccccccactgccacacccaccaccgcccgaactcggcctactacggacgtttcggccggggaaaatgggggatttttattacttcggctctcagtagcctcccccgaggatttgacagaccctcgggtggctgagagactcatgcagcagttacatcgggaactgcacgctcacgcgccacattttcaggtcagcctgctgcgggttaggcgaggctag

SEQ ID NO: 5920 - DNA, 600 bp, Artificial Sequence
  Description of Artificial Sequence: Synthetic coding sequence
atgctctggaggcaactgatttactggcagcttctggccctcttctttctgcctttctgcctttgccaagatgagtacatggagtccccgcagacgggtggcctgccgcccgattgcagcaagtgctgccatcatggcaataacggcaataatggcgcgacaggccataagggagaaaagggctatccagggatcccgcccgaactacaaatcgcctttatggccagcctggctacacactttagcaaccagaattccgggattatcttcagttccgttgagactaatatcggcaatttttttgacgtgatgacaggtcggttcggcgcccccgtgtcaggggtatattttttcacgttcagcatgatgaaacacgaagacgtggaggaggtgtacgtgtacttgatgcacaacggcaacaccgtcttttccatgtacagctacgagatgaagggcaagtccgatacttcttctaatcacgcagtcctcaaactggcaaaaggagacgaagtgtggctgcggatgggaaacggggcccttcatggtgatcatcagcgttttagcaccttcgccggatttctcttatttgagactaagtag

SEQ ID NO: 5921 - DNA, 960 bp, Artificial Sequence
  Description of Artificial Sequence: Synthetic coding sequence
atgctgtggcgccaactgatctactggcagctccttgccttgttttttctgcccttttgcctctgccaggatgagtatatggaggtctccggtcgaacaaataaggtagtagcccgcattgtccaaagtcaccaacagacaggacgttccgggtcccgtcgtgagaaggtgagggagaggagccatcccaagactggtaccgtcgacaataatacaagcacagatctgaaaagcctcagaccagatgagctacctcacccagaggtcgatgatctggcgcagatcacgacattctggggccaaagtccacagaccggcggactgccacctgattgctccaaatgctgtcacggtgactacagttttagaggctaccagggtcctccagggccacctgggccacccggcattcctggcaatcatgggaataacgggaacaacggagcaacaggtcacgagggagctaaaggagaaaagggagacaaaggagatcttgggccaaggggagagcggggccagcatggacccaagggcgaaaaaggataccctggaattcctccagaattgcagatcgccttcatggctagcttagcaacacacttcagcaaccagaacagtggaatcatctttagcagtgttgaaacaaacatcggaaatttctttgatgtcatgacaggccgtttcggcgcgcccgtctctggggtttattttttcacgtttagcatgatgaaacatgaagacgtggaagaggtttacgtgtacttgatgcataatggtaacaccgtgttcagtatgtactcctatgagatgaagggcaagtctgatacctcatcaaatcatgcagtactgaagctggcaaagggagacgaggtttggcttcggatgggtaacggcgctcttcatggggatcatcagaggttcagcacctttgctgggttccttctgtttgagactaaatag

SEQ ID NO: 5922 - DNA, 855 bp, Artificial Sequence
  Description of Artificial Sequence: Synthetic coding sequence
atgacaaagtcctctcttaggccgttgcagaagcagtccccacagaccggaggtcttcccccagactgttcaaaatgctgccatggcgactacagctttcgcggatatcagggacctcccgggccacctggaccgcccgggataccagggaaccatggtaataatggaaacaatggcgccactggccacgaaggggcaaagggagagaagggcgacaagggtgacctgggcccaagaggagaacgcggacagcacggccctaagggtgagaaggggtaccccggaattcctcctgaattgcagattgctttcatggccagcctcgcgacacacttcagtaaccagaatagcggcattattttcagctccgtcgagacaaacatcggcaatttcttcgacgtcatgacaggcaggttcggggctcccgtgtcaggagtgtatttcttcactttctcgatgatgaaacacgaagatgtcgaggaagtttacgtgtacctgatgcacaacgggaacactgtttttagcatgtattcctatgagatgaaaggaaagtccgatacgagctccaaccacgctgtcctaaagttagccaaaggggacgaagtgtggctgaggatgggaaacggcgcactgcacggcgaccaccagcgttttagcacttttgcagggttcctactattcgaaacaaagtgccacggggagaccccggccggaccgcgggattctgcagccggaaagtccaaagcttacctctgccaagccgaatggatctggcctgttagaaaactgcttcctgtgagctggcccaggtaccagctctttggctttgtgcggtggaaggaacaacacatatag

SEQ ID NO: 5923 - DNA, 234 bp, Artificial Sequence
  Description of Artificial Sequence: Synthetic coding sequence
atggccaccaggagcgtccttcttgccctagtggtccttaacctgcttttctacgtcccccctggccggagtggacctaatgtctatattcaaaagattttcgcaagttgttggaggctccagggaacttgcaggccaaaatgtctgaagaatgagcaatacagaatcctttgtgataccatccacctctgctgcgttaatccaaaatatttgcccatactcacaggcaaatag

SEQ ID NO: 5924 - DNA, 237 bp, Artificial Sequence
  Description of Artificial Sequence: Synthetic coding sequence
atgaatctttgtctgtctgcccttctctttttcctagtgatccttctgccatctggtaaagggatgttcggaaatgatggcgttaaggtacgtacctgcacttcccagaaagcagtctgttttttcggctgcccccccggctatcgttggatcgcattctgtcacaatatcctgagctgttgcaagaacatgactaggtttcaaccgccgcaggccaaggatccttgggtccactag

SEQ ID NO: 5925 - DNA, 627 bp, Artificial Sequence
  Description of Artificial Sequence: Synthetic coding sequence
atgggggctcagggcgctcaggaatctatcaaggccatgtggcgagtgccggggaccacacggcgccctgtgacaggcgagagtccaggaatgcatcgacccgaagcgatgttgctgttgctcacactggctctcctgggcgggcctacctgggcgggaaaaatgtacggaccgggcggcgggaagtactttagcacaactgaggattacgatcacgaaattaccgggctcagggtgtccgtgggcctacttctggtgaaatccgtgcaggtgaagctaggagactcctgggacgtgaagctcggggccttgggcggaaacacgcaggaagtcaccctgcagccaggcgagtatatcactaaggtgttcgtcgccttccaggctttcctccgggggatggtcatgtatacaagtaaggatcgatatttctattttggcaagctggatggccagatatcatctgcttacccctctcaagagggtcaggtgctggttggcatctacggacagtaccagctgctcggtatcaaaagcattgggttcgaatggaattatcccctggaggaacctactacagagccgccagttaatctcacttattccgctaatagtcccgtcggcagatag

SEQ ID NO: 5926 - DNA, 288 bp, Artificial Sequence
  Description of Artificial Sequence: Synthetic coding sequence
atgaaattcctcctactggtgctcgcagctctgggatttctcacacaggtcatccctgcatctgctggggggagtaagtgcgtcagcaatactccaggctattgccgtacttgttgccactggggcgagacagcactgtttatgtgtaatgcctcgcgaaaatgctgtatctcatatagctttctgcctaagccggatcttccacaactgatcggtaatcactggcagtcacggcgccggaacacccagcgaaaggataagaaacagcagacgacagtcacttcctag

SEQ ID NO: 5927 - DNA, 339 bp, Artificial Sequence
  Description of Artificial Sequence: Synthetic coding sequence
atgttcgtgttgctgtatgtcacttccttcgccatttgtgcctcaggccagcccagaggaaatcaactcaagggagagaattactctccccggtatatctgtagcattccaggcctgcctggtcctccaggaccaccgggtgctaatgggtcaccgggtccgcacggccgcatcggcttacccggtcgtgacgggagagatgggcgaaagggtgaaaaaggagaaaagggtaccgctggtctgcgaggaaaaacgggtcccctgggactggcgggcgagaagggtgatcagggagaaacaggaaaaaaaggtccgatcgggcccgaaggggagaagtag

SEQ ID NO: 5928 - DNA, 300 bp, Artificial Sequence
  Description of Artificial Sequence: Synthetic coding sequence
atgggattatttatgattattgcaatactgctgttccagaaaccaaccgtgacagagcagctcaaaaagtgttggaacaactatgtgcaggggcattgtcgaaaaatctgcagagtgaacgaggtgcctgaggctctttgcgagaacggtaggtattgctgtctgaacattaaagagcttgaggcctgcaaaaaaattactaaacccccacgaccaaagcctgccactttggcactgacgctccaggactatgtcaccattattgagaattttccaagcctgaagacccagtctacttag

SEQ ID NO: 5929 - DNA, 336 bp, Artificial Sequence
  Description of Artificial Sequence: Synthetic coding sequence
atgaagagcctgctttttacgctagccgtctttatgcttctggcgcagctggtatcaggcaactggtacgtgaaaaagtgcttaaacgatgtgggaatctgcaaaaagaagtgtaagcccgaggagatgcatgtcaagaatgggtgggccatgtgcggcaagcagcgggactgctgcgtgccggcagataggcgggctaattacccggtgttttgtgttcagacaaaaaccacccgaatcagtaccgtcacagcgacaactgccacaaccaccttgatgatgacaacagcctcaatgtcaagcatggcccctacccctgtttcccccacagggtag

SEQ ID NO: 5930 - DNA, 1698 bp, Artificial Sequence
  Description of Artificial Sequence: Synthetic coding sequence
atggaggactccgactcagccgctaagcagctcggtcttgccgaggccgcagccgttgctgcagctgcggccgttgccgccgcggccgccgcagctgctggaggggaggcagaagagccagttctgagtagggacgaggatagcgaggaagatgccgacagtgaggccgagcgggaaaccccccgtgttacagcagtggccgtgatggcggccgagcccggacatatggacatgggggcggaagccttacctggtcctgacgaggccgcggcagccgccgcatttgccgaggtaaccactgtcaccgtggccaacgttggggccgctgccgacaatgtattcactaccagcgtggcgaatgcggcgtccatttcaggccatgtcctgtccggtcgaacggctttgcagattggagattcactgaataccgaaaaagcaaccctcatcgtggtgcacacagacggctctattgtggagaccaccggactgaagggacccgctgcacctttgacaccaggacctcaatccccaccgacacctttggctcctgggcaggaaaagggaggcacaaaatataactgggacccatccgtgtacgacagtgaactgccagtaagatgccgaaatatttccgggacgctttacaaaaacaggctcgggtccggaggcagggggcgttgcattaagcagggcgaaaactggtacagccctaccgagttcgaggcaatggcagggcgcgccagtagcaaggactggaagcggtctattcgctatgccggaaggccacttcagtgcttgattcaggacggtatcctcaatccacatgctgctagctgtacttgcgctgcatgttgcgatgatatgactttgtcagggcccgtgaggctgttcgtgccttacaagcggcggaagaaggaaaacgagctgccaaccactcccgtgaaaaaggatagccctaaaaacatcacgctgctgcctgctaccgcggcgacgacgtttaccgttactcccagcggccagattaccacttccggggcattgacatttgaccgcgcaagtactgtggaagctaccgcagtgatctctgagagtccagctcagggagatgtttttgccggtgctactgtccaggaggccagcgttcaacctccttgccgcgctagccaccctgaaccccactaccccggctatcaagactcatgccagatcgcacccttcccggaagcggccctgccaacctctcacccaaagattgtgcttacatcattaccagccctggctgtcccacccccgactccgactaaggctgcaccacccgccttggtgaatggcctggagctctccgagccccgctcctggctatacttagaggaaatggtgaattctctgctgaatacagcgcaacagctgaagacgctctttgaacaggcaaaacatgcctcaacatatagagaggctgccacaaatcaagctaaaatacatgccgacgcggagcgcaaagaacagagttgtgtgaattgtggccgggaggccatgagcgagtgtacaggatgtcacaaggtgaactactgcagtacattttgtcagcggaaggattggaaagatcatcagcatatctgtgggcaatcagccgcagttaccgtgcaggcggacgaggtgcatgtcgccgagtccgtgatggaaaaagtgacagtttag

SEQ ID NO: 5931 - DNA, 471 bp, Artificial Sequence
  Description of Artificial Sequence: Synthetic coding sequence
atgaacatcttaatgctgaccttcatcatctgtggcttactgacacgcgtgactaaagggtccttcgagcctcagaagtgctggaaaaacaacgttggccattgccgaaggcgctgcctggacactgaacggtacatactgttgtgccgaaacaaactctcttgttgtatatcgattatctcccatgagtatacgcgccggcccgctttcccagtgatacacctagaggatattactcttgattactcagacgtggattcctttaccggttcacccgtgtccatgctgaacgacctcatcacattcgacacaaccaaatttggggaaacgatgacccccgagactaatacacccgagactaccatgccccccagtgaggccacaacgccggagaccacaatgccacctagtgagaccgcgacttccgaaactatgccaccaccatctcagaccgccctgacccacaattag

SEQ ID NO: 5932 - DNA, 837 bp, Artificial Sequence
  Description of Artificial Sequence: Synthetic coding sequence
atgggtggacccagagccctattggcggccttgtgggctctggaagctgccggcacagctgccctgcgcatcggagctttcaacatccagtcttttggcgatagcaaagtcagcgacccagcgtgtggcagcattattgccaaaatacttgctggctacgacctggctctggttcaggaggtgcgagacccggatctcagcgcagtctccgccctgatggagcagatcaattcagttagtgagcacgagtattcgttcgtgtcctcccaacccctgggccgggaccagtacaaagagatgtacctcttcgtatatagaaaagatgctgtgtcagtcgtggacacatacctgtacccagaccccgaagacgttttttcccgggagccctttgtggtgaagttctccgctcccggcaccgctcaaaacctggtactgattccactgcatgccgctcctcaccaagctgttgccgaaattgatgcactgtatgacgtttacttggacgtgattgacaagtggggcaccgatgacatgcttttcctaggcgattttaacgcagactgttcctacgtgagagcccaggactgggcagctattcgtctgagaagcagcgaggtgtttaagtggctgataccagattcagcggatacaacagttggtaattcagattgcgcctatgacagaattgtagcatgcggggccagactgcgaaggtccctgaagccccagtccgccaccgtgcacgactttcaggaagaatttggtctggaccagacccaagccctcgccatttccgatcacttccccgtggaggtgaccctgaaatttcatcgatag

SEQ ID NO: 5933 - DNA, 3039 bp, Artificial Sequence
  Description of Artificial Sequence: Synthetic coding sequence
atggccgaagccgcactcgaagcggttcgtagcgagctgagagaatttcccgccgccgcgagggaattatgcgtgccactggctgtgccttaccttgataagccacctacgccattacatttttatcgtgattgggtgtgcccaaatagaccttgcataataaggaacgcactgcagcactggcccgcgctgcagaaatggagtctgccttacttcagggcaacagtggggtcaaccgaagtcagtgtggccgttacccccgacggctacgctgacgccgtgcgcggggacagattcatgatgccagcagaaagacggctgcctctaagtttcgtgctggacgtgttggaaggacgggcccagcacccaggcgttctgtacgtacagaagcagtgtagcaacctaccaagtgagctcccccagcttctgccggaccttgaaagccatgttccctgggcaagcgaggctctgggaaagatgccagacgccgttaatttttggctgggagaagccgccgctgtgacctcgctgcataaagatcattatgaaaacttatactgtgttgtcagtggagagaaacatttcctgttccacccaccttctgatcgtccctttattccttatgaattgtatactcctgcgacctaccaacttactgaggagggcacctttaaggttgtggacgaggaagctatggaaaaagctgaggtcagccggacctgcctgctgacagtccgcgtgctgcaggcacatcggctcccatccaaggaccttgtgaccccttctgattgttacgtgacgctgtggctccctacagcatgtagtcatcgcctgcagacgcggacggtcaagaactcttcgtccccagtgtggaatcagagttttcattttaggatacatcgtcagcttaagaacgtaatggagctgaaggtatttgatcaagatcttgtgacaggcgatgaccctgtacttagcgttctcttcgacgccggaacattacgggcgggcgagtttagaagggaatctttctccttatcacctcagggtgagggaaggcttgaggtggagttccgacttcagagcttggcggacagaggggaatggttagtgtcaaacggtgtcctcgtcgcccgtgagctcagttgcctgcatgtgcagttggaggaaactggagaccagaagagtagtgagcatcgggtacaattggtggtgcctggctcgtgtgagggcccacaggaagcctctgttggtacaggtacgttcaggttccattgtcctgcatgctgggaacaggaactaagtatccggctgcaggacgcccccgaggaacagcttaaagcgccattgtccgccctgcccagcgggcaggtggtgaggctggtttttccaacttcccaggagcctcttatgagagtggaactgaaaaaggaggctggattgcgggagctggcagtgagactggggtttggcccctgcgctgaagaacaggcgttcctgagcagacgaaagcaggtggtcgcagcggcgttaagacaggctctgcagctagacggagacctacaggaagatgaaatccccgtggttgcaattatggctactgggggaggaatccgggccatgacctccctatacggccagctggctggtctgaaagagctgggtctgctcgactgtgtgagctatatcaccggcgctagtggatctacatgggctctggctaatctgtacgaagaccctgaatggtcccagaaggacttagcaggacccactgagctgctcaagacacaggtaacaaaaaataagttaggagtgttggcaccctcacagctgcagaggtacagacaagagctggccgaaagagctcgtttgggctatccaagctgcttcactaacttgtgggcactgatcaacgaagccttgctgcatgatgagccgcacgaccacaaactgtcggaccagagggaagccctgtcccatggccagaaccctctgccgatctattgcgcacttaataccaagggacagtccctaactacatttgaatttggtgaatggtgtgaatttagcccatacgaagttgggttccctaaatacggcgcctttatcccttcagaattgtttggctcagaattcttcatgggccaactgatgaagcgattgccagaatcgcggatctgtttcctagaagggatttggtccaatctttatgcagccaacctgcaagactccctgtattgggcatctgaacctagccagttctgggatcgttgggtgaggaaccaagccaacttagacaaggagcaagtgcctctactgaagatagaggagccgcccagcaccgccggacgcattgccgaatttttcaccgacttattgacatggcgccctctggcccaagccacacacaatttcctgaggggcttacatttccataaagattattttcagcaccctcacttctctacctggaaggcaactacactggatggcctgcctaatcagcttacaccatccgagccccacctgtgtttgctggacgtgggctacctgattaatactagctgccttcccttattgcagcccacgcgggacgtagacttaatcctcagcctggactacaatcttcatggggcgtttcagcagctccagctgctagggcggttctgccaagaacagggaatcccctttcctcccatttcaccatctcccgaggagcagctgcagccacgtgaatgccatacgttcagcgatccaacatgtccaggcgctccagccgtgctccactttcctctggtgagtgattctttccgtgagtacagtgctcccggcgtgcggcgtacaccggaggaggcagctgccggggaagtgaacctgagttcctctgactccccgtaccactacaccaaagttacctactctcaggaggacgtggataaactgctgcacctgacgcactacaatgtctgcaacaaccaggagcagctgctggaggcgctgcgccaggcggtgcagcgtcgtcggcagcggcgcccccattag

SEQ ID NO: 5934 - DNA, 1548 bp, Artificial Sequence
  Description of Artificial Sequence: Synthetic coding sequence
atggcatggccatattttctggactgccacaggtactttactagagaagacgaaggatgttacgacccgctggaaaaactgcgcggcgggctcgaggcagacgaggctctgccatccgggctgccacctaccttcatacgatttagccaccatagttatgcacagatggtgcgagtcctcagacgcactgcaagtcgctgtgctcacgtggcccgaacctattccattggccgttcttttgacggtagggagctcctcgttattgaattttcaagtcgacccggtcagcatgagctgatggaacccgaagtcaaactaatcgggaatatccacggcaacgaagtcgcaggacgggagatgctgatctatttggcgcaatatttatgttccgaatacctgctgggcaacccacggatacagcgcctgttgaacacgactcggattcacctgctgcccagcatgaacccggatggatacgaggtggctgcagccgaaggcgcagggtacaacggctggacgtcaggccgacaaaacgctcaaaatctggatctcaataggaattttcccgatcttacctcagagtattatcggttggccgaaacccgaggtgcacggagtgaccatatacccatcccacagcactattggtggggcaaagttgccccggaaactaaggccatcatgaagtggatgcagacaatcccattcgtgttgtctgcgtccctgcatgggggggatctggttgtctcgtatccattcgatttttccaagcatcctcaagaggaaaagatgttttcccctacgcctgacgagaaaatgtttaagctgctgtcccgggcttacgcagacgttcatcccatgatgatggaccgctctgagaatagatgcggggggaactttctaaagaggggatctataatcaacggagccgactggtatagctttaccggggggatgagcgattttaattacctgcatacgaactgcttcgaaatcaccgtggaacttgggtgtgtgaagtttccacctgaggaggccctgtatattttgtggcaacacaataaggaaagtctgctcaactttgttgaaactgtgcacagaggaatcaaaggcgttgtcaccgacaagtttggaaagcccgtgaagaacgccaggatatcagttaaaggcattagacatgatattaccacagccccagacggtgactattggaggctcctgcctcccggaatccacatcgtgatagcccaagcacctggatacgctaaggttattaagaaggttatcatcccagccagaatgaaaagagccgggcgtgtggacttcattctgcagcccctgggaatgggccctaagaacttcatacacggccttaggagaacaggtcctcatgaccccttgggcggtgcctctagtctgggcgaagcaacagagcctgacccactccgggctagacgacagccatcggctgatggaagtaagccctggtggtggtcctattttactagcttatccacacaccgaccacgatggctgcttaaatactag

SEQ ID NO: 5935 - DNA, 285 bp, Artificial Sequence
  Description of Artificial Sequence: Synthetic coding sequence
atgcggacgttagcaattctggctgcaatcttgctggtagcactgcaggcccaagcagagccattacaggcccgagccgatgaggttgccgctgcaccagaacagatcgctgcggatatccctgaggtggtggttagtctggcctgggacgaatcactggcaccaaagcaccccggatcccgaaaaaatatggcctgctactgtcgaattcctgcatgcatcgctggcgaaaggcgttatggcacatgcatctaccagggcagactatgggccttttgctgttag

SEQ ID NO: 5936 - DNA, 420 bp, Artificial Sequence
  Description of Artificial Sequence: Synthetic coding sequence
atgggaaaccctggcggggttggatctgaaaggatgagggtcgcacggcgtacccggaatgtttgccgctgcccaagggctgctgggcccggggtaccggagccaagggccgcgcccttacccttgctcgcgatggcccctccacctgcctgtaggagccccatgtctcccccaccgccacctctgttactgctgctgctcagcctggccttgctgggcgctcgggctcgggctgaacccgccgggtccgctgtacctgcccagagtcggccctgcgtggactgtcatgcgttcgagtttatgcagagggctctgcaggacctgagaaagacagcgtgctcattagatgcaagaactgagactttattgcttcaggctgaaaggcgcgctctgtgcgcttgctggccagctggccattag

SEQ ID NO: 5937 - DNA, 471 bp, Artificial Sequence
  Description of Artificial Sequence: Synthetic coding sequence
atggcacctgccgtgaccagactcttgtttctgcagttagtcctgggaccaactcttgtgatggatattaagatgcaaatcggatcccgaaacttttacactttgtcaatcgactacccccgagtaaattacccaaagggctttcgagggtactgcaatggtcttatgtcttatatgcgtggaaagatgcagaacagcgactgcccaaaaatccattacgtgatccacgctccgtggaaggccatccagaagttttgcaaatacagcgatagcttctgtgagaactacaacgagtactgcactctgacccaggactctcttccaatcaccgtctgctctctgtctcaccagcagccaccgacctcttgctattataacagcactctgaccaaccagaagctttacctgctctgctccagaaagtacgaagccgacccaatcggaattgctggattgtattccggcatctag

SEQ ID NO: 5938 - DNA, 444 bp, Artificial Sequence
  Description of Artificial Sequence: Synthetic coding sequence
atgataatcatggtaataattttccttgtgctgctgttctgggaaaatgaggtcaacgacgaggcagtgatgtcgaccctggaacacttgcacgtcgactatccccagaacgacgttccggtccccgctagatactgcaaccacatgataatccaaagggtgatcagggaaccagatcacacttgcaagaaggagcatgtcttcattcacgaacggccccgcaagatcaatggaatctgcatttctcctaagaaagtagcatgccaaaaccttagcgcaatattctgttttcagtctgagacaaaatttaaaatgacggtctgccaactgatagagggcacacgctaccccgcctgccgatatcactatagtcccaccgaaggtttcgtgctggtgacctgcgatgatctgcggcccgacagtttcctgggctatgtgaaatag

SEQ ID NO: 5939 - DNA, 453 bp, Artificial Sequence
  Description of Artificial Sequence: Synthetic coding sequence
atgagatttatggctggcccagccggatcccaatctttaggccctctctgcttccatagtagcccccaggcactttatacagtcctcctgattgtactggtgatgatgtctctggtttttgggaaattcgtgccagtcaactgggaaccaccccagccactcccattccctaaatatctcaggtgttatcgctgtctgctggagacaaaggaactagggtgcctgctgggatcagacatctgccttactcccgccggttcaagttgtatcacactgcacaaaaaaaattcgagtggcagcgacgtgatggtgagcgattgtaggagcaaggaacagatgagcgattgtagtaacacacgcaccagtcctgtgagtgggttttggattttctctcagtattgctttcttgacttctgcaatgatcctcagaataggggcctgtatacaccctag

SEQ ID NO: 5940 - DNA, 2742 bp, Artificial Sequence
  Description of Artificial Sequence: Synthetic coding sequence
atgggaccagaggccctaagttcactgctccttctactactagtggcctcgggggacgctgacatgaagggtcatttcgatccggctaagtgtaggtatgcattaggcatgcaagaccgcactatccccgactctgatatcagcgcttcctcatcctggagcgatagtactgctgcaagacactccagactcgagagctccgacggtgatggtgcttggtgccccgcaggcagcgtgttcccgaaagaggaggagtaccttcaggtggacctccagcgtctgcacttggtggctctggtgggcactcaggggcggcatgccggaggtctgggcaaggaattttctcgatcgtataggcttcgatattcacgtgacggccgcagatggatgggatggaaggaccggtgggggcaggaagtaatttcagggaatgaggacccggaaggcgttgtgttgaaggaccttggcccccctatggtcgcacggctcgtgagattttatcctagggcggatcgggtgatgtccgtatgccttagggttgagctgtacggctgcttgtggcgagacggacttttgtcctacaccgctcccgtagggcagacaatgtatctgagcgaagccgtctacctcaacgactctacatacgacggccatactgttgggggcctacagtacgggggtctcggccaactcgcagacggggtggtggggttagacgacttccgcaaatcacaggagctgcgggtctggccgggatatgactacgtggggtggtcaaaccacagcttctcaagcgggtatgtggaaatggagttcgagtttgaccgcctcagggcattccaggcaatgcaggtgcactgcaacaacatgcatactctcggggctcgcctcccaggtggcgtagaatgtcgcttcagacgagggcccgcaatggcctgggagggagaaccaatgcgccataatctgggaggcaacctcggggacccgcgtgccagggcggtgtcagtccctcttggcggacgggttgctcgcttcctgcagtgccgcttcctattcgccggaccctggcttctcttttccgaaatttcctttatcagcgatgtggtgaataattcttcaccagcccttggcggtactttcccgccagctccctggtggccacctggacccccacctaccaacttcagcagcctggaactggaaccccggggacagcagcctgtcgccaaggcagagggcagccctacggctatactcatagggtgcctagtggccatcattcttctcctgctgctgatcattgccctgatgctttggagattacattggagaagactgctgtcaaaggctgaacgtagggtgctggaggaagagttgactgttcatctttcagtgcccggcgacaccattctcatcaacaaccgtccaggcccccgcgaaccgccaccataccaggagccaaggccacgaggtaacccaccacattcagccccatgcgtacccaatggcagcgctctcctgttgtcaaacccggcataccgcctcctcctggccacatacgcaaggcctccccgcgggcccggtcccccaacacccgcttgggctaagccaaccaacactcaggcctactccggtgattacatggagccagagaaacccggggcaccgctactgccaccccccccccagaattcagtgccccattatgctgaggccgatattgtcaccttacagggtgtgaccggcgggaatacctacgccgtacctgcccttccccctggggctgtgggcgacggacctccccgggtcgattttccacgctcccgtctgagatttaaagagaagctcggcgagggccagttcggagaggtacacctgtgcgaagtggattctccccaggacctggtttccctcgacttccccttgaatgttcggaaaggccatccgctgctggtggccgtgaaaattttgaggcccgacgcgacaaagaacgctcggaatgacttcctgaaggaggtgaagatcatgtctagattgaaagaccctaatatcatacggttgctgggggtgtgcgtccaggatgatccgctgtgtatgattacggactacatggagaatggtgacctgaatcagttcttgagcgctcaccagctggaagataaggcagctgagggtgcgccgggcgatggccaagccgctcaggggcctacaattagttaccccatgctcctccatgttgccgctcagattgcctctggcatgcgatatctggccacacttaactttgtccatcgcgatctcgctactaggaactgcctggtaggggagaactttacaattaagatcgcagactttggcatgtcccgcaatctctatgcaggggattattacagggtgcagggacgggccgtcctgcctattaggtggatggcttgggaatgtatattgatggggaagtttaccacggcgagcgacgtgtgggcatttggcgtaacgttatgggaagttctgatgctctgccgggctcagcccttcgggcagctgacagacgagcaagtaattgaaaatgcgggggagttcttccgtgatcagggaaggcaggtttacctttctcgccctcccgcttgtccgcaggggctttacgaactgatgcttaggtgctggtcccgagagtcagagcagcgcccacccttctcccagctccatcggtttctcgccgaagacgcgctgaacaccgtgtag

SEQ ID NO: 5941 - DNA, 453 bp, Artificial Sequence
  Description of Artificial Sequence: Synthetic coding sequence
atgcgcttcatggctggccccgccggcagccagagcctagggcctctctgctttcattcttctccccaggccctgtacacagtactcctgattgtgctcgtcatgatgtcccttgtttttggaaagttcgttccggtgaactgggagcccccgcaacctttaccattccccaagtacctgcggtgttatcgctgcctgctagagaccaaagaactcggatgcttgttgggctctgacatttgtttaactcccgccgggtcttcttgcattacactgcacaaaaagaactcctctgggtccgatgtgatggtgtctgattgtcggtcgaaagaacagatgtccgattgctcaaatacaagaacctctcctgtcagtggattttggatcttctctcagtattgtttcctggacttttgcaacgacccacagaaccgcgggttgtacactccctag

SEQ ID NO: 5942 - DNA, 567 bp, Artificial Sequence
  Description of Artificial Sequence: Synthetic coding sequence
atgtttcaccagatttgggccgcactgctgtacttttatggcatcattctaaattctatttaccagtgtcctgaacactctcagctgaccactctcggcgtggatgggaaggagttcccagaagtacatctcggccaatggtacttcatcgccggggcagccccaacaaaagaagaactcgctaccttcgatcccgttgataatatcgtattcaatatggccgcaggatctgctcccatgcagctccatctgagagcaactatcagaatgaaagacggcctgtgtgtccccagaaagtggatctaccaccttactgagggaagtaccgatttgcgtaccgaggggcggcctgacatgaagaccgaactcttttcttcctcctgccctggcggtataatgttgaacgagactggccagggatatcaacgttttctcttgtacaacaggagtccacacccccctgagaaatgtgtggaggagttcaagtctctgaccagctgcctggactctaaagccttcctgctgaccccccggaaccaggaggcctgtgaattgagcaacaactag

SEQ ID NO: 5943 - DNA, 2535 bp, Artificial Sequence
  Description of Artificial Sequence: Synthetic coding sequence
atgggacctggagccccctttgcacgagtgggatggcctctccccttacttgtggtaatggccgctggggtggccccggtatgggcaagccattcgccacacctaccacggccccatagtcgtgtccctccccacccatcaagcgagaggcgcgcagtgtacatcggtgctctctttcctatgtcggggggctggccgggcggccaggcgtgccaacccgccgttgaaatggcactggaagacgttaattctcgcagagacattcttcccgattacgagttgaagctcatccaccacgattccaagtgcgatccggggcaggccacgaaatacctttacgaattgctctacaacgatcccatcaagatcatcctcatgcccggctgttcatcagtgtccacactggtggctgaagctgctagaatgtggaatttaatcgtgctatcctacggtagctcttctcccgccctgtcaaatagacagaggttcccaaccttctttcggacgcatccctccgcgaccttgcacaacccaactagagtcaaactattcgagaaatggggttggaaaaagattgctacaattcaacagaccactgaggtctttacgtctaccctggatgacctggaagaacgcgtaaaggaggccggcatcgaaattacctttagacaaagttttttctccgatcctgccgtgcccgtcaagaatctgaagcggcaggacgcaagaattattgtgggactcttctatgaaacagaagcaaggaaggttttttgtgaggtttacaaagagcgattgtttggcaaaaaatatgtttggttcctgatcggatggtatgcagacaactggttcaaaatctatgacccttccattaattgcacagtcgatgaaatgactgaagccgtggaaggtcacatcacaaccgaaatcgtgatgctcaatccagccaatacgcgtagtatctctaacatgacctctcaagaatttgtagaaaagctgactaaaagactgaaaaggcatcctgaagaaaccgggggttttcaagaggccccactggcctatgatgccatatgggcattggccctggccctcaataagactagcggcggagggggacggtcaggcgtgcggcttgaagattttaactataacaaccagaccataacagaccaaatctaccgcgctatgaatagctcatctttcgagggtgtgagtggccatgtggttttcgatgctagcggttccagaatggcctggacgttgattgaacagctgcaaggcggctcctacaagaaaatcggctattacgatagtaccaaagatgacctgtcttggtcaaaaaccgacaaatggatcggaggatcgcctccagcagatcagactctggtgatcaagacattcagattcctgtcacaaaagctctttatatccgtctcagtgctttcgtccttgggtatcgtcctcgctgtggtctgcctgtcattcaacatctacaattctcatgtgcgatacattcaaaatagccagccgaacctgaacaacctcaccgccgtcggttgttccctggcacttgcggcagttttccccctgggtctagatggttaccacatagggaggaatcagttcccattcgtctgtcaagcccggctgtggctactggggctgggctttagtttgggatatggcagcatgttcactaagatctggtgggtccatacagtctttacaaagaaggaggagaagaaggagtggcggaaaacgctggaaccctggaagctgtacgctaccgtgggcctcctcgtgggaatggacgtgctgacacttgcaatttggcagatagtggatcctctgcatcgaaccatcgagacttttgctaaagaggaaccaaaggaggatattgatgtgagtattcttccccagctggagcactgctccagccgtaaaatgaacacatggctggggattttttatggctataagggactcctgctgctcctgggcattttcctagcatacgagactaagagcgtcagtaccgagaaaatcaacgaccatcgcgccgtgggcatggcaatttacaacgtggccgtgctgtgtctcataacagcaccggtgacaatgattcttagtagccagcaggatgccgcctttgcctttgcatcactcgccattgtgtttagttcttacatcaccctcgtagtcctgttcgtgcccaaaatgcggcggttgatcaccagaggggaatggcagtccgaagcacaggataccatgaaaacgggcagctctacaaataataacgaggaagagaaatcccgtctgctggaaaaagaaaaccgagaacttgagaaaataatagcagaaaaggaagaacgggtgtccgagttacgacatcaactccagtctagacagcagctgcgatcacgaagacatccccccacaccacccgaaccttctggcgggctgcccagagggccacctgaacccccagacaggctgagttgtgacggcagcagagtgcacctgctatataaatag

SEQ ID NO: 5944 - DNA, 237 bp, Artificial Sequence
  Description of Artificial Sequence: Synthetic coding sequence
atgggatctgggctgcccttagtgttgctcctcactctgctcgggtcttcacacggcactggaccaggaatgacccttcagttgaaactgaaagaaagcttcctgacgaactcaagttatgagtcaagctttctggagctgctggaaaaactgtgccttctgctgcacctcccgagcggcacttctgtcaccctgcatcacgctaggagtcagcaccatgtagtatgcaacacctag

SEQ ID NO: 5945 - DNA, 2700 bp, Artificial Sequence
  Description of Artificial Sequence: Synthetic coding sequence
atgcttcttctgctcctgttagctcctcttttcctgcggccacctggggctgggggcgctcagacgcctaatgcgacaagcgagggctgtcagatcattcacccgccctgggaaggcggaattcggtaccgaggattaactagggatcaggtcaaggccatcaatttcctgccagtggactacgaaatcgagtacgtgtgtaggggtgaaagggaggtggtaggccctaaggttcgcaaatgcttggctaatggatcttggacagatatggataccccaagtaggtgtgtgaaccggaccccccactcagagcgcagggcggtgtatataggagccctctttcccatgtcaggtggatggccaggcggacaggcctgccaaccagcagtggaaatggcgttggaagatgtgaactcacgacgagacattctgcccgattacgagctgaagctcattcaccacgactcgaagtgcgaccccggacaagccaccaagtacttgtatgagttgttgtataacgatcccattaaaattatcctgatgccaggttgttccagcgtaagcacactcgtcgccgaggcagccagaatgtggaatcttatcgttctgagttacggatccagctcccccgcactgtccaatagacaacgttttcctaccttcttcaggacacaccctagcgctacccttcataatcctactcgggtgaagttgtttgagaaatggggctggaagaaaatcgcaacaatccagcagaccaccgaggtcttcacttccacccttgatgatcttgaagagcgagtgaaggaggcaggtattgaaatcactttccgacaatcatttttctctgatcccgccgttccggttaaaaacctgaagaggcaggacgcacgaattatcgtcgggctgttctacgagacagaagcccgtaaggtgttctgcgaggtctataaagagcgccttttcgggaagaagtacgtgtggttcctcatcggatggtacgctgacaattggttcaagatttacgacccgagcatcaattgtactgtagacgaaatgaccgaggcagtagagggacacattacgaccgagattgtcatgctgaatccggctaatacacgaagcatctcaaacatgacgtctcaggaattcgtggagaagctcaccaagcgtttaaaacgtcatcccgaggagacaggaggattccaggaggcacccctcgcttatgacgcaatatgggcccttgcattggccctcaacaagaccagcggagggggcggtcgcagtggagtgaggttagaagactttaactacaacaaccagacaatcacagatcagatctatagggccatgaactcgtcttctttcgaaggtgtatccggacatgtggtgtttgacgcgtctggcagccgaatggcgtggaccctgattgagcagttacagggtgggtcctataagaaaataggctattatgatagcaccaaggatgacctgtcatggtcaaaaacagacaaatggatcggcggttccccacccgcagatcaaaccctggtcattaaaacgttccggttcctctcacagaaactgtttatcagtgtcagcgtgttatcctctcttggtatcgtgcttgcagtggtgtgtctctcattcaatatttacaattctcacgttaggtacatacagaactcccaacctaatctgaataatctcaccgcagtgggatgctcactggcactcgcggcagtctttccacttggattagatggttaccacattggtcggaatcagtttcctttcgtgtgccaggcacggctttggttactggggctggggtttagcttaggctacgggtccatgtttaccaaaatttggtgggtgcataccgtgttcacaaagaaagaagagaagaaagagtggcgcaaaacactggagccttggaagctgtatgctaccgtaggactccttgtggggatggacgttctgaccctagctatttggcagatagttgatcctctgcatagaactattgagaccttcgccaaagaggagccgaaggaggatatcgacgtgtctatattgccccagctggagcactgttctagcagaaaaatgaatacatggctcggcattttctatgggtacaaaggccttctgttgctgcttggcatctttctcgcgtatgagaccaagtctgtgtctaccgagaagatcaacgaccaccgggccgtagggatggcgatctacaacgtcgcagtattgtgccttatcacagcgcctgtgaccatgatcctctccagccaacaggatgccgcctttgctttcgctagcctcgctattgttttctcgtcctatataaccttggtcgttctgttcgtgcccaaaatgaggcggttaataacaaggggtgaatggcagtcagaggctcaggatactatgaaaactggatcttccactaataataacgaggaagagaaaagtcgcctgcttgaaaaggagaacagggaactcgagaaaattattgccgaaaaggaggagcgggtcagcgaactgcgccaccagctacagagcagacagcagctccgaagccgacggcacccaccgacaccaccagagccgtccgggggtctgcctagagggccacccgaacctccagacaggctgagttgcgacggtagccgcgtccacctgctttataaatag

SEQ ID NO: 5946 - DNA, 2886 bp, Artificial Sequence
  Description of Artificial Sequence: Synthetic coding sequence
atgttactgctgctgctcctggcacctctcttccttagaccaccaggagcgggcggcgctcagaccccaaacgctaccagcgaggggtgtcagattattcaccctccttgggagggaggcattcggtaccgagggctgacacgcgatcaggtgaaagcaattaactttctgcccgtagattatgagattgaatatgtctgccgcggtgagcgcgaggtggtcggccctaaagtcagaaaatgtttggctaatgggagttggactgacatggatacgcctagccggtgcgtgcgaatctgctccaagtcctatctgacattggaaaacgggaaagttttcctgaccggcggagatctgcccgccctggacggtgccagagtagattttaggtgtgaccccgatttccaccttgtcggcagttctcgctctatctgttcccagggtcagtggagtacccccaagccccattgccaggtgaatcggacaccccactccgaacgtagagccgtgtatatcggagctttgttcccaatgtccggaggctggcccggtggtcaagcatgccagcccgctgtggaaatggcgctggaggacgtaaacagccgcagagacattctacctgactacgagctcaagttgatccatcacgactcaaaatgcgacccaggccaggccacaaagtacctttatgaactgctctacaatgaccctattaagattatacttatgccggggtgtagcagcgtgagtacactggtggccgaggccgcacggatgtggaatttgatcgtgttgtcgtatggttcatcctctcccgcactgtctaaccgccaaaggtttccaaccttctttagaactcaccctagcgccactcttcataaccctaccagggtgaaactctttgaaaagtggggctggaagaagattgctactatccagcagacaacagaggtgttcacttcaaccctggacgatctggaggagcgagtcaaggaagctggcattgaaatcacattccgacagtcctttttttctgacccagcagtgccggtgaagaatctgaagaggcaagacgcccgcatcatcgtagggttgttctatgagactgaggcgagaaaagtgttttgcgaggtgtataaggagcggctgttcgggaaaaagtatgtgtggttcctgattggctggtacgctgacaactggttcaagatctatgatccaagcattaactgcacagtggacgagatgacagaagctgtggagggccatattaccacggagatcgtcatgctgaatccagcaaatacacgctccatatcaaatatgacaagtcaagagttcgttgaaaagcttacgaagagactgaagcggcatcctgaggaaactggtggctttcaagaagcaccgttggcatacgatgccatttgggctctcgctctggcactgaataagacaagtggaggaggcggccggtccggcgtgaggctggaggatttcaattataataaccagacaattaccgaccagatctatcgggccatgaattccagtagcttcgagggcgtgagtggccatgtggtctttgatgccagtggttcccgcatggcctggaccctgatcgagcagttacaagggggtagctacaaaaagatcggctattacgattccaccaaggacgacctgtcctggtccaaaacagataagtggatcggtggttcacctccggctgatcagacgctcgtcatcaagacattcaggttcttgtcgcaaaaactgttcatttcagtctccgtcctatcctcattgggaattgtactagcagtggtgtgtcttagctttaatatttataatagccacgtgcgatacatacagaattcgcagcctaacctcaacaatctgaccgctgtaggctgctctctggccctggctgcagtgtttccactcggtctggacggttaccatattggcaggaaccagttccctttcgtgtgtcaggcacgtctgtggttactcggtttgggcttttctctcggatatgggtccatgttcaccaagatatggtgggtgcacaccgtgttcacgaagaaagaggagaaaaaggaatggcggaaaactctggaaccatggaagctctatgctaccgtcggtctattggtgggtatggatgtactgactctggctatctggcaaatagtcgacccattgcatcgcaccatcgagacgtttgccaaggaagagcccaaggaggacatcgatgttagcattctgccacagctggaacactgttctagtcgcaagatgaacacttggctcggaatattttacggctacaaaggcctcctcctactgctgggcatttttctggcctatgaaacgaaatccgttagtacagagaagattaatgaccacagagccgttggcatggcgatatataatgtggcagttctttgcctgattactgcacctgtcaccatgatcctgagctcacaacaggatgctgccttcgcgtttgcctcccttgctatcgtgtttagctcttatatcaccttagtggtgctgtttgtccccaaaatgcggcgtcttatcactcggggtgagtggcaatccgaagcccaggacacgatgaagacggggagctctacaaataataacgaagaagagaagagtcggctcctcgagaaagaaaatagggaactggaaaaaattattgcagagaaagaagaaagggtgtccgagctgcggcaccagctgcagagccgccagcaattgcggagccggagacatccacctaccccacctgaaccatccggaggtctcccacgcgggccgcctgaacctccggaccgactttcttgcgatgggtctagggtacatctcctgtacaaatag

SEQ ID NO: 5947 - DNA, 2535 bp, Artificial Sequence
  Description of Artificial Sequence: Synthetic coding sequence
atgggccctggggccccgtttgccagagtgggttggcctctccctctgttggtggtgatggcagcgggtgtggcgcccgtctgggcctctcacagccctcacctgcctagacctcattcacgcgtgccaccccaccctagctctgagagaagggcagtgtacattggcgctttgttccccatgagcggagggtggccgggcggccaggcatgccaaccagccgtcgaaatggctctggaggatgtgaatagcagacgcgatattttgccagattacgaactcaagctgatccatcatgactcaaaatgcgaccccggacaggctacgaaatacctgtacgaacttctatataacgaccccataaagatcattctgatgccgggttgctccagcgtatcaaccttagtggcggaggcagcgcgcatgtggaacttaattgtgctaagttatggttcctcttcccctgctctctccaaccgccagaggttccctactttttttagaactcacccctccgccactctgcacaaccctacaagagttaagctgtttgagaaatggggatggaagaaaatcgccactatccaacagacaaccgaggttttcacgtcaactctggatgatctcgaggaacgcgtcaaagaagcaggcatcgagataacctttaggcaatctttctttagcgatcctgcggtgccggtgaaaaatctgaaacgccaagacgccagaatcatcgtggggctgttttacgaaaccgaggcacggaaggttttctgtgaggtgtacaaggaaaggctttttggcaagaaatatgtttggttcctgattgggtggtatgcggataattggtttaagatctatgaccctagcattaactgtacagtcgacgagatgacggaagcggtggaagggcatattacaacagaaattgttatgctcaaccctgccaacacccgctccattagcaacatgaccagtcaggaatttgtggaaaaactcaccaaacgtctgaagcggcaccccgaggaaactggagggttccaagaggctcccttggcatatgatgccatttgggcccttgctctggcgctgaacaaaacttctggaggtggtgggcggtcaggcgtcagactggaggactttaattacaataaccagaccattacggatcagatctaccgcgcaatgaatagtagctccttcgagggggtttccggacacgtcgtgttcgatgcttctgggagccgaatggcctggactttgatcgaacagttgcagggcggctcttacaagaagatcggatattacgatagtaccaaagacgacctgagctggtccaaaactgataaatggattggggggagccctccagccgaccagacgctggttataaaaacattccggttcttgtcccagaaattatttatctcggtctccgtgttgtcaagtctgggaattgtactcgccgttgtctgcctttccttcaacatctacaattcccacgtgagatacatacagaactctcaacccaacctgaacaatttaacagccgtaggatgtagcctagctcttgcggctgttttcccactcggcttggacggctatcacattggtaggaaccagttccccttcgtgtgccaggctcgtctatggctcctgggacttggattttctctgggatacgggagcatgttcacaaagatatggtgggtgcatactgtgttcaccaagaaggaagagaaaaaagagtggcggaaaaccctggagccgtggaagctgtacgccacagtcggcctgctagttggtatggatgtgctgacccttgcgatatggcaaatcgtcgatcctttacataggaccatagaaacattcgctaaggaggaaccaaaagaggacattgatgtgagcattctgccacaattggaacattgttcttctaggaaaatgaacacctggttgggcattttttatgggtataagggactgctgctacttttggggatttttttagcctatgaaaccaagtctgtgagcaccgagaaaatcaatgatcacagagcagtgggtatggccatttacaatgtggccgtcctgtgcctgatcactgcgcctgtgactatgatactgagctcacagcaggacgctgcgttcgcgttcgcaagtctagccattgtgttctcgtcttacattactttagtggtactgttcgtgcccaagatgagaagactgatcaccaggggcgaatggcagtctgaggcccaagatactatgaagaccggttcttctactaacaataatgaagaggagaagtcccggctactggagaaagagaatagggagctggaaaaaattatcgcagagaaggaggaacgggtgtcagagttgcggcaccagctccaatcacgacagcaactccggtcaaggaggcacccaccaacgccccctgaaccatccggaggcctgcctcgcggtccccccgagccccctgataggttgagttgtgatggcagcagggttcatctgctatataaatag

SEQ ID NO: 5948 - DNA, 2535 bp, Artificial Sequence
  Description of Artificial Sequence: Synthetic coding sequence
atgggccccggagcacctttcgcgagagtagggtggcccttgccactcctggtggtgatggccgccggcgtggcaccagtgtgggccagccacagccctcatcttccacggccccactctcgggtgcccccacacccctctagcgagcgacgggccgtctatataggcgcactgtttcccatgagcggtgggtggcccggaggtcaggcttgtcagccagccgttgagatggccctggaggatgtgaacagcaggagagatattttacccgactacgaactcaaactgatacatcatgactcaaagtgcgaccccgggcaggctaccaagtatctgtatgagttactttacaacgaccctatcaaaattattctcatgcccggatgcagcagtgtctcaaccttggtggccgaagcagcccggatgtggaacctgatagtgctcagttacggatcgagcagcccagcactgagtaatcggcagcggtttcctacctttttcagaacacacccctctgccacactgcacaaccctacccgagttaagctgtttgagaagtggggttggaagaaaattgccacaatccagcagactacagaagtgttcacttcaacgcttgatgatctagaggaaagggttaaagaggctggtatcgaaatcactttccgccagtcttttttcagcgacccggcggtccccgtgaagaatctcaagcggcaggacgcccgcattatcgtaggactcttctatgaaacagaggcacggaaggtgttttgcgaggtctacaaggagcgcctgtttggcaaaaagtatgtatggtttctgatcgggtggtacgcggacaactggttcaagatttatgatccttctattaactgtaccgtggacgagatgacagaagcggtggagggacacatcacaactgaaatagtaatgttgaaccctgccaatacccggtccataagtaacatgacatcacaggaattcgtggaaaagctaacaaagcggcttaagaggcacccggaggagacgggaggcttccaggaggcccccttagcttatgatgctatatgggccctggcactggcccttaacaagaccagtggagggggcggaagatctggggtcaggctcgaagacttcaactataataatcaaacaattaccgatcaaatataccgggcaatgaacagttcttcctttgagggcgtaagtggccacgtcgtgtttgacgcgagcggttcacgcatggcctggacactgatcgagcaactgcaagggggcagttataagaagattgggtactacgattctaccaaagacgacttgtcctggtccaaaacagacaagtggatcgggggttcaccgccggctgaccaaactttggtgataaaaacctttcgattcctgtcccagaagttgtttatttccgtgagtgtcctgagttcccttggtatcgtcctggcagtggtgtgtctgtcattcaacatatataattctcatgtgaggtacatccagaacagtcagcctaatctgaataatttgactgccgtgggctgcagtctggccctggcagctgtgttccctcttggtctggacgggtatcatattggtcggaaccagttcccttttgtctgtcaggcccggctgtggttgcttgggctcggtttctccctcggctacggcagtatgttcacaaagatatggtgggtgcataccgtgtttacaaaaaaggaagagaagaaggaatggcgcaaaaccctcgagccttggaagctctatgccacagttggacttctcgtgggcatggacgtgctgaccctcgctatctggcagattgtggaccccttgcatcgtactatcgaaacatttgcaaaagaagaaccaaaagaggacatcgatgtgtctattctaccccaactggagcattgtagttcacgaaagatgaatacttggttggggattttctatggttacaaggggcttcttctccttctgggaatattcttggcctacgagacaaaaagtgtatctactgaaaaaataaatgatcatagggcagtcggcatggcgatatataatgttgcagtgctgtgtttaattaccgccccagtgactatgatcctgagctcgcagcaggacgccgcgtttgcatttgcctctttggccatagttttttcgtcttacattaccctcgttgtgctctttgtgccaaagatgaggagacttattaccaggggcgaatggcagagcgaggcccaggacacaatgaagacaggctcttctacaaacaacaacgaggaggaaaagtctagactgctggagaaggaaaaccgggaactcgaaaaaatcatagccgagaaggaagagagggtatctgaacttaggcaccagctgcagtctcggcagcagctgagatcaaggcgccatccaccaacgccccctgagccatcaggaggactgccacggggcccaccggagcctcccgatcgactgagttgtgacggaagcagggtgcatctcctgtacaagtag

SEQ ID NO: 5949 - DNA, 2700 bp, Artificial Sequence
  Description of Artificial Sequence: Synthetic coding sequence
atgctcctgcttttgctgctagcccctctattcctcagaccgcccggggcagggggggcccaaaccccaaatgcgacctctgaaggctgtcaaatcattcacccaccatgggaaggggggattaggtaccggggactgacccgcgaccaggtgaaggctatcaactttctgccagtagattatgaaatcgaatacgtctgccgtggggagagagaagtggtaggaccaaaggtacgtaagtgcctcgccaacggaagttggactgatatggataccccatcccgctgcgttaacaggaccccccactctgagaggcgggctgtgtacatcggggcactgtttccgatgtctggcgggtggcctggcggccaggcttgccagccagcggtggaaatggctttggaggacgtcaattctaggagagatattctgcccgactatgagttgaaactcatccaccacgattctaagtgtgaccctggccaggctactaagtacctctacgagttgttatataatgatcctatcaagattattttaatgccgggatgctcctccgtgtccaccctggtggcggaagccgcccgcatgtggaacctcatagtgctcagctatggtagtagctccccagcactctccaaccgacagcgatttcccaccttctttagaacccatccctccgcaaccctgcacaatcccaccagagtaaaattattcgagaagtggggatggaaaaaaatagctactatccagcagactactgaggtattcacgagtaccctcgacgatctggaagagcgcgtgaaagaggcaggtattgagattacctttcgtcaaagcttcttttcagatccagcggtaccagtaaagaacctgaagaggcaggatgcacggatcatagtgggactgttttacgagaccgaagctaggaaagtcttttgtgaggtatataaggagcggctgttcgggaagaagtatgtgtggtttctgatcggatggtatgccgataactggttcaaaatttatgatccctcaatcaattgcacagtcgacgagatgacagaggcagtggaggggcatattaccaccgagatcgtcatgctgaaccctgcaaatacccgtagcatcagtaatatgacctctcaagaatttgtggaaaaactcacgaagagactaaagcgacaccccgaagaaaccggagggttccaagaggcccccctagcatatgatgcaatctgggccttggcgctcgcacttaataagacgtccggtgggggtggtaggagcggcgtaaggctcgaggatttcaactacaacaaccagaccattactgaccagatctatagagccatgaattcctcctcatttgagggtgtgtctggacacgtggtttttgacgcctccggatcacggatggcgtggactctgattgagcagctacagggcggctcatataaaaaaattggctattatgattcaaccaaagacgacctctcctggtccaaaaccgataagtggattggagggtctccgccagccgatcagacactggtaattaagaccttccggtttttatcccagaaactcttcatcagcgtgtccgtgcttagcagcttaggaatcgttcttgccgtcgtgtgcctttctttcaatatctataacagccatgtccgctacattcagaactcccagccgaacctaaataatctgactgcagttggatgctcgttagccctggctgcggtgtttcccctggggctggatggataccacataggacgcaatcagtttcccttcgtgtgtcaagcacggttatggctactcggcctgggattttcccttggttacggctcaatgttcaccaaaatctggtgggtgcatactgtcttcacgaagaaagaggagaagaaggagtggagaaagacactcgaaccctggaagctgtacgccacagtgggcctgctggtgggcatggatgtactaaccctggcaatctggcagatcgtggatcctcttcaccgcacaatcgaaacatttgccaaagaggagccaaaagaggacatcgacgtctccatattgccgcagctggagcactgtagctccagaaagatgaacacttggctgggaatcttctacggctataaaggactcctgctgttgctggggatcttcctggcttatgaaacaaagtctgtgagcaccgagaaaatcaatgatcaccgtgcggtcgggatggccatttataatgtggctgtactttgccttatcactgcccctgtaactatgatcctgtcaagccagcaggatgcagcttttgccttcgccagcttagcgatcgtgtttagtagttacatcacccttgtcgtgctgtttgttccaaagatgagacgcctcatcacccgcggcgagtggcagagtgaggcccaagatacaatgaaaactggttcgagcaccaataacaacgaggaggaaaaatcaaggctcctcgaaaaggagaacagagagctagagaagatcatcgccgagaaggaagagagagtatcagagctccggcatcaactgcagtctagacagcagctgcggagtcgtcgccaccccccaactcccccggagccctccggggggctgcctagaggaccaccagagccaccagatcgactctcctgtgacggaagtcgcgttcacctattgtacaagtag

SEQ ID NO: 5950 - DNA, 2886 bp, Artificial Sequence
  Description of Artificial Sequence: Synthetic coding sequence
atgctgcttttgttgctgttggcgccattatttctcaggcctcccggagccgggggggcacaaaccccgaatgctacatctgaaggatgtcagatcatccaccctccatgggaagggggcataagatatcgggggctcacccgggatcaggtaaaggccatcaatttcctgcccgtagattatgagatcgagtacgtgtgtcgcggtgaacgggaggtggtggggccaaaggtcaggaagtgtctcgcaaacggcagctggaccgatatggatacgccgagccgctgtgtgcgcatctgcagcaagtcctacttaactcttgagaacggcaaggtcttcttgaccgggggcgaccttcctgcactcgatggagctagagtggacttcagatgtgatccggactttcacctcgtgggtagctcaaggtctatctgcagccagggacagtggagcacaccaaaacctcattgccaagtgaataggacccctcactctgaacggagagccgtgtacattggagctctgttccctatgtctggcgggtggccaggggggcaggcctgccagccagcagtggaaatggctctggaagatgtgaattcgagacgggacatcctgccagattacgaacttaaactgattcatcatgatagcaagtgtgatccggggcaggccaccaagtatctgtatgaattattgtacaacgatcctatcaaaatcattttaatgcctggctgtagttcagtcagcactctcgttgctgaggctgcccggatgtggaacctgattgtgctttcatacgggtcttcatcaccggctctttctaacagacagaggttcccaacattctttcgcacccatcccagcgccaccttgcacaatcctactcgtgtgaaactgttcgagaagtggggttggaagaagattgcgaccattcaacagaccaccgaggtcttcacgtccaccctggacgacttggaggagagggtgaaggaagccggaatcgagatcacgtttcgtcagagctttttcagcgaccccgctgttcctgtaaaaaaccttaaaaggcaggatgctagaataatcgttgggttattctacgaaaccgaggctcgaaaggtcttctgcgaggtttataaagagcggctttttggcaagaaatacgtttggtttttgatagggtggtatgcagataactggtttaaaatttacgatccctccatcaattgtacggtggacgaaatgacagaggcagtggaaggtcatatcacgacagagatcgttatgctcaaccccgccaacactcgctccatatcaaacatgacttcgcaggagtttgtggaaaagttgaccaaacgcttaaagcggcaccctgaagaaaccggaggattccaggaagcacccctggcctacgatgccatatgggcattggcacttgccttaaacaagacatctggaggaggcgggagaagcggcgtccgcctggaagactttaactataataatcagacaatcaccgaccagatttatcgagctatgaatagcagctcgttcgaaggcgttagtggtcacgtggtgttcgatgcatcagggtcccggatggcctggacactaatcgagcagttgcaaggggggtcctataagaagattggatattacgatagcactaaggatgatttgtcttggagtaaaacggataagtggatagggggctccccaccggctgatcagactttagtgattaaaaccttcaggttcctttcccagaaacttttcatcagtgtctccgtcctatccagtcttggaatcgttttagcagtcgtgtgcctctcctttaatatttacaactcacacgtccggtatatccagaacagtcagcctaatctgaacaatctcacggccgtgggctgctccctggctctggcggctgtttttccattaggactcgacggctaccacatcgggcggaatcagttcccgtttgtttgccaggcacgcctatggttactcgggctcgggttcagtctagggtatggttctatgttcaccaaaatctggtgggtgcataccgtgttcaccaagaaagaggaaaaaaaagagtggaggaagaccctcgaaccatggaaactgtatgccacagtggggttactggtgggcatggatgttctcacccttgctatatggcaaatcgtggatcccctgcacagaactatcgagacttttgccaaggaagagcctaaagaagacatcgacgtgagtatactcccccagctggaacactgctcctccaggaagatgaatacttggttggggattttttacggatataaagggctgctcctgctcctaggtatcttcctggcctatgaaactaaaagtgtgagcaccgagaaaatcaacgaccacagggccgtgggtatggctatatataatgtggcggtcctgtgtctgatcaccgctccggtcacaatgattctttcttcacagcaggacgccgctttcgcctttgcctccctggccatagtcttcagttcttacataaccctggtggttttatttgtgcccaagatgagaagactgatcactcgcggggagtggcaaagtgaagctcaggacactatgaaaaccgggtcttctactaataataacgaggaggaaaagtccaggcttctagaaaaggaaaaccgtgaactggagaagatcattgccgagaaggaagagagggtgtctgaattgcgtcaccagctacagtcccgacagcaactgcggtcgcggaggcacccacccacgcctcccgaacctagtgggggactgccccgggggcccccagagcctcctgatcgactctcctgtgatggttcccgtgttcaccttctctacaaatag

SEQ ID NO: 5951 - DNA, 2535 bp, Artificial Sequence
  Description of Artificial Sequence: Synthetic coding sequence
atgggcccgggcgcgccgttcgcgcgcgttggctggccacttcctctgttggtggttatggctgccggagtcgcacctgtgtgggcctcacactcaccccatcttccacggccccacagtagagtcccgccgcatccctcctctgaaaggagggccgtctacataggggcactgttccccatgtctggggggtggcccggagggcaggcctgtcagccagcggtggagatggcacttgaggacgtgaatagccgacgcgacatccttccggattatgaactgaaactcattcaccacgattctaagtgtgaccccggtcaagctaccaaatatctttacgagctcctttacaatgaccccatcaaaatcatactcatgcctggctgcagttctgtttcaactcttgttgctgaagcggctcggatgtggaatttaatcgtcttgtcatatggcagttcttcacctgcactctcaaataggcagcgttttcccacattcttccgcactcacccaagcgcaactcttcacaaccccacccgcgtgaagttgtttgaaaagtggggctggaaaaagatcgccacaatacagcagactaccgaggtgtttaccagcacgctggatgatctcgaagagagagtgaaggaagccggaatcgaaatcacatttcgccagagcttcttctccgacccggccgttccggtaaagaacttgaagagacaggacgcccgcattatcgtgggactcttttacgagacagaggccaggaaggttttctgcgaagtttacaaagagcgcctcttcgggaaaaaatacgtttggtttcttatcggttggtacgcagacaattggtttaaaatttatgatcctagcattaactgcaccgttgatgagatgaccgaagccgtagagggtcatattacaaccgagattgttatgttgaatcccgctaataccaggtctatcagtaatatgacttcccaggaatttgttgagaagctaactaagcggttaaagcgacatccagaggagacagggggatttcaggaggctccactcgcttacgatgccatttgggcactggccctggcactgaataaaacatcaggtggagggggacggtctggcgttcggcttgaagacttcaactacaataaccaaaccattaccgatcaaatttatagggcaatgaacagctcgagcttcgaaggagtgagcgggcacgttgtctttgacgccagcggctcgaggatggcttggactcttatcgaacagctgcaaggcggatcttataagaagattggatactatgattctacaaaggatgacctgagttggagcaaaaccgataagtggattggagggtctccacctgccgaccagacattggtaatcaagacatttcggtttctgtctcagaagctctttatcagcgtctctgttctcagcagcctgggcatagtgctggcggtagtatgccttagcttcaatatctacaactcccacgtcagatacatccagaacagtcagccaaatctgaataacctcacagctgtcggttgttccctggctttagccgctgtgtttccgcttggcctggatggataccacatcggtcgaaaccagttccccttcgtgtgccaggcccggctctggttattgggactggggttttccctgggctatggcagtatgtttacgaagatctggtgggtccacacagtcttcaccaaaaaagaggagaaaaaagaatggcgtaaaactttggaaccgtggaaactgtacgccacagtgggactgcttgttggaatggatgtgctgaccctcgcaatctggcaaatagtcgatccactccatcgaaccatcgagacattcgccaaagaggagccaaaggaagatattgatgttagtattcttccacagctggagcattgcagtagccggaagatgaacacgtggctaggtattttttatggctacaagggattgctgctccttttgggtatatttttagcctatgaaacaaaatcagtttctaccgagaaaatcaacgaccacagagccgtaggcatggccatttacaatgtagcagttctatgtctcataacagcccccgttaccatgatcctgagttcccaacaggacgctgcctttgcatttgccagtctggccattgtctttagtagctatataaccctagtggtgttatttgtccccaaaatgcggcgcttgattactaggggcgaatggcagtccgaagcccaggacaccatgaagaccggcagctcaacaaataacaatgaggaggagaagtcccgactgctcgaaaaggagaatagggaattagagaagataatagctgagaaggaggagcgcgtcagcgaattgcgacaccagctgcaaagtaggcagcagcttagatccaggcgacatccccccaccccccccgagccttctggcggtctgccaagaggccccccagaaccccctgatcgtttgtcctgcgacgggtccagagtccacctcctttataaatag

SEQ ID NO: 5952 - DNA, 3090 bp, Artificial Sequence
  Description of Artificial Sequence: Synthetic coding sequence
atgccgccgaccaagtccgtttccgagcctgtccccttcgaaactgaagcgccaagtatgacaatagttcctactactgacatcgagcccgtgaccgtcagaactgaggcaaccgttactaccttggcacctaagacttcgcagagaaccagaactcgcagacccagacccaaacacaagaccacaccccggcctgagaccctgcaaaccaagcttgatttcgggcctatcaccccggggactagctcagcccctactaccactacaaagagaaccagacgcccgcatcctaagcctaagacgaccccccaccctgaggtacctcagaccaaactggttcctgctactattctcgaaccagtgctgcgaaccgaggccagcggcaccaccgccgtgcccgcaaccatcttcgagccggtctcccctattaaggaggcccccggaaccacttttgttccggtcacagatcttgaacctgtcactttccgtactgagatccccgccaccactctcgccaccaagacgtcaaagcgcacccgtccgcctcgcccgagacccaaaaccaccccatcgcctcaggctccagagacaaagccagtacccgccacagtcctggaacctgtgaccctgaggcctgaggccagcactacattggcctcgaagacaagtcagcggaccaggcggccgcgtttgcgtactaagacgaccccccggccagaggctcccgaatccaaacccgtccctacagcggaactgaaacctgtgacgctgaggactgaaacctgggtcacaacacaggctcccaagacaagccagaggacacggagacctcgcccgaaaacaaagaccacaccgtcccctgaggtgccacagacaaagctcgtacccagtacagatctggaaccggggacgctccggactgaggccccaaagactatggttgtcacaaccgtattggagcctgatactttcaggacaaaattccctgagacaacactcgcgccaaaaacacagagaacccgacgaccacgtccacgacctaagaccacttcctcacctgaagtaccgcagaataaatcagtttcagttaccggcttcgaaccggtggttcactccactgatgctccaggcactaccttcgctcttaccgaactacagaccctcattctgaagcccgtgacctcgcccagtttggagatgacagaatctcagcccgtctctgacgtcctcgaatccgtgacactcagcactgagagtcctaaggagaccatcgctcccgccaagactgattatgtatacccaaccgccaaagcaccactctggcccgaagaaccaaaaacggaggtggtcgagagtatcacgtacgtgtcagagccgcccgaaaccaccttggagaccagcccacttccttcccagagcatcacattaccctcaccggatgagcctcaaacggagcccgccccaaagcagacacccagagcaccacctaaaccaaagacctccccacgcccccgcatacctcagacccagccggtgccaaaagttccccagcgagtcacagcgaagcctaagacctcccctagccccgaggtcagctatacaacacccgccccaaaggacgtactgttgcctcacaagccgtaccccgaagttagccagagtgaacctgcgcccctggaaacccgcggaattcccttcattcctatgataagcccctctcccagccaggaagagctacagactactctggaggagaccgatcaatctacccaagagccttttacaaccaaaataccccgcacaactgaacttgcgaagaccacacaggcacctcaccggttctataccacagtgcggccccggacaagcgacaagccccacatcaggcccggggtcaaacaggcacccaggccaagtggtgccgataggaacgtgtctgtggattctactcaccctacaaagaagccaggtaccagacgccctccgctcccaccacggcctactcatccgcgccggaagccccttccgcccaataatgtgactggaaagccgggatctgccggaattatctcctctggaccaattacaactccccctctgagatcaactcccagacccacaggaacacccctggaaagaattgagaccgacattaagcagcccacggtgcctgcctcgggcgaggaactggaaaatattacagactttagtagctctcctactagagagacagacccccttggcaagcctcggttcaaaggcccacacgttagatatatccaaaaaccagataattccccttgcagcatcacagactccgttaagagattcccaaaggaggaagccactgagggtaatgcaacctcgcctcctcagaatcctcctacgaaccttaccgtcgtgacagtcgaaggctgccctagtttcgtcatcttggattgggagaaaccattaaatgacaccgtgaccgagtacgaggtgatatctcgtgagaacggaagtttctctggaaagaataagtctatccagatgactaatcagacgttctccaccgtcgagaatctgaaaccaaacacttcatatgaatttcaggtgaagcccaagaaccctctcggggagggccccgtctctaacaccgtggccttttccaccgaaagcgccgacccacgtgtgagtgagccagtttccgctggaagggatgcaatctggacagaacgccctttcaactctgattcttacagtgaatgcaaaggcaagcaatatgtaaaacgaacctggtataagaagttcgtcggtgtgcagctctgtaattccctgaggtacaagatatatctgagtgacagtctaaccggtaagttttacaatattggtgatcagagaggtcacggagaggatcattgccagtttgtggacagttttctggacggcaggacagggcagcaactgacatccgaccagcttccaatcaaggaggggtatttccgcgctgtgaggcaggagcccgtgcagttcggagagattggcggccatacacagattaactatgtccagtggtatgagtgtggcaccacaatccctgggaagtggtag

SEQ ID NO: 5953 - DNA, 2355 bp, Artificial Sequence
  Description of Artificial Sequence: Synthetic coding sequence
atgacaatcgtgcctaccacggatattgaaccagtaactgtgcgtactgaagctacggtgacaacattagccccgaagacgagccagcgcacacgcacccggcgacccaggccaaagcacaaaacaaccccccggccagagacactccagactaagctggactttggtcctatcacccctgggacctcttccgctcccactacaaccacaaagcgaacccggcggccacaccctaaaccaaaaaccaccccacatcccgaggtgccacaaaccaaacttgctccaaaggtgcctcagaggactcacagacctcatccaaagcctaaaaccacgctctccccagaagaattacagaccgagctggtgcctgtcacagatctggagccagtgacctttcgaactgaaatcccggcaaccacactggcaacaaaaacttccaaacgcacacgtccaccaaggccccgcccgaaaacaaccccatcgcctcaggccccagaaactaagcctgttcctgctaccgtgctggagcctgtaaccctgaggccagaagcctccacaacactcgcttctaagacctctcagcgtaccagacgcccccgactgaggaccaaaacaacgcctcggccagaagcgcctgaaagtaagccggccccaaagcagaccccccgggcacccccaaaaccaaagacatcccccaggccccgaattccccagacacagcccgtgccaaaagtgccccagagggtcacggccaaacccaaaacaagccctagccccgaagtctcctataccacccctgctcctaaggatgtcctactcccacataagccctaccccgaagtgtctcagagcgaacccgcgcccttagagactcgcgggatccccttcattccaatgattagtccctcccccagccaggaggaactccaaaccacactggaggaaaccgatcagtccactcaggagccctttacaacaaagatcccccgaaccactgaactcgctaagacgacacaagcccctcaccgcttctatacaaccgtgcggcctcgcacaagcgataagccccatatccgacctgtgctaaatcggacgaccaccagaccgacgcgccctaaacctagtgggatgccctcaggaaatggagttgggacgggagtgaaacaggcacctcgtcctagcggggcagatcgcaatgtgagcgttgattcaacccacccaaccaagaaaccgggtacgaggagaccacctctgccgcctcgccccacgcacccacggcgaaagcccctgcctcctaataatgtgaccggcaagccaggaagcgccggcatcattagtagcggacccataactacaccccccctgaggtctactccaagacctacaggtacccctctcgagcggatagagacagacataaagcaacccaccgtgcccgcatcaggagaagagttggagaacatcaccgatttcagttcctctcccactcgcgagacagatcccctcggcaaacctcggttcaagggcccacacgttcgctatatccagaaacctgataacagcccatgttctatcaccgattccgtcaaaaggttccccaaggaggaggccaccgaaggaaacgcaacatcaccgccccagaaccccccaacaaacctgactgtcgtgaccgtagaggggtgcccctcattcgtgattctggactgggagaaacctctcaatgataccgtaactgagtacgaggtgataagtcgggaaaatggcagtttctcaggcaaaaataagagtatccagatgaccaaccagaccttcagcacagtggaaaacttgaaaccaaacacaagctatgaattccaggtgaagcctaagaatcctcttggcgaaggccccgtgtccaacaccgtcgcattctccaccgagagtgccgacccccgagtatccgagcctgtgagcgccggcagggatgctatctggacggagaggccttttaactcggacagctatagcgagtgtaaaggcaagcagtacgtgaaacgcacttggtataagaaatttgttggggtgcagctatgcaattccctgcgatacaagatctatctctcagactccctcaccgggaagttttataacatcggagaccagcgggggcatggagaagaccattgtcagtttgtcgatagttttctggatggccgaacgggccagcaactgacctccgatcagcttcccataaaggagggttacttcagagcagtccgacaggagcctgtgcaattcggcgaaatcgggggacacacccaaattaactatgttcagtggtacgaatgtgggactactatccctggaaaatggtag

SEQ ID NO: 5954 - DNA, 1584 bp, Artificial Sequence
  Description of Artificial Sequence: Synthetic coding sequence
atgcttatgctgtttgtgtttggtgtcctgttacatgaagttagcctatcaggtcagaatgaggctccgccaaacacccacagcattccaggcgagcccctctacaactatgcaagcatccggttgccagaagagcatattcccttcttccttcataataatcggcacatcgcaacggtttgccggaaagattccctctgtccatataagaaacacttggagaagctgaagtactgctggggctatgaaaagtcttgcaaaccagagttcagattcggttacccagtgtgtagctacgtcgacatgggatggacagataccctagaatctgctgaggacatcttttggaagcaagccgactttggatacgctagggaacgattagaagagatgcacgtcctatgtcagccaaaggagacctctgattcttccctggtttgctctcgctacctacaatactgccgcgcaaccaacctgtaccttgacctgagaaatattaagagaaaccacgacagattcaaagaagacttttttcagtccggagagatcgggggccactgcaaactggacatcagaacactgactagtgaggggcagcggaagtcacctctgcagtcatggtttgccgaactgcagtcctacacgcaacttaacttcaggccaatcgaagacgctaagtgtgacatagtaatagaaaagcccacctactttatgaagctcgacgcgggggtgaatatgtatcaccacttctgcgactttatcaacttgtacatcacgcaacacgtcaacaactctttctccaccgacgtttacatagtgatgtgggatacaagctcatatggctatggagatctcttttcagacacatggaacgcgtttacagattatgatgtcatccacctgaaaacctacgactctaagcgcgtgtgcttcaaggaggctgttttcagcctactgccccgaatgaggtacggtttgttttacaatacccccctgataagtggttgccaaaataccggcctctttcgagccttcgctcaacacgtgctccacagattgaatattacacaggagggccctaaggacggcaaaattcgtgtgaccattctcgctcgctcaaccgaataccgcaagatcctgaatcaaaacgaacttgtaaatgccctgaaaactgtttctacattcgaggtgcaaatcgtggattataaatatcgggagctaggtttcctggaccagttgagaatcacacacaacaccgacatttttattgggatgcatggagctggcctcacccatcttctcttcctgcctgattgggccgctgtgtttgaactgtacaactgcgaagatgaacgttgttatttggatttggcccgcctgaggggagtgcattacattacctggaggcggcagaacaaggtctttccccaggataaaggtcaccaccccactttgggggagcaccccaagttcaccaattatagcttcgatgttgaggagttcatgtatctcgtgcttcaggcagccgaccacgtccttcagcatccaaagtggcctttcaaaaaaaagcacgatgaattatag

SEQ ID NO: 5955 - DNA, 2004 bp, Artificial Sequence
  Description of Artificial Sequence: Synthetic coding sequence
atggggtccagccgcctcgccgccttattacttccactgttgctgattgtgatcgatttaagcgatagcgccggcatcggcttccgccacctgccacattggaacacaaggtgtcccctggccagccataccgatgactcttttactggctcttctgcatacattccctgtaggacgtggtgggccttgtttagcactaaaccctggtgcgttcgcgtgtggcactgtagtcgttgtctttgtcagcacctcctgtctggaggcagtggattacagcgcggcctattccatttgctggtccagaaatccaaaaaaagcagcacttttaagttctatcgtaggcacaagatgcccgcacctgcccagcgcaaacttttaccaagaaggcacctgagcgagaagtctcaccacatatccattcccagccctgatatctcacataaaggactccgatcaaagaggacacagccttcagacccagagacttgggagtccctgccaaggttagatagccagcggcacggcggcccagagttttccttcgatctgctacccgaggcaagggctatcagggttactatttcttccggaccagaagtatctgtcaggctgtgtcaccaatgggctctcgagtgtgaggaactgagctcaccctatgatgtgcaaaagatcgtgagcggggggcacacagttgaactcccctatgagtttttactgccatgtctctgcatcgaggcgtcctatctgcaggaagacaccgtgcggcggaagaagtgcccttttcaaagctggcctgaggcctacggctctgatttctggaaatccgtgcatttcactgattattcacagcatacacagatggttatggctctcacgttaaggtgccctctgaagctcgaagccgcactttgccagaggcacgactggcataccttatgcaaggaccttccaaacgcaaccgccagagaatccgatggctggtacgtgcttgaaaaggtcgacctgcatcctcagctgtgcttcaagtttagctttggcaactcatcacacgtggaatgtccccatcagactggaagcctaacaagctggaacgtgagcatggacacccaagctcagcagctcattttacacttctcgtccaggatgcacgccacattcagcgccgcttggtccctgccgggcctgggacaggacacgctggtgcctccagtgtataccgtcagccaggcacggggcagctctcccgtgtccctcgatcttattattcctttcctaaggcccggctgctgcgtgctggtctggagatctgacgtgcagtttgcctggaagcacctactctgtccagatgtgagctaccggcacctcggcctcctgattcttgccctgctggctctactgaccctccttggggtcgtcctagccttaacttgtcggagaccccagagcggcccaggacccgctaggccggtgctactgcttcatgcagctgactccgaagctcagcgacgcttggtgggagcattggcggagctgttacgtgccgcgctggggggcggcagggacgtgatcgttgatctgtgggaaggaagacatgttgccagagtggggccattaccttggctgtgggccgcccgaacgcgggtggcccgggagcagggaacagtactgctcttgtggagcggtgccgatctgcgccccgtgagcggccccgacccccgggcagcaccactgctcgcccttctgcatgccgcaccccggccccttcttcttttggcttattttagccgcctttgtgccaaaggtgacatccccccccctctcagagccctgccgaggtaccgcctcttgagagatctgccacgcttgctacgggcactggacgcacgtccgtttgcggaggcaactagctggggccgccttggggcacggcagagaaggcagtcaaggctggaactgtgttctagactggaaagggaagccgccaggctagctgacctcgggtag

SEQ ID NO: 5956 - DNA, 1101 bp, Artificial Sequence
  Description of Artificial Sequence: Synthetic coding sequence
atgcccatgattagtgttctggggaaaatgttcctctggcagcgagaagggcccggtggtaggtggacgtgtcagacatccaggagggtgtcctccgacccagcctgggcagtcgagtggatcgagctgccccgtggacttagcctgtcaagcctagggtccgccaggaccctgcgaggatggagccgcagttctagaccctcttcagtggactcccaggatctacccgaggttaatgtcggcgataccgtcgctatgttgcccaagtcgaggcgcgcgttgacgattcaggaaatcgcggcgctggctaggtcatccctacatgggatctctcaagtggtgaaggatcacgtgaccaagcccacagctatggctcaaggaagggtggcccatctgatcgagtggaagggctggtcaaagccatccgactctccagctgccttggaaagcgctttctctagctattctgatctgtcagagggcgaacaggaagctaggttcgctgcgggggtcgcggagcagtttgcgatcgctgaggcaaagctgagggcctggagcagcgtagacggcgaggacagcaccgatgacagctacgatgaggatttcgcgggtggtatggatacagacatggctggccagcttcctctgggacctcatctgcaggacctctttaccggccacagatttagtaggcctgttcggcaggggtctgtagagcccgagagtgactgctcccagaccgtttcacctgacacactgtgttcctccctgtgctctctggaggatggcctgttgggcagtcccgcccgactggctagccaactgctaggtgatgagcttctgcttgcaaaactccctccgagtagagagtcagcctttcgtagcctgggacctctggaagctcaagacagcctgtacaactcccccttgaccgagtcttgtcttagtccggccgaggaagagcccgccccctgcaaagactgccaacctctgtgccctcctctaacaggatcctgggagaggcaacggcaggcatctgacttggcgagttccggggtcgtgtcactcgatgaggatgaggcagagcccgaggagcagtag

SEQ ID NO: 5957 - DNA, 5172 bp, Artificial Sequence
  Description of Artificial Sequence: Synthetic coding sequence
atgcagttccaacttactctgtttcttcatctcggctggctatcttacagcaaggctcaggatgattgtaatagaggcgcctgccaccccacgaccggagacctcctggttgggcgcaatactcaacttatggcaagttcgacatgcggcttgtccagggcacagaagtattgtattctttcctatcttgaaggagagcaaaaatgctttatatgcgactccaggtttccctacgatccatacgatcagcctaactcccataccattgagaatgtaatcgtgagttttgagcctgaccgcgagaagaaatggtggcagtctgaaaacggtctcgatcacgtgtcaatcagattggatctggaggcactctttcggttttcccacctcatcctaacttttaaaacatttagacctgcagccatgctcgtggagagaagtacggactatggacataactggaaggtatttaaatactttgcaaaggattgtgcaactagcttcccaaacattacctcaggccaggctcagggggtgggcgacatcgtgtgtgacagcaaatactctgatattgaaccttctacaggaggtgaagttgtgctgaaggtgcttgacccttccttcgaaatagagaacccttacagtccatacattcaggacttagtgacactcactaacctgaggatcaattttaccaagcttcacaccctgggcgatgctttgctggggcgtcggcaaaacgactccctcgataagtactactatgctctttatgaaatgatcgtgcgcggcagctgcttctgtaatggccacgccagtgaatgccgccctatgcaaaagatgagaggtgatgtcttttcacctcccgggatggtgcacggacagtgtgtgtgtcagcataatacagacggccctaactgtgagagatgcaaggacttctttcaggatgccccttggcgtcccgccgcagacctacaggacaatgcttgtcggagttgctcatgtaactcacactcatcccggtgccattttgacatgaccacctatttggcaagcggcggacttagtggcggggtttgtgaagattgtcagcataataccgagggacagcattgcgaccgatgcaggccccttttttatcgcgatcccttaaagaccatttctgacccctatgcctgcattccttgtgagtgtgaccccgacggcaccatcagcgggggaatatgcgtttctcattctgacccggccttgggttcagtggcaggccagtgtctgtgcaaagagaatgtggagggggcaaaatgcgaccagtgtaaaccaaatcactatgggctgagcgcaacggacccattaggttgccaaccatgtgattgtaatcctttggggtccctgcccttcctgacatgtgacgtggacacgggccagtgcctttgcctcagctacgtgaccggggctcactgtgaggaatgtaccgttggatactggggattgggaaatcatttacatgggtgctctccttgtgattgcgacattggtggagcatactcaaacgtctgtagcccaaaaaatgggcagtgtgagtgccgccctcacgtcacaggccggtcttgcagcgagccagcaccgggctacttctttgcccccctgaatttttacctctacgaagccgaggaggccacaacactgcagggccttgcacctcttgggtccgagacattcggacaaagcccagccgtccacgtcgtgctcggggaaccagttccaggaaatcctgttacctggactggacccgggttcgcgcgcgtcctgccaggtgcgggccttcggttcgccgtgaacaatatcccgtttcccgtcgacttcaccatagccatacattatgaaactcaatcagcagccgattggaccgtccaaatagtggtcaacccaccaggtggatcagaacactgcatacctaaaactctccagagcaaaccacagagcttcgctctgccagctgcgactaggatcatgttacttcctactcccatctgcctggaaccagatgtgcagtactcaattgatgtgtattttagccagccactccagggagagtctcatgcacactcacacgtattagttgattccctgggattgattcctcagattaacagcttggaaaacttctgctccaaacaagacttagatgagtaccagctccacaattgcgtggagattgccagcgctatgggcccgcaggtcttaccaggcgcatgtgaaagactcatcatttctatgagcgccaaactccacgacggtgcagtggcatgtaagtgccaccctcaaggaagcgtgggcagtagctgcagcaggctcggtggacagtgccagtgcaaacctctcgtcgtcggccggtgctgtgatagatgctcaactggctcttacgacctcggtcaccatgggtgccatccttgccattgccacccacagggatccaaagacacagtctgtgatcaggttacaggtcagtgcccgtgtcatggggaagtctccggcaggagatgtgatcgttgccttgctggttattttggatttccatcctgtcacccttgcccttgtaaccggtttgctgagctgtgtgatcccgagacaggttcctgctttaattgtggaggttttacaaccggccgaaattgcgagcgctgtattgatggttactatgggaatccttcaagtggacagccatgtaggccgtgcctctgtcctgatgatcctagctccaatcagtatttcgcccattcctgttaccagaatctttggtcttccgacgtgatttgtaattgcctccagggctataccgggacacagtgtggggaatgttctacagggttttacggcaacccccggatcagtggggctccatgccagccctgcgcttgcaacaataacatcgacgttaccgaccctgaatcctgtagccgtgttaccggtgagtgcttacggtgtcttcataatacacagggtgccaattgtcagctgtgtaagcccgggcactacgggtccgcccttaaccaaacatgccgccgttgtagctgtcatgccagtggagtgtcaccaatggaatgccctcctgggggcggagcatgcctgtgtgaccccgtcacaggcgcttgtccatgcttgcctaacgtgacgggcttagcttgcgatagatgcgctgacggctattggaacctggtgccaggtcgtggatgtcagtcctgcgactgtgacccacggacgtcccagtcttcccactgcgaccagttgacagggcagtgtccatgtaaattggggtacggcggtaagcgttgtagtgaatgtcaagaaaactactacggcgatccccctggccgctgcataccctgcgactgcaatcgggccggcacccagaaacctatttgcgatccggacacggggatgtgtagatgccgggaaggcgtaagcgggcagagatgcgatcggtgcgcccgtgggcactcccaggagtttcctacgtgcctgcaatgccatctgtgcttcgaccaatgggaccacacaatttcttcattgtccaaagcagttcagggacttatgcgtctggctgccaatatggaggacaaacgtgaaactctgccagtatgcgaggccgacttcaaggacctgcgggggaacgtctccgaaatcgagcgaattcttaagcatccagtgttcccatctggaaaattccttaaggttaaagactaccacgattcagtgcggaggcaaatcatgcagctgaatgagcagctcaaagccgtttacgagttccaggacctgaaagacaccatcgaaagggcgaagaacgaggcagatttgctgctcgaagacctgcaagaggagattgacttacaaagttcagtcctcaatgcctccatagcggactcttctgagaacatcaaaaagtactaccacatttcctcttccgccgaaaagaagatcaatgagacatctagcaccattaacacctcagccaatactaggaacgatctgctgaccatcctggacacactgacctctaaaggcaacttgtctctggagcggctgaagcaaatcaagattccagatatccagatactgaacgagaaggtctgcggcgaccccggaaacgtcccctgcgtgccccttccatgcggaggggctttgtgtaccggacggaagggacatcgcaagtgtcgtggcccaggctgtcacggctctctgaccctgtctactaacgcactccaaaaggcccaggaggccaagtctatcatccgcaatcttgataaacaggtcaggggcttgaagaaccagatcgagagcatcagtgagcaggcagaggtgagcaaaaataatgcactccagctgagagagaaactgggtaatatcaggaatcagtccgacagcgaagaagaaaatatcaacttatttattaaaaaagtcaagaatttcctccttgaggagaacgtgcctcccgaggatattgagaaggtggctaatggggtcttagacattcatttgcctataccctcacagaacttgactgacgagctggtcaaaattcagaagcacatgcagctgtgcgaagactaccggactgacgagaatcgcttgaatgaagaggccgatggtgctcagaagctgctggttaaagccaaagcggctgaaaaggctgccaacatcctgttgaacctcgataagactctgaatcagctccaacaggcccagataactcaaggtagagctaattctaccatcacacaactgacagccaacattacaaagatcaagaaaaatgtgctccaggcggagaaccagacgcgcgaaatgaagtccgaattagaactagccaagcagcgctccggactggaagatgggctgagtttgctgcagacgaagctgcagcgacatcaggaccacgctgttaacgccaaagtgcaggccgagagcgcccagcatcaagcaggcagcctcgagaaggagtttgttgaattgaagaagcaatatgcaatcctgcagcggaaaacatccacaacaggattaactaaagaaacgctgggcaaagttaagcagttaaaggacgctgcggagaagctggcaggtgatacagaggctaaaataagacgcataaccgggtgctttcagaacagcgctaggtag

SEQ ID NO: 5958 - DNA, 5286 bp, Artificial Sequence
  Description of Artificial Sequence: Synthetic coding sequence
atgcagttccaactcacgctgttcttacacctgggatggctgagttactcaaaggctcaagacgactgcaatcgaggcgcgtgtcaccccaccacaggcgacttgctggtcggtcgcaacactcagcttatggcgagttccacgtgcgggctcagccgcgctcagaagtattgtatcctgtcgtacttggagggcgaacagaagtgctttatttgcgattcacgctttccctatgacccatacgaccagccgaatagccacactatcgagaatgtcatcgttagttttgaaccggatcgagagaaaaaatggtggcagtcagagaacggtctcgatcacgtgagcattcgtctggatctcgaggccctattccgcttctcacacttaatcctaacgttcaagacgttccgccccgcagcaatgctagtggaacgcagcacagattatggacataactggaaggtcttcaagtacttcgctaaggactgtgcaacatctttccctaacattacttccgggcaggcccagggcgttggagacatcgtctgcgactccaaatacagtgacattgaaccatccaccgggggagaggtcgtgctgaaggtcctcgatcctagctttgagattgagaatccatactctccttacatccaggatcttgtcactctcaccaacctgcgcatcaactttaccaaactccacacgttgggagacgcactgctaggtagacgacagaacgacagtctcgacaagtactactatgcactgtatgaaatgatcgtacgggggagctgcttctgtaacgggcacgcatcagagtgtcggccaatgcagaagatgaggggcgatgtgttctctccacctggcatggtacacggccagtgcgtctgccagcacaacactgacgggcccaactgtgagcgctgtaaagacttttttcaagatgcaccgtggcgccccgcggcagatctgcaggataacgcttgccggagttgttcatgcaactctcactcctcgcgatgtcatttcgacatgaccacctaccttgctagtggcggcttgtccggcggcgtgtgtgaggactgccagcataacactgaaggacagcactgcgatcgctgtcggcccctcttttaccgcgaccccctgaaaaccatctccgacccctatgcttgtattccctgcgaatgtgatcccgatggtactatatctgggggcatttgtgtgagtcatagcgatccagccttgggcagtgtagccgggcaatgcctctgtaaggagaatgtcgagggcgctaagtgcgatcaatgtaagccgaaccactacggcctgagcgccaccgatccacttgggtgtcaaccctgtgattgcaatccgctcggatctctgccattccttacctgcgacgtggacactggccagtgcttgtgtctcagttatgtcacaggagcccattgcgaagagtgcacagttggctactggggtcttggaaatcacctgcacggctgtagtccgtgtgactgtgatataggaggcgcgtattctaatgtctgttcgcccaagaatggccagtgtgagtgtcgccctcacgtcactgggcgctcttgctccgagcccgccccaggctattttttcgcccctctcaacttttacctatacgaggccgaggaagccacgacattgcaaggactcgcccccctagggtctgaaacctttggccagagtcctgcagttcacgtggtgttgggcgagccagtcccaggaaaccctgtgacatggaccggccctggcttcgctcgggtcctgccgggggcaggactccgatttgcggtaaataatatcccatttcccgtggacttcacaatcgccattcattatgagacacagtccgccgccgattggactgtgcagatcgtcgtgaacccaccaggcgggagcgagcattgcatacctaagaccttacagtccaagccccaatcctttgccttgcctgctgccaccagaatcatgctgctgcccactcctatatgcctggaacccgatgtgcagtattccattgacgtctacttttcccagcccctacagggggagagtcacgcacactcgcatgtgcttgtggactccctgggactgatcccccagattaactccttggaaaatttctgcagcaaacaagatctggatgagtaccaattacacaactgtgtggagatagcctcagctatgggcccacaggtactcccaggtgcctgcgaaaggctaattatttctatgagcgcaaaattgcatgacggagccgtggcctgcaagtgccacccacaaggctcggtaggctccagttgcagtcggctgggcggccagtgccagtgcaagcccctcgttgtcggccgctgttgtgaccggtgcagcaccggctcatatgatttgggccatcatggttgccatccttgtcactgtcatccacagggaagcaaagacacagtctgtgaccaggtgactggccagtgtccctgtcatggtgaagttagtggccggcggtgcgacaggtgcctcgctggatactttggatttcctagttgtcatccctgcccctgtaatcgctttgccgaactgtgcgacccggagactgggtcttgctttaactgcggtggttttacaacaggccggaattgcgaacgatgtatagatggctattatgggaatccgtctagtggacagccttgcaggccctgcctatgccctgatgatccatcttctaatcagtattttgcccattcttgctaccagaatctgtggagcagcgacgtgatctgcaattgcctccaaggctacaccggcacacagtgcggcgaatgttcgacaggcttctatggcaatccgaggatttcaggagcaccctgtcagccttgcgcttgtaacaataatatcgacgtgaccgaccccgagtcatgctcccgagtgactggcgagtgcctgcgctgtctgcataacacgcagggcgcaaattgtcaactgtgtaaacctggacactacggaagcgcgctgaaccagacttgccggagatgctcttgccacgcttccggcgtgagccccatggagtgtccaccgggcggaggcgcctgtctgtgtgacccagtgactggggcctgcccatgcctccctaatgtcacgggacttgcttgtgatagatgtgctgatggctactggaacctggttcccggtcgcggctgtcagtcttgcgactgcgaccctcgcacaagccagtcttcacactgcgatcagctcactggccaatgcccgtgcaagctcggctacggaggcaagaggtgttctgagtgtcaggagaactactatggagatcctcccggccgctgcatcccgtgtgactgtaaccgggccgggacccagaaaccaatatgcgacccggacacaggcatgtgtcgatgccgcgaaggtgtttccggccaacgttgtgatcggtgcgccaggggacacagtcaggaatttcccacatgccttcaatgccacttgtgcttcgaccagtgggaccacacaatcagttccctcagcaaagctgtgcaggggctgatgcgactggccgcaaacatggaagataagcgggagactctcccagtctgtgaggctgactttaaggacctgcgaggaaacgtgtcagaaattgagcgcatcctgaagcaccccgtgtttccctccgggaagtttctcaaggtaaaggactaccacgactcagtacgtcgccagatcatgcagctaaatgagcagttgaaggctgtgtacgagttccaggacctgaaggacaccatcgaaagagcgaagaacgaggcagacctcctgctggaggacctgcaggaggaaattgacctccagtcctctgtgttgaacgctagcattgctgattcaagcgagaacataaaaaagtattatcacatctcctcatctgctgaaaagaagattaacgagaccagctcgacgataaacacctccgccaacactagaaacgacctgctgaccatccttgacacccttacctccaagggcaacttaagcctggagcgcttgaaacaaataaagataccagacattcagattctgaatgagaaagtatgcggtgaccccggcaacgtgccctgcgtccctctgccatgcggcggagcattgtgtaccggccggaaaggccatcggaagtgcagaggaccgggttgtcacgggagcttgaccctgtcgaccaacgccctccaaaaagcacaggaagctaagtccattatcaggaacttagataagcaggtgcgcggtttgaagaatcaaatcgaaagtatttccgaacaggctgaggtaagcaagaacaatgccctgcagctccgtgaaaagctcgggaatattcgtaaccaaagcgactctgaggaggagaacatcaatctgttcataaaaaaggtaaagaactttctactcgaggagaatgtgccccctgaagatatagaaaaagtggcgaatggtgtcttggacatccatttgcccattccttcacagaaccttactgatgaactggtaaagatacagaaacacatgcagctatgcgaggactatagaaccgatgaaaaccggctcaacgaagaggccgacggggcccaaaagctcctggtaaaggctaaggctgctgagaaggccgctaatatcctactaaacctagacaagacgctgaatcagctgcagcaggcccagattacccagggtcgggccaatagtaccataacacaattaacagccaacatcactaaaattaagaagaatgtgttgcaggctgaaaatcaaaccagggagatgaagtccgagctggaactggcgaaacagcggtcaggattggaagacggtctgagcctgctacagaccaaacttcagcgccaccaggatcacgctgtgaacgccaaggtgcaggccgagtcagcacagcatcaggccggcagtctcgaaaaggaattcgtcgaactgaagaagcagtacgccattctgcaaaggaagacgtcaaccaccggtctcactaaggaaacgctcggaaaagttaagcagctgaaagacgccgcagagaagctagctggagacactgaggccaagataaggcgcataacagatcttgagagaaaaatccaggatctgaacctcagtcggcaggcaaaggccgatcagttgaggattttagaagatcaagtagtggccattaaaaacgagattgtggaacaggaaaagaaatacgctaggtgctattcttag

SEQ ID NO: 5959 - DNA, 1455 bp, Artificial Sequence
  Description of Artificial Sequence: Synthetic coding sequence
atgggggctgaagccctccctggaccggacgaagcagccgccgccgctgcatttgctgaagtcactactgtgacagttgccaacgtgggcgcagcggccgacaacgtgtttaccacgtcggtggccaatgcagcctcaatttccggacatgtgttgtccggccgtaccgcactccagatcggtgactccctaaatacggaaaaggcaactctgattgtggttcacaccgacggctcaatcgtggagaccacaggactaaaaggacccgctgcaccgttgactccgggtcctcagagtcctccgacacccctcgctcccggccaggagaaaggcgggactaagtataactgggaccccagcgtctatgacagcgagcttccagtgagatgccggaacatttccggaacactgtacaagaacagactgggaagtggcgggcgtggtaggtgtattaaacagggcgagaactggtactcacccaccgaattcgaagcaatggctggacgtgcttcctccaaagattggaagcgttctatcaggtatgccggaagaccattgcagtgtctgatccaagatgggattctgaacccacacgcagcctcctgtacatgtgcggcctgttgtgacgatatgaccctgtccggtccggtgcggttgttcgtcccctataagagacgcaagaaagaaaacgagttgcccacaacgcccgttaagaaagatagtccaaaaaatattactcttcttcccgccactgctgcaaccacctttacagtgaccccaagcggtcagatcacgacctccggcgccctgacattcgacagggcgtcaacggtggaggccacggcagttatttcagaaagcccagcccagggagacgtgtttgcaggcgccacagtgcaggaggcgagcgtccagcccccatgccgggcttcccacccagagccgcattacccggggtaccaagatagctgccaaatagctccctttcccgaagccgcacttcccacttctcaccccaagatcgtgttgacgtctctaccggctctggccgttcccccaccaacacctacaaaagccgcccctcctgccctagtcaatggactggagttgtcagagcccagatcttggctgtacttggaggagatggtgaacagtttgctgaacaccgcccagcagttgaagacactgtttgaacaagcaaaacacgcaagcacatatcgtgaggctgccacaaaccaggccaagatccatgctgacgcggagagaaaagaacagagctgcgtgaattgcggtcgagaggctatgtccgagtgtaccggctgtcacaaagtaaactactgttctaccttctgtcagcgtaaacgctggagcctgacaatgcttactagcctggtaagtatctcctggttaagggccattctcccctgtcagcctccaaaggtgctgggcttatag

SEQ ID NO: 5960 - DNA, 1512 bp, Artificial Sequence
  Description of Artificial Sequence: Synthetic coding sequence
atgtctggtgctctactgtggcctctcctgcctcttctgctgctccttctttcagcccgggatggggtgagggcagcccaacctcaagctccaggctatcttatagcggctccgtcagtattcagggccggtgtagaggaagtaattagcgtgaccatctttaattctcctagagaagtgacagtccaggcccaactggtggcccagggtgagccggtagtgcagtcacagggagcaattctggataaaggaacgatcaagctgaaagtgccaacgggcctgcgtggacaggcactactgaaggtgtgggggcgaggctggcaggccgaagaaggacccctattccataatcagactagtgtgacagtagacgggcgaggagccagcgtttttattcagaccgacaagccggtgtataggccccagcatcgagtgttgatttccatctttacggtttcaccaaatctaaggccagtgaacgaaaaactcgaggcctacatacttgatccccgaggctcccgcatgattgagtggaggcatctcaagcctttttgctgcggcatcaccaacatgtcttttcctctgtcagaccagccagtcctgggtgagtggttcatttttgtcgaaatgcagggccatgcttacaataagtcctttgaggtacaaaaatatgtcctgcccaagtttgagctgctcatcgatcccccacgctatatacaagatctagatgcctgcgagacagggacagtgagggcccgctatacttttgggaagcccgttgctggcgcgctgatgataaacatgacggtcaatggggtaggctactacagccatgaggttgggcggccagtgctcagaaccaccaagattcttggctctagggatttcgacatttgcgttcgggatatgattccagcggacgtgcccgagcattttcggggccgtgtctcaatatgggccatggtgacaagcgtcgatggctcccagcaagtcgccttcgacgattctacccccgtgcaaagacagttggttgatatccgctacagtaaggatacgcgtaagcaattcaagcctgggttggcctacgtggggaaggtggaactgtcctatccagatggctccccagccgagggagtgaccgttcagataaaggccgagctcacccccaaagacaatatctacacctccgaagttgtgtcccagcgtggactcgtggggttcgagattcccagtatcccgacgtcggcccagcatgtatggctggaggtgttccaagagctggaagactacgacgtctcagatagtttcggcgtgtcgcgggaggatggaccattttggtgggcgggcctcaccgcccagaggagacggcggagtagtgtgttcccttggccatggggcataacgaaagattccgggttcgcgttcacagtcaggcggggtaacggaacggggggcgacgatagaccctcagagccggaaccccccgctggtcgatggcccctccatcgctag

SEQ ID NO: 5961 - DNA, 144 bp, Artificial Sequence
  Description of Artificial Sequence: Synthetic coding sequence
atgaaactgtgtgtaactgtgttatctctcctggttctcgtggccgcattttgttcactagcattgagtgctcccaaagcatccaagtctgccctcacacccgttagccccggctcaaggtcgacatgtatgacttggaactag

SEQ ID NO: 5962 - DNA, 861 bp, Artificial Sequence
  Description of Artificial Sequence: Synthetic coding sequence
atggaagtgtatattcggcatttggagaaggtacttaggagatatgtgcagagacttcagtggctccttagcggccctgttctgtgctcgagaacttggtaccgacagagtatggataggggtgtgatgatgacagccgcatccggcagcaggcggctctttggcaccgtgcttgaaagtaaggtatgcattctcctcgacacctccggttcaatgggaccctaccttcagcaggtcaagaccgaactggtcttattgatttgggaacagctccgcaaatgctgtgatagcttcaacctcttatcatttgctgaatcatttcaaagctggcaggacacacttgtggagactactgacgcagcctgtcacgaagctatgcaatgggtcacccacctgcaggcccaaggtagtacatctatcctccaggccctactaaaggccttttctttccacgacctggaagggctttatcttctgaccgatggcaaacctgacacaagttgttcattagtcctcaatgaggtgcaaaagttgcgtgaaaagcgcgacgtcaaagtacacacaatcagcctcaactgtagtgacagagccgcagtggaatttctgcgcaagctggcaagtttcaccgggggacggtaccactgcccagtgggagaggacaccctgtccaaaatccactcgctcctgaccaagggattcataaacgaaaaggatcccacgctcccacccttcgagggagacgatctgcgcatcctcgcgcaggaaatcacaaaagcccgatcctttctgtggcaggcacagtctttccggtctcagttgcagaagaaaaatgacgccgagcctaaggtgacgctgtcctag

SEQ ID NO: 5963 - DNA, 3555 bp, Artificial Sequence
  Description of Artificial Sequence: Synthetic coding sequence
atgaaaaagtatagaaaaatttctatcgggtgctttgcaatggccactcagaccagccacgtatttcacggccaggaaaatatgttcctcgaaaaccactgtatccgcaggaacaccggtagagattctaagaaacctttgaagcaaaagaacatgaacggcctcggccaaaactctgataacggactgcttgtgactcacgtgaatcagacgcaggacttactgaggctccaaggctctgaaacccaaagttctgattgggaagactctgaagattggttgagcgcgcactcattaaagtgccagaagctcaccctcgccgacctcatttcccaaggtactgaagttcttgaagaggggaccaatgtggtccagaagatctgtttcagcacccagatcatcaggcatttcgaatccaagttgtctgatactatcgaggtctatcaggagcgtatccagtggctgacagagaatagcaaaaaggcctttggattaattaagggagccagagtgtcaattctcatcgacgttagcgctatttcaagtgggccacagaaggaggaattccagaaggatctgatgtcgcttatcgacgagcagctgtcccacaaggagaaactcttcgttctctccttcggaacaaatgcaggatctctctggcctgatcctatggaggtgtctgcaagtactctgcaagagctcaaactgtgggtcaaaaccttgcagcctgatggagggagtaaccttttgcaagcattgaaaaagatttttacactgaaagggttggacagtcttgtggccatcatgagaagttgccctgatcagccatctgagatcctctctgactacatccagcagtccaccatgggtagagatttaattatccacttcattacatatcggtgtgacgatcagatgccacctgcggtgctgaaaaatctcgccgaggctgtcagagggtattatcactgctactcccccaaaatggagcattatactagtcgagatatggacgagcttctcgcagaaatacagaaggcacaaagtctgctgtcgcatgtgcaggccttacagcattcctccccatgtgaagccctgacgtgtaccatggaggaaatcagcacggagattacaaatggacctctcattagcttgttaccgaagccgccaaagcacgatgcacctctgaccatcgagttccccaacctggacaaaaccagcgcggagtggttaaaagtaaacgggctgaaggctaagaagctttcgctctatcaggtgctcgctcctaatgctttctctcctgtcgaagagttcgtgccaattctccagaagactgtgtcaagcactatccatgaaaaagcgatgatccaattcgagtggcacgacgggacggtgaagaatattcacgttgaccccccatttctatataagtatcagcagcagctgtcccgtgcaatgaggatgtatgagcgtcgcatcgaatggctgagtctcgccagtagaagaatttgggggaccgtgtgcgagaaacgcgtggtcgtgctgctcgacatcagcgctaccaactccatgtacatcattcacatccaacatagcttgcggctcctgctggaggaacagttgtcaaataaagactgctttaatctgattgctttcggctccaccattgaaagttggcggccagagatggtccccgtgtcccacaataacctccagtccgcatggcgatgggctctaaacctgaggtgccgtggctctcggaacgttttgtctgctttacgaaaggccgtggaggtggacttcaaggataaggataaacaccagtcccaagggatttatctttttacaggaggcataccggatcaggatatgccgacgctcagtgcctacatggctgaagcatgcggcgggtgcgacttgcagctaaacgtttgtctgttttacgttggcgaacccaaaatggacactacccctccagcccgatacgctagccacacagacacagctgctgcctacaaagaagtgacgagggcagccggaggtcgatttcattggttcggcgatacaggcatctatgaaagcgatgatatcaattcaataatgtcggagatggaaaaagctctgaactactcgcagaagtgtgcattcctcatggcctccctcaagaatcattccgggaaggtactcggaagttctgctctccctaaagaaaagccaaagactctccagttgcgaagtcagcccaaaaaattgtgtcctcccaggccaaccgtcccacttggcgcacgaatgtcaatcaaagacgatcctgaccgcgaaaaaagtccgcccttaaagagcctgaagtggcgccctctgagttctagagtgggaatcagccccgccgcagcccagccgactaaggaggggatgatggaactacgtcgcaagaccaaaagccgcgaggcagagacaagtctactgttgttctataccgaaaagggtaacgacgtggggagcgtctacaaaaagtaccctcagggtcgcggtctcagacgtacctccagtagcatcgacctgccaagaaaagatacagtgtgtagctcacaggagtgggtggcgaagtatggcttgaaaaagcttaaactggagatctccagatgtatgggcccaaactgcacccatcagaagtccggccaacggtccgccagcgctaaacattgttccatcttcccctccgtagaaattcacggtgtagtgagacatatacaatggacccctcgcgagatggaagtgtatatacgccatctcgaaaaggtcctgcgacgctatgttcagcggctgcaatggctattgagcgggagcaggcggctatttggcaccgttttggagtctaaggtgtgtattctgttggacacctctggcagtatggggccttatctccagcaggtaaaaactgagctcgtcctgctgatctgggagcagctccgcaaatgctgtgactcattcaacctgttatcctttgctgaatcgttccaaagctggcaggacactcttgttgagaccaccgacgcagcctgccatgaggctatgcaatgggtgacccaccttcaggcacaagggagcacgtcgattctgcaggcattactgaaagctttctcttttcacgatctcgaaggtctatacttactgacggacggcaaacccgataccagctgcagcctggttcttaacgaagtgcagaagttacgcgagaaacgcgatgtgaaggtgcataccatatcactaaattgcagcgaccgcgctgctgtggagtttcttcgcaagctggccagcttcaccggaggaagataccactgtcccgtgggcgaggacaccctctccaagatccactccctcctgacaaagggattcattaatgaaaaggatcccacactacctccttttgaaggagatgacctcaggatactcgctcaggaaatcaccaaggctaggtcatttctttggcaggcacaaagtttcagatcacagttacagaaaaaaaacgacgctgaacctaaagtaacgttgtcttag

SEQ ID NO: 5964 - DNA, 906 bp, Artificial Sequence
  Description of Artificial Sequence: Synthetic coding sequence
atgcttcccttaacaatgactgtcctgattctgttacttttgcctacaggccaggccgcgcctaaagatggggtgactcggccggacagcgaagtgcagcatcagctgctccccaaccccttccaacccgggcaagaacagttgggattgttgcagagttacctgaaaggtctgggcaggacggaggtgcaactagaacacctctcgcgggagcaggtgctgttgtacttatttgcactccatgactatgaccagtcggggcagctggacggccttgaactgctgtccatgctcacagctgctctcgctcccggagccgccaatagcccgactacaaatcccgtgattcttattgtggacaaggtgcttgaaacccaggacctgaacggtgacgggctgatgactcctgctgaattgatcaacttccctggagtggcgttaaggcatgtggaacctggcgaacccctcgcgccctcacctcaggagccccaggccgtgggtcggcaatcgcttcttgccaagtcccccttgcggcaagaaacccaggaagcccccgggcccagagaagaggcaaaaggccaagttgaagctcgccgagagtcactggaccctgtacaggagcctggcggccaggccgaagcagatggagacgtccccggcccccgaggagaggctgagggccaggccgaggctaaaggagatgctccagggcctagaggcgaagctgggggacaggctgaggccgaaggcgatgcacctggccccagaggcgaagctggaggacaggcagaagctagggaaaacggcgaggaagcgaaggaactgccaggggaaacacttgagtcgaaaaacacccagaacgatttcgaggtgcatatagttcaggtggagaacgatgaaatctag

SEQ ID NO: 5965 - DNA, 4722 bp, Artificial Sequence
  Description of Artificial Sequence: Synthetic coding sequence
atgagagtactggcctgcttactggccgcactcgttggtatacaggcagtggagcgcctgagattggccgacggcccccacgggtgtgccggacggctcgaggtgtggcatggtggtcgctggggaacggtgtgtgatgatggttgggacctcagagatgctgcagtggcctgccgacaattgggatgtggaggcgccttggctgcccccggcggcgcattctttggtgaaggagctggccctgtatggctttcagagctcgcgtgtcgcggtaatgaaggccagttgggtctttgccaccaccgtgggtggaaggcacacatctgctcgcacgaggaggacgccggagtggtatgtgcgggccagcgcgtcgccaactcgcgtgacgattctacatcccctctggacggcgcgccctggccgggactgctgctcgagctgtcaccctccaccgaagaacccctggtaacacacgcaccacggcctgcaggaaatccacagaacgcatcccggaaaaagagccccagacccaaacaggccaaaagtaccagggcgcccttgctgaccaccggtgctccaagacaggaaaggctgcgactggtgagtggaccccatcggtgcgcgggacggctggaagtctggcacggggggaggtggggcacagtgtgcgacgatggctgggacctccgcgatgccgccgtcgcatgcagggagctcggctgtggaggcgccctggcagcccccggcggcgcacgcttcggaccgggggctggaccagtgtggatggacgatgtggggtgtggaggcggtgagcaggccctcagggactgtccacgcagcccttggggacggagtaactgtgaccacagcgaagatgccgggctggtatgtacaggccccgcccccagacttcgcctggccgacggacctcatggatgtgctggcaggctggaggtgtggcacggagggagatggggctcagtgtgtgatgatgcctgggacctgagagatgcagcagtggcgtgtcgcgagctcgggtgtggcggcgcactagccgcccctggtggggccttcttcggcgagggaagcggtcctatcatactggacgaccttcgatgtcggggcaacgagacagcgttacgcttttgtcccgcgcgcccctggggccagcacgactgccaccatcgggaagatgctggggctgtgtgtgacggtatgccgcttggatacgtgcctccaaccgcacctaccgattctaacaactccactccacgagaggcggcatctagacccccgagtaccatgaccagtcaggccccagggacagctggtgtgagtcctccgccagccagccctacagtcctgtgggagccaggacctgaagcaggctcccctcagctacgcctggtggctggaccttccaagtgctccggacggctggaggtgtggcatgatcagcgctggggtactgtctgtgatgacagttgggatatgagagacagcgcggtcgtttgtcgggaactcggctgcgggggtccccagcagccagaccctgccgcggggcggttcggctggggagccggacctatctggctggatgatgtcggatgtgtgggcacagaggcaagcttaagcgattgcccagcagcaccatgggggaaacataactgcgcccacaatgaagatgtgggagtcacgtgtacagggccaccagggctggactcaatttcggaccctttttcatggagctggatcccaggactcggaagggaccgggacgcttggttaccgggtgagcttgctacaaagcccagtgcctccgtgacagcttcagtgttggagaagactacaacaaaggctcccggaaaaatgcccaagagtaccaaaaagtgggtgaccaaaaatgcaaaacggcccacaacccagcccccggtgatgcctaccaccaagcactctcgcgcccaaagcccccctgacttaacctctcagaccacagcagccctgaccacagaggcctccaggcgacctacaagcgaattcactcgacgaccaactacagaggctcctcagcgctggacaagtcatacaactgccacccttacgccccaggcccctagagagaggactaccaagaccatggccatgctcacaacccaaggtcctcaggaaatgacatcggaatctactataaaatccatccctcaagctagcctggagccatccgcggagatccccgagggctcaccagagtcccccaaagaccctgccccttcgccttcggttagtacaactggggagtccgggcttttccgggtgaggttggccgatggccctaaccggtgcgctggccgtctggaggtctggcacgcggggcggtggggtaccgtctgtgatgataactgggatcttagagatgcaacagtggcctgctgggaactagggtgcggcaaggtaaggcccagagtgggcaagactcactatggcccaggaacgggcccgatttggctcgacgacatgggctgcaagggaagtgaggcatctcttagtgattgccccagcggcgcatggggaaagcacaactgtgatcatgaggaagatgtcgggctgacctgcaccgggtacacagactatgacgattaccccccatggacatgggaccctacctcaagggaggacctcgctaagggaaccacaactgcgggggtgcccggacataccttgccatggcgtacgactagacgaccagggtcctcttctccggctattagacgcctgcccgacactgggagtaaggacggttataaacttccatggacttgggataccccatcaggacgcggcctggccgaaggaacacccaccgcagggaagcttggacctaccttgggcgccgggactactcgcagccccggcagtcctcctacgctgcgcgtccacggagatacaggctccccaagaaaaccttggcctgaaaggagacctcccagaccagcagccaccagaaccgctcctcctacccccagcccaggcccaagtgcttcccccggcccaccgggaccagccctcacatccgacagcagccgggaacttaccccccactcagccctgacctcagaggccacctccgacgctcctgacactagcccacctactccggatcctgcatctcgcaccaatcccgacttaatcctgacatccccggacttcgcgctgtccaccccggactccagtgtggtccccgcactgactcccgagccatcaccaacccctcttcccactctgccgaaagaactaacctcagacccatccaccccctccgaagtgacaagtctgtcccctacaagcgaacaggtcccagagtctgacactactccagacctggacacgaccccgtactcttccactgtgtcagagtatagcagatccccagaccccagccccagtcctcatccaaccaccactcctgaccctacgatggctccagatccaatcaccaccctgaaccctaccgtgactccacattttcccacaacaccccatcccacaacaacgcctcatcccactacaattacccactccactatgatcccggaccccacgactacaccccagcccttcactactatcacacactcaacaatgattcctgaccctaccactactcctcagccatttacaaccatgcaacctaccacaacccctcattcaactacccctcaccctactactactccccaccccaccacaataacccatagcacaatgattccggatcccaccacgacgcctcagccctttaccacgatgcagcctaccacaatgccacaccccacaacaacaccccatcctacaacgaccccccaccccaccactaccccccaccccacgaccactccgcacccaacaatgacaccggatcctacaacaaccccctatcccacgacaacacctgatccaacaacgacacctcaccctacgactcctgatccttcgagcactccagtgatcactacggtgtcattgcccacttctttgggcaccgaactcagttcgccaactctggcacccactgtgaaaccgtctttacaccctcagctgacatttaccgctccggcgccacacacttctacgtcccagatccctacactggaaccttccccggccctggagagtagtccatcacggagttcgacagctaccagcatggacccgctgtccacagaagatttcaagccaccacggtcccagagcccgaacttaacgccccccccaacccatactccacattctgccagcgacctgacagtttcccccgatcccctcctcagccccaccgcccatcctctggatcatccaccactagatcctctcacccttggacctactcccgggcaatccccaggaccacacgggccttgtgtggcacccacaccccctgtaagggtgatggcatgcgagcctcccgccctcgtggagttagttgccgccgtgcgggatgtgggcggccagttacagcggctcacccaggtggtcgaacaggaaaggcaggagcggcaggcactgctgctgggactcacccaactcgtagaggcagcccgcgggctgggtcagctgggcgaggccgttaagcgccttgccgagatggcatggacaacaagcatgcccgcccccaccaccacaaccccagaagaagaggagagaccactgcgcggggacgtctag

SEQ ID NO: 5966 - DNA, 1911 bp, Artificial Sequence
  Description of Artificial Sequence: Synthetic coding sequence
atgacgacatggagcctcaggcgtcgccctgcacggactcttgggctgctgctgctggtggttcttggtttccttgtactgcgacgtctggactggtccacgttggtaccgctccgactgcggcacaggcaactgggactgcaggcgaagggatggaattttatgcttgaggatagtaccttctggattttcggaggtagtatccactatttccgcgtaccacgtgaatattggagagaccggctgttaaagatgaaagcctgcggcctgaacaccctgaccacgtacgttccatggaatctgcacgaacccgaacggggcaaattcgactttagcggcaacctagatctggaagcattcgttctgatggccgctgaaatagggctttgggtcattctccgcccaggaccctatatttgcagcgaaatggacttgggcggactcccctcgtggctcctgcaggatccaggtatgcgtcttcggacaacctacaaaggcttcaccgaagcggttgatctgtattttgaccacctcatgagcagggttgtgcctttacaatataagagaggagggcctataatcgccgtgcaggtagagaacgagtacggctcctacaacaaagacccggcatatatgccatatgtcaagaaggcactcgaagacagaggcatcgtagagctcctgctgacttccgataacaaggacggcctgtcgaaggggattgttcagggcgtgctagctacaatcaacctgcagtccacccacgagctgcagcttctgacaacgtttctgttcaacgtgcaggggacacagccaaaaatggtgatggaatactggacaggctggttcgatagctggggcggcccacacaatatcctggattcttctgaggtcctcaaaaccgtgtccgcaatagtcgacgccggatcaagcataaacctgtacatgtttcatggtggaactaacttcgggtttatgaacggcgccatgcactttcacgactataagagcgatgttacaagctatgactatgacgccgtcctcactgaagccggagattatacagccaagtatatgaagctgagggatttttttggatccatctcaggtattcctctcccaccaccgcctgacctcctacctaagatgccttatgagcccctgacccctgtcctgtatttgtccctgtgggatgccctgaaatacctcggcgagccgatcaagagcgaaaaacccattaacatggagaacttgcctgtgaacggggggaatgggcaaagttttgggtatattctgtacgagacctccatcacatcgagtgggattctctccggacacgttcatgacagagggcaggtgtttgttaacaccgtctcgataggcttcctggattataaaactactaaaatcgcagtacccttgattcaaggctatactgtactccggattttggtggagaatcgaggtagagtaaattacggggaaaatatcgacgatcagaggaaaggccttatcggtaacttatatttgaatgacagcccactgaagaacttccgcatttattccttggatatgaaaaaatccttttttcagaggttcggccttgataaatggtcgtcgctgcctgaaactcccaccctccctgcatttttcctgggatctctgagcatatcttccaccccttgtgatacgttcctgaagctggaaggctgggaaaaaggagttgtattcatcaacgggcagaacctgggccgttattggaatattggtcctcaaaagaccctctatctccccggaccatggttatcctcaggtatcaaccaggtcatagtcttcgaagaaacaatggctggccctgcattgcagtttaccgagactccccatctgggcaggaaccagtacattaagtag

SEQ ID NO: 5967 - DNA, 2037 bp, Artificial Sequence
  Description of Artificial Sequence: Synthetic coding sequence
atgcgtacagtggtcctaacaatgaaagctagtgtgatcgagatgttcctggtgctgctcgtgaccggggtccactctaataaggaaaccgctaaaaaaattaaacgccccaaattcactgtgccacagataaattgtgatgtaaaagcgggtaagataatcgatcccgaatttatcgtcaagtgtcccgcagggtgtcaggacccgaagtatcatgtttacggcaccgacgtgtacgccagctactctagcgtatgtggtgccgccgtgcacagcggggtcctcgacaacagcggtgggaagatccttgtcaggaaagtggctgggcagtccggatacaaaggctcttactctaatggtgtccagtccttatccttacctaggtggagggagtcatttattgtgttagagagcaagccgaagaagggcgtgacttatccatccgcactgacctattccagcagcaaaagccccgcagcccaggccggggaaacaacaaaggcctaccagagaccacctatacccgggacaacggctcagcccgtcacactgatgcagctgcttgcagttacggtggccgttgcaactcctaccacgctaccacgccccagcccgtcggcagcctcaaccacctctattccgcgtccccagtcagtgggacaccgatcccaggaaatggatttgtggagcaccgcaacctatacgtcatcccaaaaccgccccagggccgaccccggaattcagagacaggacccatccggagccgcctttcagaagccggtgggagccgacgtttcccttggactggtccccaaagaggagctgtccacccagtcattggaacctgtgagtttgggggatccgaactgtaagattgacctgtcgttcttaatcgatggttccacctcgattggaaaaagaaggttccgaattcagaaacaactgctggctgacgtggcccaggccttggacattggcccagccggacccctgatgggtgtcgtgcagtatggggacaatcccgcaactcacttcaatctaaagacccacactaactccagagacctgaagaccgcaatcgagaagattacccaacgtggcgggctgtcaaacgtcggacgggccattagcttcgtcacaaaaaactttttcagtaaggcgaacggaaatagatccggtgcccctaacgtggtagtcgtgatggtagatgggtggccaacagacaaggtcgaggaggcgagtagattggcacgcgagagtggcattaatatcttttttattacgatcgagggggctgcggaaaacgaaaaacaatacgtcgtggagcctaacttcgccaataaagccgtgtgtaggacaaacggattctactccctgcacgtgcaatcctggtttgggctgcacaagacccttcagccactcgtgaagagagtctgcgacaccgatagactcgcttgcagtaagacttgcctcaattctgccgatatcgggtttgttatcgatggaagctcttcagtagggacgggtaactttaggacagtgctgcagttcgtgaccaacctgacgaaagagtttgaaatcagcgatactgacaccaggatcggagctgttcagtatacgtatgagcaacggctagagttcggcttcgacaagtactccagtaagcctgatatcctaaatgcgattaagagagtgggctactggtcaggaggcacgtccaccggggcagccataaatttcgcactggaacagctctttaaaaaatctaaaccaaataagaggaagttgatgattctgatcactgatgggcgctcatacgatgacgtcagaatcccggccatggctgcccacctgaagggggtaataacctacgcaatcggggtggcctgggccgcccaggaggaattagaagtgatcgccacccacccagcccgagaccatagttttttcgtggacgagtttgacaatctacaccagtacgtgcctagaataatacaaaatatctgcaccgaatttaatagccagccacggaattag

SEQ ID NO: 5968 - DNA, 324 bp, Artificial Sequence
  Description of Artificial Sequence: Synthetic coding sequence
taaactgtagctgctccttcagtctttatattcccaccttctgatgagcagctcaagtccgggacggctagtgtggtgtgccttttgaacaatttctacccccgtgaggctaaggtgcagtggaaagtcgataatgcccttcagtcaggcaacagccaagagtctgtcactgaacaagattctaaagacagtacctacagcctgtccagcacactcaccctcagtaaggcggactacgaaaaacacaaagtctatgcttgcgaagtaacgcaccagggcctgtcttctcctgtgaccaagtcatttaaccggggagagtgttag

SEQ ID NO: 5969 - DNA, 366 bp, Artificial Sequence
  Description of Artificial Sequence: Synthetic coding sequence
atggtgctccagacccaggtgttcatttcattgcttctttggatatcaggagcctatggcgacattgtcatgactcagtcccccgatagcctagccgttagcctgggtgaacgtgctaccatcaactgtaaaagtagccaaagcgtcctgtattcttctaacaacaaaaattacttggcttggtaccagcagaagcctggccagccgcccaaactactgatctattgggcatctactagagagtcgggggtacccgatcgattcagcgggagtggctccggcaccgatttcactctcacaatctccagcctacaggccgaggatgtggcggtctattattgccagcaatactatagtaccccctag

SEQ ID NO: 5970 - DNA, 984 bp, Artificial Sequence
  Description of Artificial Sequence: Synthetic coding sequence
gctagcactaaggggcctagcgtctttccgcttgctccctgttcccggtccacttcagagagtaccgccgctctgggctgtcttgtgaaggattactttccggagcccgtcacagtatcttggaattcaggtgcgctcacatctggagtccacactttccctgccgtgctccagtcctcaggactgtattccctctcctctgtggtgaccgtcccgtctagcagcttgggaaccaagacgtacacatgcaatgtggaccataaacctagcaatactaaagtggataaacgtgtggaatctaagtacggcccgccatgtccttcatgtcccgccccagagtttctcggcggcccatctgtgttccttttcccaccaaaaccaaaagatactctaatgatctcacggacccctgaggtgacttgtgtggtagtggatgtgtcacaggaagacccggaagttcagtttaactggtacgtggacggggtggaggtgcacaacgctaaaaccaaacctagggaggagcagtttaattctacatatagggtagtaagcgtgctcacagtgttgcaccaagactggctgaatggaaaggaatataaatgcaaagtgagcaataagggcctgccatcttctatcgagaaaaccatctcgaaagccaaaggacaaccacgcgagccccaggtgtacaccttacctccgtcacaggaagagatgacaaaaaaccaggtcagcctgacctgtcttgtgaagggtttctatccctccgacatcgcagttgaatgggagtctaatgggcagccagagaataattacaagaccacccccccggtactggactcagacggctctttcttcctttattcacggttgaccgtggataaaagtagatggcaggaaggcaatgtgttcagctgctctgtgatgcacgaagcattacacaaccactacacgcagaagagccttagcctcagcctcgggaagtag

SEQ ID NO: 5971 - DNA, 981 bp, Artificial Sequence
  Description of Artificial Sequence: Synthetic coding sequence
gcctcaactaagggcccaagtgtcttccctctggcgccttgctcaaggtctaccagcgaatccactgcggctctgggctgtctggtgaaagattattttcccgaaccagtaacggtgtcttggaacagcggggccctgaccagcggggtgcacacttttcccgctgtgctgcaatcttctggcctctactcgctgagttccgttgtgacagtgccgagttccaacttcggaacacagacctatacatgcaatgtagaccacaaaccgtctaataccaaagtggataagactgttgagagaaagtgctgcgtcgagtgccccccatgccccgctccccccgtagccggcccttccgtgtttctgttcccccctaaaccaaaagacaccctgatgatttcaagaacacccgaggtcacctgtgtcgtggtggatgtctctcatgaggaccctgaggtgcagttcaattggtatgtggatggcgtagaagttcataacgcaaagaccaaaccgagagaagaacaatttaattccacctttagggtggtcagtgtactgaccgttgtacaccaggactggctgaatggtaaggagtacaagtgtaaggtttcaaataaaggccttcccgctcccatcgaaaagacaatctcgaaaacgaagggacagcccagggagccccaggtctacactcttccgccgtctagagaggaaatgacaaagaaccaggttagccttacctgtctggttaagggcttttatccctctgacatctctgttgagtgggagtcgaacggccagcctgaaaacaattacaaaactactcccccaatgctggacagtgacggcagtttcttcctctactccaaactgaccgtggacaaaagccgttggcaacaggggaacgtatttagttgctccgtgatgcatgaagccctccacaaccactatacacaaaaatcactctcactgtccccaggcaagtag

SEQ ID NO: 5972 - DNA, 993 bp, Artificial Sequence
  Description of Artificial Sequence: Synthetic coding sequence
gcatcaaccaaaggcccttctgtctttccactcgctccctcgtcaaagtcgacaagcggcggcaccgctgccctcggttgtctggttaaagactatttcccagagccggtgaccgtttcttggaactcaggcgctcttacctccggtgtccacaccttcccagccgttcttcagtcttccggtctgtacagcttgagtagcgtggtgactgtgccttctagcagcctcggtacgcaaacgtacatctgcaatgttaaccataaaccttcaaatacaaaagtggataagaaggtagagcccaaatcatgcgataagacacacacttgccccccttgtcctgccccagaactactcggtggcccatcggttttcttattccctcctaagcccaaagacacactcatgattagccgaacacccgaggtgacatgcgtggtggtggacgtgtcccacgaggatccagaagtaaagttcaactggtacgtggacggggttgaagtccacaatgccaagactaaacctagggaagagcagtacaatagcacctatagggtggtctccgtgctgactgttcttcatcaggactggctgaatggcaaggaatataagtgtaaggtcagtaacaaagcgcttcccgcccctatagagaaaactatatctaaagccaaaggccagcctagggaaccccaggtctacactctccccccaagcagggacgagctaacaaagaatcaggtgtccctgacctgcttggtgaaaggattctacccttccgacattgctgtggaatgggaaagcaacggccagcctgagaacaactataagacgaccccgcctgtgttagatagcgatgggtctttttttctttactccaagctgacggtggataagagtcggtggcagcaaggcaacgtcttttcctgctccgtgatgcacgaagcacttcacaatcactatacacagaagtcactatccctatctcccggaaagtag

SEQ ID NO: 5973 - DNA, 651 bp, Artificial Sequence
  Description of Artificial Sequence: Synthetic coding sequence
atgggtgctgtgatggggacctttagttcattgcaaaccaaacagagacgcccatccaaggacaagatagaagatgaacttgagatgacaatggtgtgccatcgccctgaggggcttgagcagctggaagctcaaacgaatttcacaaaacgtgagttacaggtgttgtacagaggttttaagaacgagtgtcctagtggcgttgtaaatgaggatacgttcaaacagatctatgcacaattttttccacacggggacgcaagtacctacgcccactatctgtttaatgcttttgatacgacacagactggatctgtcaagtttgaggatttcgtgacagccttaagcatcctgctgaggggaacagtgcacgagaagttgcgctggacttttaacttatacgatattaacaaagacggttacatcaataaggaagagatgatggatattgtcaaagccatctacgatatgatgggaaagtacacatacccagttctgaaggaggatacccctcgtcagcacgtcgacgttttcttccagaagatggacaaaaataaggacggaatagtgactctcgacgagttcctggaatcttgtcaggaggacgacaatataatgcggagcctgcaactcttccaaaatgtcatgtag

SEQ ID NO: 5974 - DNA, 762 bp, Artificial Sequence
  Description of Artificial Sequence: Synthetic coding sequence
atggcccgcagccttctactacccttgcagatccttctactatcactggccttagagacagctggggaggaagcgcagggtgacaaaattattgacggggccccctgtgcgaggggaagtcacccatggcaggtggcccttctgagcggcaatcagctgcattgcggcggggtgctggtaaatgaacggtgggtgctgacagctgctcattgcaaaatgaatgaatatacggtgcacctgggttcagacacccttggcgaccgccgagcccagagaatcaaggcttccaaatctttcagacatcccggctatagcacacagactcatgtcaatgatctcatgttggtgaaactcaattctcaggcgcgcttgtctagcatggtgaaaaaagttcgcctgccctctaggtgcgaaccgcccggaacaacgtgcaccgtctctggatggggaaccactacgagcccagacgttaccttcccatcagacctgatgtgtgtggacgtcaaattaatcagcccccaggattgcacaaaggtctacaaggatctcctggagaacagcatgctttgcgccggcattcccgatagcaagaagaatgcgtgcaacggcgactcaggagggccccttgtatgtagggggacattgcagggtttagttagttggggtactttcccctgtggtcagccaaacgacccaggggtgtatacccaagtctgtaaatttactaagtggattaatgacacgatgaagaaacataggtag

SEQ ID NO: 5975 - DNA, 468 bp, Artificial Sequence
  Description of Artificial Sequence: Synthetic coding sequence
atgtttcagcgcctcctgctgctgctgttgctatccatggggggcacttgggcctcgaaagagcctcttagaccaaggtgtcggcctatcaacgccaccttggctgtggagaaagagggctgcccagtctgtataaccgtgaatactaccatctgtgcgggctattgccctactatgacacgtgtattgcagggtgttttgcctgcacttccccaggtagtgtgtaattacagggatgtaagattcgagtctataagactgccaggatgcccaagaggcgtcaaccccgtggtgagttacgcagtagccctaagctgccaatgtgcgctgtgccgaagaagcacaactgactgcggcgggccaaaggaccatcccctgacttgcgatgatcctcgcttccaggacagcagcagcagtaaggccccgcccccttctctgccatctccgtcacgactccccggaccttag

SEQ ID NO: 5976 - DNA, 1554 bp, Artificial Sequence
  Description of Artificial Sequence: Synthetic coding sequence
atggccgtttctagaaaggattggtcagctctgagctcacttgctcgtcagcggacactggaagatgaagaagaacaggagcgagagagaaggcgaagacatcgcaacctatcctcgacaacagatgacgaggccccgaggctctcccagaacggggaccggcaggcaagcgcttcagaaaggctgccatccgtcgaggaggccgaggtgcctaagccgctgcctcccgcctcaaaggacgaggatgaagatattcagtccatcctgagaacaagacaagaaagacgccagaggcgacaggtggtggaggcagcccaagcacccatccaggagaggcttgaggctgaggaagggcggaacagtctgagtccagtgcaggcaactcagaaaccgctggtgagcaagaaggagctggagattcctcctcgtcgcaggctgtctcgcgagcagagagggccttgggctctggaagaagaaagcctggtgggcagagaacccgaggaacggaagaagggcgtcccggagaagtcccccgttctggagaagtccagtatgccaaagaagacagctcctgagaagtctctcgtgtctgacaaaacttcaatctcagagaaagtactggcctccgaaaagacctctctatccgagaaaatcgcagtcagcgagaagagaaactctagtgagaaaaagagtgtactagaaaaaacctcagtgtccgagaagtctctggcgccagggatggccctcgggagcggcaggcggctcgttagcgagaaagctagcatcttcgagaaagcattagcctcagagaaatcccctaccgcggacgcgaaacctgcgcctaagcgtgccaccgcatccgagcagccactcgcccaggaacctccagcatctggaggctccccggccacaactaaagagcaacgtgggagggcactccctggcaaaaatttgccaagcctcgcaaaacagggcgccagtgacccacccaccgtggcctctcgactgccacctgttacactacaggtgaagatcccaagcaaagaggaggaagcagatatgagctcccccactcaacgcacatactcttccagcctgaagagaagctccccaagaacaataagtttccgaatgaaaccgaagaaagagaacagcgagaccactcttactcgcagcgcctccatgaaactgcccgacaacaccgtgaagttaggggagaagctggaacggtaccacaccgctattaggagaagtgagtcggtcaagagtcggggactgccttgcacagagctgtttgtggcacccgttggcgtagcctcgaagcgccatctttttgaaaaagagttggcagggcagagccgggctgaacctgcaagctcacgcaaggagaacctcagactgtctggggtcgttacttcacgcctgaacctgtggatctctcgaacccaggaatccggagatcaggaccctcaagaagcccagaaggcctcctcagcaactgaaaggacacagtggggacagaagtcagatagtagcctcgatgcagaagtgtag

SEQ ID NO: 5977 - DNA, 270 bp, Artificial Sequence
  Description of Artificial Sequence: Synthetic coding sequence
atgcaggcgtgcatggtgcccggcctggccctgtgtctcctgctgggccccctcgcgggagcaaagcctgtacaggaagaaggcgacccttacgcagagctcccggcaatgccctattggcccttctccactagcgatttctggaactatgtgcaacatttccaggcactgggcgcctacccgcaaatcgaggacatggctcgcaccttttttgcccattttccattgggatcaaccctcgggttccatgtcccttaccaggaagattag

SEQ ID NO: 5978 - DNA, 1302 bp, Artificial Sequence
  Description of Artificial Sequence: Synthetic coding sequence
atgggaaatgcttgttgggagctgtactgcttggaacacggcattcagccagacggtcagatgccaagtgacaagaccattggggggggggatgattctttcaccacatttttctgtgagaccggcgcaggcaagcacgtgcctcgggctgtgtttgttgatctcgagcctacagtgatcgatgagatccggaacggcccctatcgccagctgttccatcccgagcagctcataactggcaaagaggacgccgccaataactacgcaaggggtcactacaccattggtaaggagatcattgatccagtcctggacagaatccggaaattgtccgaccaatgtaccggactgcaaggctttctggtctttcatagctttggcggcgggacaggctcaggcttcacgtcgcttctgatggagaggctctctgtggactatgggaaaaagagtaaattggagttttctatttaccctgctccacaggtgagcaccgcagtcgtggagccctacaacagtatccttaccacccacactacactggaacattccgattgcgccttcatggtggacaatgaggccatttatgacatctgcaggcggaatctggacattgagcgccctacatacaccaacctgaaccggctcatttcccagatcgtgtcctccatcactgccagcctgcgcttcgatggcgccctgaacgttgacctcaccgagtttcagactaacctggtcccatacccgaggatccatttccctttggcgacctacgctcccgtaatttcagccgaaaaagcttatcacgagcagctctcggtggctgaaataacaaatgcctgcttcgaacccgctaatcagatggtgaagtgcgacccccggcacggaaaatacatggcatgctgcctgctttaccgtggggatgtagtcccaaaagacgtcaacgcagcgatagccgccataaagacaaaaaggagcatccagttcgtcgactggtgccccacagggttcaaggtggggatcaattatcagccaccaaccgtagtgcctgggggagatctcgctaaagtacagagggcggtttgcatgctgtcgaacacgactgcaatcgctgaagcgtgggcccgtctcgaccacaagttcgatctgatgtacgctaagcgagcttttgtgcactggtacgtgggggaagggatggaggaaggcgaattttcagaggcacgggaggacatggccgctcttgaaaaagactatgaggaggtagggatcgatagttatgaggacgaggatgaaggcgaagagtag

SEQ ID NO: 5979 - DNA, 1965 bp, Artificial Sequence
  Description of Artificial Sequence: Synthetic coding sequence
atggcccccaagaaactcagctgtttgcgttccctgctcctgcccctcagcctgacactgttactgccacaagccgatactaggtccttcgtggttgaccgcggccacgaccgttttcttctggatggagctccattcaggtacgtttcaggctcgcttcactattttagggttccacgcgttctgtgggccgatagactgctgaagatgaggtggtcaggactgaatgcaatacagttctacgtcccatggaattaccatgaaccccagcctggggtctacaacttcaacggttcccgcgatctgatagcttttctcaacgaggccgctcttgcgaatttgctggtgatactcaggcctggtccttacatttgtgctgaatgggagatgggcggcctcccaagttggttgctacggaagcccgagatacatctccggacatccgaccctgactttcttgcagccgtcgatagctggttcaaggtgctacttccgaaaatatatccgtggctctaccataacggagggaatatcatatccatacaagtagagaacgagtacgggagctatagggcttgtgacttcagttacatgcgccacctcgccggactctttcgggcactcctaggagagaaaattttgctgtttacaactgacggtcccgagggtcttaaatgtggcagcttgcgtggactctacactacagtggacttcggtcccgccgacaacatgacaaaaatttttactctgctgagaaagtatgaaccgcatggaccactggtaaatagcgaatattatacgggttggctggattactggggtcaaaatcactcgacaagatccgtttccgccgttaccaaaggcctcgaaaacatgcttaagctgggtgctagcgtaaatatgtacatgtttcacggaggtaccaactttggatactggaatggagcggataagaaaggaagattcctgcccattaccaccagctatgactatgatgcaccaattagcgaggcgggcgatcccactccgaagctcttcgctttacgggacgtaatatctaaatttcaggaggtgccactcggcccgttgccaccaccttctcccaaaatgatgctcggacccgtgaccctccacctggtcggccatttgcttgcttttcttgatttactttgcccacgagggcccattcactctattttgcccatgacatttgaagcggtgaaacaagaccacgggttcatgctctatagaacttacatgactcacactatcttcgagccgaccccattttgggtgccaaacaatggagtccacgaccgcgcgtacgtaatggtagacggcgtttttcagggagtagtggagcgaaatatgagagataaactgtttctgactggtaagttaggctctaagctggacattctagtggagaacatggggcgtctctcctttggcagcaattcctcagacttcaaagggctcctcaagccgccaatccttggtcagacaattctgacacagtggatgatgtttcctctgaagattgataatctcgtgaagtggtggttccctctgcaattgcctaagtggccatatccccaggcacctagcggcccaacattttattctaaaacgttccctattctgggctctgtgggagatacttttctgtacctgccaggctggacaaaaggacaggtatggattaacgggttcaacttaggccggtattggacaaaacagggtccccagcagacgctctatgtgccccgattcctcctcttcccacgcggagccctcaataagatcacactgctggaacttgaggatgtgccactgcagcctcaggtccagtttttggacaaacccattctgaacagcacttcgaccttgcaccgaacacacattaatagcctttcggcagatacgctgtccgcttctgagccgatggagctgagcggacactag

SEQ ID NO: 5980 - DNA, 1173 bp, Artificial Sequence
  Description of Artificial Sequence: Synthetic coding sequence
atgaaattccaggggccactggcatgcctgcttctggctctttgtcttgggtctggcgaagctggcccactccaaagcggggaggagtccaccggcaccaacatcggagaggcccttggtcacggcctgggtgatgcactgtcagagggcgtcggcaaggccatcggcaaggaagcaggcggagcagcgggaagtaaggtatccgaggccctgggccagggtacacgagaggccgtcggcaccggggtgcgtcaggttcccgggttcggcgtggccgacgcattgggcaaccgtgttggcgaggccgcccacgctctgggcaatactggccatgagatcggcaggcaggccgaagacgtgatccgccacggcgccgacgcagttcgcggcagctggcagggagttcctggacacaacggagcatgggaaacgagcggtgggcacggtatatttgggtcacagggcggacttggcggccagggacaaggcaatccagggggtctgggcactccttgggtgcatggctaccctggtaattctgcgggcagcttcggtatgaacccccaaggggccccgtggggacaaggggggaacggcggtcccccgaacttcggtacgaatactcagggcgccgttgcccaacccggctacggaagcgtgcgcgcctctaatcagaatgaaggttgtactaacccacccccctctggaagtggaggtggcagctctaactctggcggcggttcgggaagccaatctgggtcgagcggttcaggatctaacggagataataataacgggtcatcttccggggggtctagctccgggagcagttctggaggtagttccggaggttcttctggaggatcgtccggaaattcaggcggctcgcggggtgatagtggctcagagtcctcctggggctcctctacgggctcctcttcaggcaatcatggaggtagtgggggtggtaacggacacaagcctggctgcgagaaacctggcaatgaagccagggggtctggagagtctggaatccaaggattccgagggcagggcgtcagctctaatatgcgcaacagtgagacgtctccaggaatgtttaacttcgatactttctggaagaactttaagtcaaagctgggatttatcaactgggatgccatcaataaatag

SEQ ID NO: 5981 - DNA, 846 bp, Artificial Sequence
  Description of Artificial Sequence: Synthetic coding sequence
atggggagccgggggcaggggctgctgcttgcttactgcctcctgttagccttcgcctccggacttgtgctctcacgcgtgcctcatgtccagggcgaacagcaggagtgggagggcactgaagaactgccatccccacccgatcacgctgaacgcgctgaagagcaacatgaaaaatatcgtcctagccaagaccaggggcttcccgctagcaggtgtctgcggtgttgcgatcccggtaccagtatgtatccagctacagccgtcccccagataaatattaccatattgaaaggggagaagggcgaccgtggggaccggggattgcagggaaaatacggcaagaccgggtccgccggggctagaggccacacgggaccaaagggtcagaaaggctctatgggggcccctggagagcgatgcaagagccactacgctgctttttcagtgggtcgaaagaagcctatgcattcaaatcactactatcagacggttatattcgacacagaatttgtaaacctgtatgatcactttaatatgtttacaggaaaattttactgttacgttccaggcctgtatttcttcagtctaaacgttcacacctggaatcaaaaagagacttatctacatattatgaagaacgaggaggaggtggtgatactatttgcccaggtgggagacaggagtatcatgcagagtcaatctttgatgctagaactgcgagagcaggatcaggtgtgggttcgactttacaagggcgagcgggaaaacgccatatttagcgaggaacttgacacatatatcactttttccgggtatctggtgaagcacgccacagagccatag

SEQ ID NO: 5982 - DNA, 876 bp, Artificial Sequence
  Description of Artificial Sequence: Synthetic coding sequence
gtgttgtcggcttcaggcccggggagaaagatggggtcccggggtcagggcctgctgttggcctattgccttcttttagccttcgcatccggacttgtgttaagtagagtgccgcacgtacagggcgagcagcaggaatgggaggggacagaggagctaccgtccccccctgaccacgccgagcgggctgaagagcagcatgagaaataccgcccaagccaggatcagggattaccagcatcacggtgtctgagatgttgtgaccccggaacttcaatgtatccagccactgctgtgcctcagattaatatcacaatactgaaaggcgaaaaaggagacaggggggaccgtggtttgcagggaaagtatggaaaaacaggctctgccggcgcccgtggacacaccggacccaagggccaaaaaggctcgatgggggcccccggcgaaaggtgcaagagtcactatgccgctttctctgtgggccgaaagaaaccaatgcattcaaaccactattaccagaccgtcatctttgacacagaattcgtgaacctctacgaccatttcaatatgttcaccggaaagttctactgctatgtccctggtctgtattttttttcgctcaacgttcatacttggaaccaaaaggaaacatatctgcatatcatgaagaatgaagaggaggtggttatcctgtttgctcaagtgggcgacagatccataatgcagtcacagtcactgatgctggaattaagggaacaggaccaggtgtgggtgagactctataaaggtgagagagaaaacgctatattctctgaggagctcgacacgtacattaccttcagtgggtacctcgtcaaacatgcaacagagccctag

SEQ ID NO: 5983 - DNA, 1002 bp, Artificial Sequence
  Description of Artificial Sequence: Synthetic coding sequence
atggtgagtaaatcgcgttggaaacttctggctatgctggcactggtgttggtggtaatggtgtggtatagcatctcacgggaggataggtatatcgaactcttttactttcctatacctgaaaagaaggaaccctgtctccaaggggaagcagaaagcaaagcttcaaaactgtttggaaattatagccgcgaccaaccgatattcctccgtctggaggactacttctgggttaaaacacctagcgcatacgaacttccttacggaacgaagggatctgaagatctcttgctccgggtcttggccatcacttcttcgagtatccccaagaacatccagagtcttcgttgccgccgctgtgtggtggtgggaaatggacaccgccttcggaattccagcctcggcgatgctatcaataagtatgatgttgtgattcgtctgaacaatgctccggtcgccggttacgagggggacgtggggtccaagaccactatgaggttattctatccagagtcagcccattttgatcctaaggtcgagaacaatccggacactctcttagtgttggtcgctttcaaagctatggactttcattggatcgagactatactcagcgataagaaaagagttcggaaagggttttggaagcagccgcctctaatatgggatgtcaaccctaagcagatccgcatcttaaatcccttctttatggagatcgcagccgacaaactactgagcctgcccatgcagcagccccgcaaaatcaagcagaagccgacgacaggcctgcttgccataaccctcgctctccatctgtgtgacctggtgcacatcgctggctttggatatccagatgcatataacaagaagcagaccatccactactatgaacagattacactgaaatcaatggcaggaagtggacataatgtttcacaggaagccctcgctatcaagcgtatgttagaaatgggtgcgattaagaatctgacaagtttttag

SEQ ID NO: 5984 - DNA, 312 bp, Artificial Sequence
  Description of Artificial Sequence: Synthetic coding sequence
atgtcaggccgtggtaagggtggaaaggggctcgggaagggaggtgctaagcgtcaccgcaaagttctgcgcgataacatccaaggcattaccaaacctgccatccgcagactggcccgacgtggcggggtaaaaaggatttcgggactaatctatgaggaaacaaggggcgtgcttaaagtgttcttagaaaatgttattcgcgatgcagtgacgtacacagagcacgcgaagagaaaaacagtgactgccatggacgtggtctatgcccttaagcgtcagggcaggacgctttacgggttcgggggatag

SEQ ID NO: 5985 - DNA, 312 bp, Artificial Sequence
  Description of Artificial Sequence: Synthetic coding sequence
atgtctggcagaggtaaaggtgggaaaggactgggtaagggaggcgccaaaaggcacagaaaggttctcagggacaatattcaggggataacgaagcccgccatacggcgtttagctcggcgaggaggtgttaaaagaatctctgggctaatctatgaggagacaagaggcgttctcaaggtctttctggagaacgtgatacgggacgcggtgacatacactgagcatgctaagcgtaagactgttacggctatggacgtggtgtatgcactgaagagacagggccgtacactttatgggtttggaggatag

SEQ ID NO: 5986 - DNA, 312 bp, Artificial Sequence
  Description of Artificial Sequence: Synthetic coding sequence
atgtccggccgtgggaaaggaggaaaagggctgggcaaaggtggtgccaaacgccacagaaaggtactgcgggataatatccagggtatcaccaagccagcaattcgccggctggcaagacggggtggcgtgaaacggatttccggcctaatatatgaggagactagaggagtgttgaaagtgttcctggaaaacgtgattagagacgcagtgacctacacggagcacgcaaaacgaaaaacagtcacagccatggatgtggtgtatgctctgaaaagacagggtaggaccctatatgggttcgggggctag

SEQ ID NO: 5987 - DNA, 312 bp, Artificial Sequence
  Description of Artificial Sequence: Synthetic coding sequence
atgtctggcagagggaaaggcggtaagggtttggggaagggaggagccaagagacacagaaaggtgctgagagacaatattcaaggcattactaaaccagccatccggcgcctcgcccggcgcggcggagtcaaacgtatatctggactgatctacgaagagacccggggagtgctgaaagttttcctcgaaaacgtcatccgcgacgccgtaacttatactgagcacgcaaaacgcaagactgtaactgcaatggacgttgtatatgctttgaagaggcagggaaggaccctgtacggatttggcggttag

SEQ ID NO: 5988 - DNA, 2268 bp, Artificial Sequence
  Description of Artificial Sequence: Synthetic coding sequence
atgcccccctttctgctgctggaagcggtttgcgtgttcctgttctcccgggtccccccctcgttgccccttcaggaggtgcacgtgtctaaggaaacgatcgggaaaatctctgcagccagcaaaatgatgtggtgttctgcagctgtcgacatcatgttcctgctcgatgggagcaacagcgttgggaaaggaagtttcgaacggtccaagcatttcgcaattactgtctgcgatggactggacatttctcccgagagagttcgggttggggccttccagttttcatctactccgcacctagaatttcccctggactcctttagcactcagcaagaggtgaaagctcggataaagcgcatggtgttcaaggggggacggacagagactgagttagccctgaagtatctgctgcaccggggcctacccggagggaggaatgctagcgtcccacagatcctgattatcgtgacggacggaaaaagtcaaggagacgtggctcttccctccaagcagctcaaggagcgaggagtaactgtgtttgccgtgggagtacgctttccgcggtgggaggagcttcacgccctggcaagcgagcctcggggccaacatgtcctgctggccgagcaagtcgaggacgcaaccaacggactgttctccacattatcctccagcgctatctgtagctccgctactcctgactgtagagtcgaagcgcatccttgcgagcacaggaccctggaaatggtcagagaatttgcgggcaacgctccctgttggagggggtcgcgccgtaccctggcagttctcgccgcccactgccctttctactcctggaaacgggtttttcttacacaccctgccacttgttacaggacaacatgccccgggccttgtgatagccagccttgtcagaatggcggcacatgcgtgcctgagggtttggatggataccagtgcctgtgtcctctggccttcgggggggaggccaactgcgccctgaagctgagccttgaatgtagggttgatctgttattcctgcttgactctagtgctggcactaccctagacggtttcctgcgggccaaagtattcgtgaagagattcgtgcgcgccgtgctcagcgaggattcgcgcgcccgcgtcggcgtggccacttattcacgggaactcctggtcgctgtgcccgtgggcgaataccaggatgtgccagacctggtctggtccctggacggcataccctttagaggcggaccaactttaacaggttccgcattgagacaagccgcagagcgcggatttggttcagcaacaagaacagggcaggacaggcccaggcgggtagtggtattgctgaccgagtctcactccgaggacgaagttgctggtcctgctcgccatgccagagcccgtgagctcctgctgttgggggtagggtccgaagctgttcgtgcagagcttgaagagataaccggctctccgaaacacgtgatggtgtattccgaccctcaagatctgtttaaccaaatccctgaactgcagggaaaactgtgttccaggcagaggcctggctgtagaacacaggccttggatctcgtcttcatgctcgacaccagcgcctcagtggggcctgagaattttgcacagatgcagagcttcgtacgatcttgtgccctgcagttcgaggtaaatcccgatgtaacccaggtgggccttgtagtatacggatctcaagtgcagacagcattcggtttggatactaaacccacccgggcggcgatgctgcgggcgatcagccaggctccttacttaggcggcgtggggtccgccgggacagccttgttacacatctatgataaagttatgaccgttcagaggggtgcccgacctggtgtgcccaaggcagtggtggtgctaaccggcggacgcggagcagaggacgccgcggtccctgctcagaaactaaggaacaatggcatcagcgttttggtggttggagttggtccggtgctgtctgagggacttcggaggcttgccggtcccagagacagtctgatccacgttgctgcctatgctgatctgaggtaccaccaagacgtactgatagaatggctgtgcggcgaagcgaaacagcctgtgaacctgtgcaaaccatctccatgcatgaacgaaggaagttgtgtcttacagaatggaagttacaggtgcaagtgtcgggatggatgggaggggccacattgtgaaaaccgattcctgcggcgtccgtag

SEQ ID NO: 5989 - DNA, 816 bp, Artificial Sequence
  Description of Artificial Sequence: Synthetic coding sequence
atgataactggtgtcttcagtatgaggttgtggacacccgtcggcgtcctgacctctctcgcctattgtctgcaccagcgaagggtggctcttgctgaactgcaagaggcagacggacagtgcccagtcgacaggagtctgctaaagctcaaaatggtgcaggtcgtcttccgacatggggcacggtcgcctctgaagccactcccgctcgaggagcaggttgagtggaatcctcagctattggaggtgcctccacagactcagttcgactatacagtgacgaatctggctggtggcccaaagccatatagtccttacgactctcagtaccacgagacgaccctgaaaggcgggatgttcgcaggccaacttacgaaggtcggcatgcagcaaatgtttgctttgggtgagcgcctaaggaagaactatgtcgaggacatcccatttctttccccaactttcaacccacaagaggtgtttatccgctcaaccaacatttttcgaaaccttgaaagtactagatgtctccttgccggcctcttccagtgccagaaggagggtcccatcattattcacactgatgaggcagacagcgaagtcctctaccctaactaccaatcttgttggtcactgcgtcagcggactaggggcaggaggcagacagcttccctgcagccaggcattagcgaagatctaaagaaagttaaggaccgaatgggtatcgactctagcgacaaagtggatttttttattctgctggacaacgttgctgcagagcaggaaaaaatgggatcttgcaggttccacgggtcttag

SEQ ID NO: 5990 - DNA, 1395 bp, Artificial Sequence
  Description of Artificial Sequence: Synthetic coding sequence
atggagcattccgtctgtccatccagcgcagtgcatctgatccctgtgtcaactccgaaaaacggcatgagttccaagagcaggaagcggattatgcctgatccggtgactgagcccccagtgacagacccagtgtacgaggctctcctgtattgtaatatcccttcagtggcagaaaggtctatggagggccatgcacctcatcattttaagcttgttagcgtacatgtattcatccgccacggggatagataccccttatacgtgattccaaagaccaagcgaccggagatcgactgtaccttggtggcgaaccggaaaccctaccaccccaaactggaagccttcatatctcacatgagcaagggcagcggcgccagcttcgaaagtccgctcaatagcctcccactgtaccctaatcatccactgtgcgaaatgggggagctgactcagaccggagtggtgcagcacctccaaaatggccagctcctaagagatatttatcttaaaaagcacaagttactgcctaacgactggtcggctgatcagctctaccttgaaacaacaggcaagtccagaaccctgcagagtgggttagctctgctttatggattccttcccgatttcgattggaaaaagatttactttagacaccagcctagcgctctgttttgctctggctcatgttactgccctgtgcgcaatcagtatctagagaaagagcagcggagacagtatctgttacggttgaaaaactcgcagttagaaaaaacatacggggaaatggctaagattgttgatgtaccaacaaagcagcttagagctgccaacccaatcgactctatgttgtgtcatttctgtcataacgtgtcctttccatgtacaagaaacgggtgtgtggatatggagcacttcaaggtgatcaagacccatcaaatcgaggacgagagagagcgacgagagaaaaaactatactttgggtactccttgttgggagcccaccctattctgaaccagactattggccgcatgcaaagggctaccgagggccgcaaagaggaactttttgctctgtattctgctcatgatgtgactctctctcccgtcctgagtgcacttggcttgtctgaggcccgctttccccgcttcgctgctagattgatcttcgagctctggcaggatcgagaaaaacccagtgagcattcagtcagaatcctgtacaatggggtcgacgttacgttccacacctctttttgtcaggaccaccataagcgctcacctaagcctatgtgtcctctcgaaaaccttgtgcggtttgtcaagagggacatgttcgttgccctaggtgggtctggcaccaactactatgacgcctgtcaccgtgaggggttctag

SEQ ID NO: 5991 - DNA, 1443 bp, Artificial Sequence
  Description of Artificial Sequence: Synthetic coding sequence
atgctcttccgaaatcgattcctgttgttactggctctggctgctctgttggcctttgtgtccttaagccttcagttcttccatctaattcccgtaagcacgcccaaaaacggcatgagctccaagagtcggaagcggataatgcccgatccagtgactgagccacccgtgaccgatcccgtgtatgaggctctgctgtactgtaacattccaagcgttgcagaacgtagcatggaagggcacgcgccacatcatttcaagctggtgagcgtccatgtattcatcagacacggggatcggtaccctctctacgtaatccccaagactaaaagaccagagattgattgcactctagtcgctaaccgaaagccctaccatccaaagcttgaagcattcattagccacatgagcaagggttcgggcgcgtcttttgaatctcccttgaactcactcccactctatcctaatcaccccttgtgcgagatgggcgagttaactcagaccggcgtggttcagcaccttcagaacggccagctgctgagggatatctatctgaaaaagcacaagctcctgccaaatgactggtcagctgaccaactgtacttagagacaacagggaaatcacgtaccctgcagtctggactcgccctcctctatggcttcctcccagactttgactggaaaaaaatttatttcagacaccagccatcagctcttttctgtagcggatcttgttactgccctgttcggaaccagtacctcgaaaaggaacagcgccggcagtatttattacgcttgaaaaacagtcaactggaaaaaacgtacggggaaatggcaaagatcgtcgacgtgccaaccaagcagttaagggctgccaatcctatagactcaatgctctgtcacttttgccataacgtatcctttccttgcactagaaatgggtgcgtcgacatggagcattttaaggtcattaagacccatcaaatagaagacgagcgcgagaggagagagaagaaactgtactttgggtactcactcttaggtgcacacccaattctaaaccaaacaataggcagaatgcagagggcgaccgaagggcggaaagaggagctgtttgcattgtacagtgcccacgatgtaaccctttccccagtgctttccgctctgggactatcggaggcacgattccctcggtttgctgctcggctcatttttgaattgtggcaggacagagaaaagcccagcgagcatagcgtccggattctatacaatggcgtggacgtgacttttcacacctccttctgccaagatcaccataagcgctcgcctaagcccatgtgcccgctcgagaacttggtgagattcgtcaagagagatatgtttgtggcacttggcgggtccggtacaaactactacgacgcttgccaccgtgaaggattttag

SEQ ID NO: 5992 - DNA, 1311 bp, Artificial Sequence
  Description of Artificial Sequence: Synthetic coding sequence
atgcaggggacccctggcgggggcactcggccagggccgtcccctgtagacagacgaaccctcctggtcttctcattcattctcgccgccgctctcggacaaatgaatttcactggagaccaggtccttagagtgttggctaaggacgaaaagcaattatctctgctcggggatctggaaggcctcaagcctcagaaagtggacttctggcgcggtccagctcggcccagcctccctgtagatatgcgcgtgcctttttccgagctgaaggacattaaagcttatctcgaatcgcacggactggcctacagtataatgattaaagacattcaggttctgttggacgaggaaaggcaggcaatggcaaagagtcgcagattagagaggagtactaattctttttcatatagctcctatcatactctggaggagatttatagctggattgacaatttcgtcatggagcactctgatattgtgagcaaaatccagatcggaaacagtttcgaaaatcaatcgatcctggtgctaaaattctccacaggtggttctcggcatccagccatctggatcgatacgggcatccactctagagagtggataactcatgccactggcatctggaccgctaacaagatagtctcggactatggcaaggatagagtgctaacagacatactgaatgctatggatatcttcatcgagctggtaactaaccccgacggattcgctttcacccacagcatgaatcgtttgtggcgcaagaacaaaagcatccggcccggaatattctgcatcggagtagatcttaatcgcaactggaagtccggtttcggaggcaatgggagcaactcaaatccatgcagtgagacataccacggtccctcccctcagagcgaacctgaagtagccgcaattgtcaattttatcacagcacacggcaactttaaagccttgatttctattcacagctactctcagatgctgatgtatccttacggacgcctcttggaacctgtgtctaaccagagggaactctacgatctggctaaagacgccgtcgaggctctgtataaggtgcacgggatcgaatacatttttggcagcatctcaactacactctacgtggcctcaggaattaccgtggactgggcttacgatagtggaatcaagtacgcattcagtttcgagctgcgtgacaccggtcagtacggatttctgcttcccgctacacagataattcccacggcgcaggagacctggatggctctgagaactattatggaacatacactgaatcacccatactag

SEQ ID NO: 5993 - DNA, 1161 bp, Artificial Sequence
  Description of Artificial Sequence: Synthetic coding sequence
atggcccagtggcactgctcccagagaacacaggcagggggtcacggggtgggcgagagattagcccagtgtcaagaccagagcagtcggcatgcagccgaactgagggatttcaagaataaaatgttaccccttcttgaggtggcagagaaagaacgcgaagcattgcggacagaagccgatactatcagtggtcgggtcgataggctggagcgcgaggtcgattatctagagacccagaaccccgcactcccttgcgtggaatttgatgagaaggtaaccggaggccctggcacaaaaggaaaaggaagacgcaacgagaagtatgacatggtcacggattgcgggtatactattagccaggtccgcagcatgaagatcctcaaaagattcgggggtcccgctgggttatggactaaagatccattgggccagacagaaaagatctacgtgctggacgggactcaaaatgataccgcgttcgttttccctaggttgagagacttcactttggcaatggcagctaggaaagcatcacgggtgagagtgccttttccatgggtcggcactggacagctggtgtatggcggtttcttgtactttgcccggcggcccccaggacgtcctggcggcggcggtgaaatggaaaacactctccagctgatcaaattccacctggcaaataggaccgtggttgattccagtgtgttccccgctgagggtctcattcctccctatggcttaaccgcagacacatacattgatttagctgctgatgaggagggtctgtgggcagtatacgctaccagggaagacgaccggcacctgtgcctggccaagctcgatcctcaaaccttggatacggaacagcagtgggacaccccgtgcccacgcgagaacgcggaagcagctttcgtcatttgtgggaccttatacgttgtatacaatacaagacccgcctctagagcccgcatccagtgttcatttgacgcaagcggaactctaacccctgaaagagccgccctcccttacttcccccgcagatatggggcccatgcttcgctccggtacaacccccgggaacggcagctctacgcatgggacgatggataccagattgtgtacaagctcgaaatgcgaaagaaagaggaagaagtctag

SEQ ID NO: 5994 - DNA, 990 bp, Artificial Sequence
  Description of Artificial Sequence: Synthetic coding sequence
atgcgtccccccccggccctggcattagctggtctgtgtcttctggccctgccagcagctgctgcttcgtacttcggtctcaccggcagagaagtgctgaccccattcccaggcctgggaactgccgcagccccagctcaaggcggggcccatctcaagcagtgtgatcttttgaaactgtcccgccggcagaaacagctctgtcgacgggagccaggtctggctgagacattaagagacgctgcgcacctgggcctgctggagtgtcaatttcagttcaggcacgaaaggtggaattgtagtctggagggcagaatgggcctgctaaagcggggcttcaaggagaccgccttcctgtatgctgtctcctccgccgccctcacccacactctcgcaagggcatgctcagcaggtaggatggagaggtgcacctgtgacgattcgccaggcctggaatcccggcaggcttggcaatggggcgtgtgcggcgacaacttgaagtattctaccaagttcctgagtaactttcttggaagtaagcgaggaaacaaagacctgagagcgagggccgacgcacacaatactcacgtgggcatcaaagccgtgaaatctgggcttagaaccacgtgcaagtgtcatggcgtgagcggctcctgtgccgtgaggacttgttggaagcagttgtccccattcagggagaccgggcaagtcctgaaactccgctatgacagcgcagtcaaggtctcctcagcaacaaacgaggccctggggcggcttgaactgtgggcaccggcgcggcagggcagtctgaccaaaggactagctccccgtagcggagacctagtctacatggaggacagtccgtctttctgtagaccctcgaaatatagccccggtacagcagggtggtccgccgtggctcggagccagctgatcaccaccagtacgagtcgcattcaagccattctgccgagccagctgcccgagtag

SEQ ID NO: 5995 - DNA, 579 bp, Artificial Sequence
  Description of Artificial Sequence: Synthetic coding sequence
atgaggctggccggtcccgagtcctccgtgacggcagctcccagggcacggaagtacaagtgcgggctgccacagccatgcccggaagagcacttagcctttagggttgtgtctggggcggcaaacgttattggccctaaaatatgcctcgaggataaaatgctcatgtctagtgttaaggacaatgtgggacggggactcaatatcgcgctggtcaacggtgtttctggggaattgatcgaggcccgggcattcgatatgtgggcgggcgatgtgaatgatcttctgaaatttatccggccactccatgaagggactctggtgttcgtagcctcctatgatgatccagctactaaaatgaatgaggaaactcgaaaactgtttagcgaacttggctctcggaacgccaaagaactcgcctttcgggacagctgggtgttcgttggagcaaaaggtgtccagaacaagtccccatttgaacaacacgtaaaaaatagcaaacactccaataagtatgaggggtggccagaggcccttgaaatggaggggtgtatcccacggcgaagcacagcctcatag

SEQ ID NO: 5996 - DNA, 1053 bp, Artificial Sequence
  Description of Artificial Sequence: Synthetic coding sequence
atgaagtgttccctgcgggtatggtttcttagtgtcgcatttcttcttgtcttcattatgtccctgctgttcacgtactcacaccactcaatggcgacccttccctatctagactctggtgctctggacgggacacatcgggtgaagctggtgcctgggtacgccggactccaacggctgagtaaagagagactctccggcaagagttgcgcctgccgccgttgcatgggtgacgccggcgcctcggattggttcgattcacattttgatgggaacatcagtcctgtctggacccgggaaaatatggacctgccccccgatgtgcagagatggtggatgatgcttcagcctcagtttaaaagccataataccaatgaagttctggagaagctgtttcaaattgtcccaggtgaaaatccttaccggttccgggatccccaccagtgccggcgctgtgccgtcgttggtaactcaggtaatctcaggggatcaggatacggacaagacgttgacggacacaattttataatgagaatgaaccaagcccctactgtgggttttgaacaggacgtgggtagtaggactacacatcatttcatgtaccctgaaagcgccaagaacctccctgccaacgtcagtttcgtactggtgcccttcaaggtccttgacctcttatggatcgcatccgccctgagcacagggcagataagatttacttacgccccagtgaagtctttcctgcgcgttgataaagagaaagtgcagatttacaatcccgcgttctttaaatacatccatgacagatggaccgaacaccatgggcgctacccttctaccgggatgctggttctcttcttcgcactgcacgtgtgtgacgaggtcaatgtctacggtttcggtgcagacagtagaggcaactggcatcattattgggagaataaccgatatgccggagagtttaggaagacaggcgtacacgatgccgacttcgaggcccacattattgatatgctcgccaaagcgtctaaaatagaggtgtatagaggaaattag

SEQ ID NO: 5997 - DNA, 189 bp, Artificial Sequence
  Description of Artificial Sequence: Synthetic coding sequence
atgaagattcagctttttttcttcatactgcacttctgggtgactatcctgccagctcgtagcaattttgagcccaaatatcggttcgagcgttgtgaaaaggttcgcggcatctgcaaaacattctgtgatgatgtagaatacgactacggctattgtatcaagtggaggagccagtgttgcgtgtag

SEQ ID NO: 5998 - DNA, 738 bp, Artificial Sequence
  Description of Artificial Sequence: Synthetic coding sequence
atgacgctattccccgtattactcttcctcgtagccgggttgctgccatctttccccgccaatgaagacaaagaccctgctttcacagcactactgactacccagactcaggtccagcgcgagatagttaacaagcataacgagctgcgtagggctgtcagcccacccgcaaggaacatgcttaagatggaatggaacaaagaagccgctgctaatgcccagaaatgggcaaaccagtgcaactataggcattcaaatcccaaagataggatgacgagtctgaaatgcggcgaaaatttgtatatgtcctcagcaagctcctcctggtcccaggccatccagtcatggttcgacgaatacaacgattttgatttcggtgtcggacccaagactcctaatgctgtggtgggccactatacccaggtagtctggtattcgagctatttagtggggtgtggcaatgcctactgtcccaatcaaaaagtgctgaaatactactacgtgtgccagtattgccccgcggggaactgggcaaatcggttgtatgtcccttatgagcagggagccccatgcgcaagttgcccggacaactgtgatgatggcctgtgtacaaatggatgcaaatatgaggacctctatagcaattgcaagtccctgaagctgaccctgacatgtaagcatcagctggttcgagactcctgtaaggcatcctgcaactgcagcaatagcatctactag

SEQ ID NO: 5999 - DNA, 1341 bp, Artificial Sequence
  Description of Artificial Sequence: Synthetic coding sequence
atgctgcatccagaaacttcacccgggagggggcacttgctcgccgtcttactcgccctgctggggacggcgtgggctgaagtgtggcccccccagctccaggagcaggccccgatggcaggcgctctcaaccgcaaggagagtttcctccttctgtctctacataacagattgcgctcatgggttcagccgcccgctgcagacatgagacgccttgactggagcgattcattagctcagctggcccaggcccgagccgcgctgtgtgggacccccacccctagtctggcatctggattatggcgcacattacaggttggctggaatatgcagctgctgcctgctggtctggtgagttttgtggaagttgttagcctctggttcgccgagggacagcgttacagccatgctgccggggaatgtgcaagaaatgctacttgcacacattatactcagctggtctgggctaccagctctcagctcggatgtggccgccacctgtgtagtgctggccaagctgcaatcgaagcatttgtctgtgcctattccccaagaggcaactgggaggtgaatgggaaaaccattgtgccctataagaagggcgcgtggtgctcgttgtgtacagccagcgtaagtggctgtttcaaggcttgggatcacgcgggcggcctgtgtgaggtgccaaggaatccttgtcggatgtcttgtcaaaatcatggaaggttgaacatttcaacttgccactgtcattgccccccaggctataccggtcgctactgccaagtgcggtgttccctacagtgcgttcatggtagattccgagaagaagagtgctcttgcgtatgcgacatcggctacgggggcgcccagtgcgcaacaaaagtgcacttcccattccacacatgcgatctgcgcattgatggggattgcttcatggtgtcctcggaagctgacacttactacagggcacggatgaagtgtcagaggaagggcggggtcctagctcagatcaagtctcagaaggtccaggacatccttgccttttatctgggtagactcgagacgacaaatgaggtgattgattccgatttcgagactaggaacttctggattggtctgacttataagactgccaaggacagttttcggtgggccactggggaacaccaggctttcacatccttcgcttttggtcaaccagataaccatggatttggcaactgtgtggagctgcaggcgtcagctgccttcaactggaatgatcagagatgcaagacacgtaataggtatatctgccaatttgcacaggagcatatatctcgctggggccccggtagctag

SEQ ID NO: 6000 - DNA, 585 bp, Artificial Sequence
  Description of Artificial Sequence: Synthetic coding sequence
atgacaatgaggcacaattggactcctgatttgagtccgctttgggtgctcctcctgtgcgcccacgtcgtcacactgctggtgagagccacaccagtctcccaaacaaccactgccgccaccgctagtgtcagatctaccaaagacccatgcccatctcagccacctgtgttcccggccgccaagcaatgcccagcactggaggtcacatggcccgaagtagaagtgccacttaacggcacactctcgcttagctgtgtggcctgtagcagatttcctaatttcagcatactttactggctcgggaatggatctttcatcgaacatctgccaggacgcctgtgggagggatcaacgagcagggaacgtggttcgaccggcacacagctgtgcaaggctctggttctggaacaactgactccggccttgcatagcactaacttttcatgtgtgttggtggatcctgagcaggtggtgcagaggcatgtggtgttagcacaactctgggctgggctgagggccaccttaccccctacacaggaggccttaccttcgtctcactcctccccgcagcaacaaggatag

SEQ ID NO: 6001 - DNA, 585 bp, Artificial Sequence
  Description of Artificial Sequence: Synthetic coding sequence
atgaccatgcgccacaattggacgcccgacctgagcccactttgggtccttcttctgtgtgcccacgtcgttaccctgctggttagagccacacctgtaagtcagactaccacagcggccacagccagcgtccggagtaccaaagatccctgcccttcccagccccctgtgtttccagccgcgaaacagtgtcctgcgctagaggtgacctggcccgaagtagaggtcccacttaacggaactctaagcctgtcatgtgttgcctgcagccggttcccgaattttagtattctttattggctgggtaacggcagctttatcgagcaccttcccgggcgactttgggagggatccacgagccgggagaggggctctactggcacacaactgtgtaaggctctggttctggagcaactgactccggctctccatagcacaaatttctcatgtgtgttagtcgacccggagcaggtggtccaacgacatgtcgtgttggcccaactgtgggcaggtctaagagcaacgttgccccctactcaggaagcattgccctcatcccattctagtccccagcaacagggatag

SEQ ID NO: 6002 - DNA, 348 bp, Artificial Sequence
  Description of Artificial Sequence: Synthetic coding sequence
atgactatgcgccataactggacaccagatttgagtccattgtgggtgctgctgttatgcgcgcacgtcgtgaccctgctcgtgagagctacaccggtcagtcaaacaaccaccgcagctactgccagcgtacggagtactaaagacccatgtccttcccagccccccgttttccctgcggctaaacagtgtcccgctctggaagtgacctggcccgaggtggaggtgccactgtcctgggccgaaggtaacctggcgcctcaccccaggtctcccgccctgcagccgcaacagagcacggccgcagggctaagactctcaaccggccctgccgcagcccaaccctag

SEQ ID NO: 6003 - DNA, 528 bp, Artificial Sequence
  Description of Artificial Sequence: Synthetic coding sequence
atgctacctccaatggcactgccatccgttagctggatgttactgagctgtctcatgctgctgtcccaagtccaaggagaagagcctcagagggaactgccaagcgctagaatcagatgtccaaaaggatcaaaagcatatggcagccactgttacgccctgtttctttcaccaaagtcctggaccgacgccgaccttgcatgccagaagagaccgtccgggaatcttgtgtccgtgctgagcggggccgaggggagcttcgtgtcctcactggtgaagtccattggtaattcttacagttatgtctggattgggctacacgaccctacgcagggtactgaacccaacggggaaggctgggagtggagttctagcgatgtgatgaactacttcgcttgggagaggaacccgtcaacaatcagttctcctggtcactgcgcctccctgtctcggtcaactgcatttttgcgctggaaggactataactgtaatgtgagactcccctatgtgtgtaaattcacagattag

SEQ ID NO: 6004 - DNA, 993 bp, Artificial Sequence
  Description of Artificial Sequence: Synthetic coding sequence
atggggaagctctgtctgggaccaaccctctgtcctgccgccgccgctgaggagtctcgagatgcagaacctaggagggagctcctctgttctggtagaccttggacatggagggccgcagctagagtgaccacaatgatcccatgggtcctgctggcctgtgcactgccttgcgcagctgatcctctgctcggagcattcgcccgccgagactttaggaaagggtcccctcaactggtgtgctccctgcccggccctcagggcccaccgggtcctcccggggccccgggcccgtcgggcatgatggggcgaatgggattcccagggaaagatggtcaagacggacatgatggagaccgcggagactcaggtgaggaagggcccccagggcggactggtaataggggaaagcctgggcctaagggcaaagccggtgctatcgggcgagccgggcctagggggcccaagggcgtgaacggcacgccagggaagcatgggacccctgggaaaaagggaccaaaggggaaaaagggagaacctgggctccccggaccatgtagctgtggcagcggacacacgaagtccgcattcagtgtggccgtcacaaagtcatatcccagagagcggctccccatcaagttcgacaagatcctcatgaacgaaggcggacactataacgcaagcagcgggaagtttgtgtgtggcgtgccgggcatttactatttcacgtatgacattacattggcaaataaacacttagccatcggtctagtgcacaacgggcagtacaggattaggacattcgatgcgaacactggcaatcatgacgtcgctagtgggagcaccatacttgcgctcaagcagggtgatgaagtttggctacagatcttttatagcgagcagaacggtctcttttacgatccttactggacggacagcttgtttacaggctttctgatatatgccgatcaagacgatcccaatgaggtgtag

SEQ ID NO: 6005 - DNA, 390 bp, Artificial Sequence
  Description of Artificial Sequence: Synthetic coding sequence
atgaggctgcttcttctagttccattactgttggcaccagccccaggaagcagcgctccaaaggtccgtcgtcagtcggatacctgggggccgtggagccaatggtccccctgctcccgcacttgcggtggtggtgtctcctttcgtgagcgaccttgctattctcaaagaagagatggggggtcttcctgcgtggggcccgcaaggtctcatcgttcttgtaggacagaatcatgcccagatggtgctagggacttcagagctgaacagtgcgcagaattcgacggcgcagagttccaagggcgcaggtatagatggctcccttattactcagccccgaataagtgtgaattgaactgcatccctaaaggcctcgggctccagggctag

SEQ ID NO: 6006 - DNA, 1227 bp, Artificial Sequence
  Description of Artificial Sequence: Synthetic coding sequence
atgttcagtaacgcaaacagccggagcaagatgtggctgttgcttactatggcaagcctaatctctgttctcgggaccacacatggactctttggcaaactgcatcccgggagccccgaagtgaccatgaatattagccagatgatcacttactggggttaccctaatgaggaatatgaagtggttaccgaggatggatacattcttgaagttaataggatcccgtacggaaagaagaattccggcaataccgggcaaaggcccgtggtgtttctgcagcatgggctgctagcttcagctaccaattggatctccaacctgcctaacaactccctcgccttcatactggccgacgcaggatatgatgtctggctggggaactctagggggaacacatgggctagaaggaacctgtattatagccctgactccgtcgaattctgggccttctcatttgatgaaatggccaagtatgacttgccggcaactatcgattttatcgtaaagaaaactggacagaagcagctgcattacgtggggcacagccagggcaccaccataggctttattgccttcagtaccaacccgagcttggctaaacgaattaagaccttctatgctttagcacccgtggctaccgtgaaatatacaaagtctctgattaataaactcagattcgtgccccagtcactgtttaagtttatcttcggggataagatcttttatccccacaactttttcgatcagttcttagcgaccgaggtatgtagtagagaaatgctgaacctgctgtgttccaatgccctgtttataatatgtggctttgactccaagaacttcaatacgtcaaggcttgacgtttatctctcccacaatcctgctggcactagcgtgcaaaacatgtttcactggacgcaggctgttaaatctggtaagtttcaggcatacgattgggggtctcctgtgcaaaataggatgcattacgaccagagtcaaccaccatactacaacgtgacagcaatgaatgtgccaatcgcagtatggaacggcggtaaggatctcctggctgacccacaggacgttgggcttctgctgccgaaactgcccaacctcatataccacaaggagattccattctataaccacctcgacttcatctgggcgatggatgcgccacaggaggtctataacgatatcgtgtctatgatcagcgaggataaaaaatag

SEQ ID NO: 6007 - DNA, 393 bp, Artificial Sequence
  Description of Artificial Sequence: Synthetic coding sequence
atggcctcagatctgatacgcactatcctagcagtagctcttatatcgaaactgggcactgcagtggacgctgaattgatgcccagcggagccatactacaaaacaaaagggagaacctaccacgcgtttgccacgcactcgcctttctgggcatggctagatgccaggatttgttcctggtccgcctacagggctggaaactgggcacaagatttcaggatggaccccgcagcacccctcaggaggagggggggtccccccaacggaaaaggggtatgcccgtgcaaattcactttctgctgaagtctttcctgtcttcccctatcacgttcgcctttatatcgcttgcgcgcacagtctctctggctacagcgatctgcaagattgtttag

SEQ ID NO: 6008 - DNA, 393 bp, Artificial Sequence
  Description of Artificial Sequence: Synthetic coding sequence
atggccagcgacctcatccgcactattctggccgttgctctgatcagtaagctggggactgccgtcgacgcagagctgatgcccagcggagccatcctgcagaacaagcgtgagaatttgccaagagtctgtcatgccttagccttcttggggatggcccgctgtcaggatcttttcctggtcagactccagggctggaagctgggcacaagattccaggacggcccccggtccactccccaggaagaaggtgggtccccccaaaggaagagaggaatgcccgtgcaaattcactttctcctgaagagcttccttagttctcccataaccttcgcctttatttctttggctagaacagtgtccctggcaaccgcaatctgtaagatcgtgtag

SEQ ID NO: 6009 - DNA, 1731 bp, Artificial Sequence
  Description of Artificial Sequence: Synthetic coding sequence
atgatagttttcggatgggctgttttcctggcctcgcggagtctcggccaggggttgcttctgactctcgaggagcacatcgcccatttcctcggaactggtggagctgcgaccacaatgggaaactcttgcatctgtcgagatgactccggtacagacgacagtgttgacacacagcagcagcaagctgaaaactccgccgtccccacagcagatactcgatcacagcctagggatcccgtgcgccctcctagacgggggcgtggaccccatgagcctcgaaggaagaagcagaatgtggatggactagttttggataccttggctgtcattcgaaccctggttgacaatgaccaggaacctccttactctatgatcactcttcatgaaatggcggagacagatgaaggatggttagatgtggtccagagcctaatccgggtgataccactcgaagacccgctgggaccagccgtgattaccctgttgctggacgagtgcccactgcccacgaaggacgcactgcaaaagttaactgaaattctcaatcttaatggcgaagtggcttgtcaggacagcagtcacccggctaaacacaggaacacaagtgctgtccttggttgcctcgctgagaaattagccggacctgcctcaatcggactcctttcgcctggaattctcgaatatttgctacagtgcctcaagcttcaatcccacccaacagtcatgctgtttgcactgatcgcgctcgagaagtttgcgcagacatccgagaataaattgacaatctctgaaagctccatctccgatcgactggtaacactcgaaagctgggcgaatgatccagactaccttaagcggcaggtgggtttctgcgcccaatggtctctcgacaacttgtttctcaaggaggggcggcaactcacctacgaaaaagtaaacctttcatccatccgggccatgctgaatagcaatgatgttagtgaatatctcaagataagcccgcacggcttggaagctcggtgcgacgccagctcatttgagagcgtacgctgtacattctgcgttgacgccggggtctggtactacgaggttactgtggtgacctcaggcgtgatgcagattggttgggcgaccagggattccaaattcctaaatcacgagggatatggcataggggacgacgagtattcatgcgcatacgacggatgcagacagctaatatggtacaacgcaagatccaaacctcatattcacccttgctggaaagaaggcgatacggtcggattcctgctagacctgaatgaaaaacagatgattttttttctcaatgggaaccagctgcctccagaaaaacaggtgttctccagcactgtcagcggttttttcgctgctgcctcatttatgtcataccagcagtgtgaatttaattttggcgcaaagccgttcaagtaccctccaagtatgaagttctctactttcaacgattacgcttttctcactgccgaagagaagattatcctgccgcggcatagacggctggcactcctgaagcaggtcagtatacgggagaattgctgctcattgtgttgcgatgaggtggctgatacgcagctgaagccatgcggccattccgatttgtgcatggattgtgcgcttcaactggagacctgtccgctatgtcggaaagagattgttagcagaattagacagatcagtcacatctcatag

SEQ ID NO: 6010 - DNA, 360 bp, Artificial Sequence
  Description of Artificial Sequence: Synthetic coding sequence
atggcacggcctgggatggaacgctggagagatcgtctcgctctggtaacaggggcaagcgggggcatcggtgcagccgtcgctcgggcccttgtccagcaagggctgaaagtggttggctgtgcaagaacagtgggcaatattgaggagctggctgccgaatgcaagagtgcaggctatcccggaactctcattccgtataggtgcgatctgtccaacgaggaggatatattgagcatgtttagcgcaataagatcccagcattcaggcgtcgatatttgcattaataatgccggacttgccagaccggatacgctgctaagtggatcaacatccggctggaaggatatgtttaattag

SEQ ID NO: 6011 - DNA, 144 bp, Artificial Sequence
  Description of Artificial Sequence: Synthetic coding sequence
atgcaggtctcaactgccgcattggccgtgttactatgtacgatggccctttgtaaccaggtcctttccgccccacaggccggccggtcagttctcacccccgtgcgcagtggttcacgcaacacgagtgttacttggagctag

SEQ ID NO: 6012 - DNA, 159 bp, Artificial Sequence
  Description of Artificial Sequence: Synthetic coding sequence
atgcaggtgtctacagctgccttagctgtcctgctgtgtaccatggccctgtgtaaccaggtactctccgctccactgtcacggccgagggaagcaggacgttctgtactcacacccgtgaggagtgggtccaggaatactagcgtgacctggtcttag

SEQ ID NO: 6013 - DNA, 1272 bp, Artificial Sequence
  Description of Artificial Sequence: Synthetic coding sequence
atggaactcgagctgatgccatttaacgtgcttcttcgtaccacattggatctactgcaggagaaggatcccgctcatatctttgcagagccggtgaatttgtccgaggtgccagattacctcgagtttatttctaagcctatggacttctctacaatgaggcgaaagctggagtcccacctgtaccgcacgctcgaagaatttgaggaagattttaacctcattgtaaccaattgtatgaagtacaatgctaaagatacaatctttcacagggcagccgtgcggcttagagacctcggcggggctattttgcggcacgccaggcggcaggcggagaatataggatatgatcctgaacgcggtacccacctgccagaatcacctaaactcgaggacttctaccggttttcctgggaggatgtcgacaacattctcataccagaaaatagggcacacctgtcccctgaagtgcagctgaaagagctcctagagaaactggacctggtatctgccatgcggagctcaggggctcgaacaaggcgggtgagacttctgcggcgggagattaatgccctgcgacagaagctagcacagcccccccccccgcagccaccgagccttaataaaaccgttagcaacggcgagttaccagctggaccacagggcgatgctgcagtcctggaacaggcactacaagaggagccagaagatgacggcgaccgtgatgattctaaactgccacccccccctaccctcgaaccaaccggacccgccccgtccctgtccgagcaagaaagtccaccggagccacctaccctgaagccaatcaatgactctaaaccgccatctcgcttcctgaaaccccggaaagtggaggaggacgagctgctagaaaagagcccactgcagctggggaatgagccactgcagaggctcctgtctgataacggtatcaatcgcctttcccttatggctccggacacacccgccggtactcctctgtccggggtcgggcggcggacctcggtgttatttaaaaaagccaagaatggggttaagctgcagaggagtcctgatcgggtgcttgagaacggcgaagaccatggggtcgccggttcccccgcaagcccagccagtatcgaggaagaaagacactctcgcaaaagaccgaggtctcggtcgtgctcagagagcgagggcgaaagaagcccccagcaagaggaagagacgggcatgactaatggatttggaaagcaccgcaagcgagtatag

SEQ ID NO: 6014 - DNA, 3030 bp, Artificial Sequence
  Description of Artificial Sequence: Synthetic coding sequence
atgggttcagggcgggtacctggactctgccttctggtcttgcttgtccatgcaagggcagctcaatatagtaaagccgcccaggacgtggatgagtgcgtagaagggacagacaattgtcacatagacgccatttgtcagaataccccccggtcatacaagtgtatctgtaaaagcggatatactggcgacgggaagcactgtaaggacgtcgacgaatgtgaaagagaggataatgctgggtgtgtgcatgactgcgtgaacataccgggcaattatcgctgcacctgctatgacggcttccatctggcacatgacggacataactgtcttgatgtggacgaatgtgcggagggcaacggtggctgtcaacagtcatgtgtgaacatgatgggctcttatgagtgtcactgccgcgaggggttcttcctttccgataaccaacatacatgtatccagcgccccgaggaggggatgaattgcatgaacaaaaatcatgggtgcgcccatatctgcagagagacacccaagggtggaattgcttgtgagtgtaggccaggattcgaacttacaaagaatcagcgcgactgcaaactgacatgtaattatgggaacggcggttgtcagcacacttgtgatgacactgaacagggcccccgttgcgggtgtcacattaagttcgtgctgcatacagatggcaaaacctgcatcggagaacggcgcttagagcagcacatcccaacgcaggcagtgagcaacgaaacgtgtgccgtgaacaacggcggttgtgatagcaagtgccacgacgcggccaccggtgtgcattgtacgtgtcccgtggggtttatgctccagccagatcggaagacatgcaaggacatagacgagtgtaggctcaacaacggcggttgcgatcatatttgccgtaataccgtaggcagtttcgaatgcagctgtaagaaggggtataagctcctcattaacgaaaggaattgccaggacatcgatgaatgctcttttgacaggacatgtgatcatatttgcgtgaatacacccgggagtttccagtgtctgtgccaccggggatatctactgtacggcatcacgcactgcggtgacgtggacgaatgtagcataaaccggggaggctgtagattcggctgtatcaacactccaggcagctatcagtgcacctgcccagctgggcaggggcgtctgcactggaatgggaaagactgcacagaacctctaaaatgccaagggagcccaggcgcctctaaagctatgctttcatgtaatagatctggcaagaaggacacatgcgcactgacttgtccttcccgagctagattcctgcctgagtccgaaaacgggttcactgtttcctgtgggaccccttccccacgggctgcccccgcgcgggctgggcacaacggcaattccaccaatagcaaccattgtcacgaagctgcagtgttatccattaaacaacgcgcatccttcaaaattaaagacgccaagtgccggctgcacctaagaaacaaaggaaagacggaggaggcaggtaggatcactggcccgggcggcgccccttgcagcgagtgccaggtgacattcattcacctgaagtgcgactcaagccggaaagggaaagggcgccgagcccgcacaccccccgggaaggaagtgactcgtctgactctcgaattagaggcggaggtacgggccgaagagacaactgcatcttgtggtctcccgtgcctacggcaacggatggagcggcgcctgaaggggagtctcaaaatgctgagaaagtcgatcaatcaggatcgctttctcctcaggctcgcaggtctggactatgagctggcacataagcctgggttggtggctggcgaaagagctgaacctatggagagctgtaggcccgggcagcatcgggccgggacaaaatgcgtaagctgtccgcagggtacctactatcacggacagaccgaacagtgtgtaccgtgtcccgcggggacgttccaggagcgcgaagggcagctgagctgtgacctatgccccggctctgacgctcatggccctctgggtgccacaaacgtcacaacgtgcgctggccagtgtccaccaggacagcattctgtagatggcttcaagccttgtcagccctgccctcgcgggacatatcaacctgaagccgggaggaccctgtgctttccatgtggaggaggactcaccacaaagcatgaaggcgcaatcagttttcaggattgtgacacaaaagtccaatgctctccgggccactattataatacttcaatccatcgatgtattaggtgcgccatgggaagttatcaaccagacttccggcagaatttctgctcccgctgtcccggcaacacttccacggactttgacggtagcactagcgtcgcccagtgtaagaacaggcagtgtggtggggagcttggtgaatttacaggctatattgaaagcccaaattaccctggcaactatcccgctggcgtggagtgcatctggaatatcaacccaccccccaagcgcaaaatactgattgtggtgcccgaaattttcttgccatccgaggacgaatgtggcgatgtccttgtgatgcggaaaaactcatctccctcctccatcactacatatgaaacctgccaaacttatgagagacctattgcgttcacagcccgcagccgcaagctgtggatcaatttcaaaacatctgaggcaaacagtgcccgcggcttccagattccctatgtcacctacgacgaggattacgaacagctggttgaggacatcgtgagggatggtaggctatacgcctccgaaaatcatcaagaaatcctaaaggataagaagctaattaaagccttcttcgaggtgctagctcacccccagaactacttcaagtatactgaaaaacacaaggaaatgcttcctaagagctttataaagttgttaaggtcgaaggtgagctcctttcttcgcccatacaagtag

SEQ ID NO: 6015 - DNA, 984 bp, Artificial Sequence
  Description of Artificial Sequence: Synthetic coding sequence
atgaccgctttggaacttgcaaggaggggggccagggtggtactagcgtgcagatcccaagagcgaggagaagccgcggcgttcgatctgagacaggaaagcggtaacaatgaagtaatctttatggccctcgacctggcttctctggcctcggtgagggcttttgccacggccttcctgtctagtgaacctagactcgacattttgattcacaacgctggcatctcctcttgcggtcggacaagggaggcctttaacctcctcctccgcgtgaatcacattggcccatttctcttgacacatctcctgctaccatgtctgaaggcttgtgcaccctcaagggtggtggtcgtcgcctccgcagctcattgccgcgggcgtctggattttaaacgcctagataggccagtggtgggctggcgccaggagctgcgtgcttatgccgacacaaagctcgccaatgtgctgtttgcacgggagctcgcaaaccaattagaagctacaggcgtcacatgctacgccgctcatcctggtccggtgaacagtgaattgttcctgcgccacgtgcccggctggcttcggcccttactgagacccctcgcctggctggtcctgagggcaccacgcggaggcgcgcagacccccctttactgtgccctgcaggaaggaattgagccactgagcggcaggtatttcgccaattgccatgtcgaggaagtgccacctgccgcccgagatgatcgggctgcccaccggctgtgggaagcttcaaaaagacttgctgggctcggccctggtgaggacgccgagcctgatgaggacccacagagcgaagattctgaagcccctagcagcctcagtacccctcacccggaggaacctaccgtgagccagccgtatccatccccacagagctcacccgacctgagcaagatgacccataggattcaggcaaaggttgagccagagatccagctttcatag

SEQ ID NO: 6016 - DNA, 1320 bp, Artificial Sequence
  Description of Artificial Sequence: Synthetic coding sequence
atgcccgcaattgcggtgctggcagcagccgctgctgcctggtgctttctccaggtggaaagtagacacttggacgctcttgcggggggcgcaggcccgaaccacggaaattttttggacaatgaccagtggctctcaaccgtgagccagtacgaccgggataagtattggaataggttcagggatgacgactactttcgaaactggaaccccaataaacccttcgatcaggcactggatccatcaaaagacccttgcttgaaggtcaagtgcagccctcacaaagtgtgcgtgactcaggactaccaaacagcactctgtgtttcacggaagcacctacttcctcgccagaagaaaggcaacgtggcacagaaacactgggtgggaccaagtaatctcgttaagtgcaaaccttgtcctgtggctcagagcgcaatggtgtgcggcagtgacggtcatagctacacctctaagtgtaaattagaatttcacgcctgtagtaccggaaagagtctcgcgaccctctgcgatggcccttgtccctgcttaccggagccagagcctcccaagcacaaggccgaaagatccgcatgtaccgacaaggagcttaggaacctcgcttcccgattaaaggattggttcggcgcattacacgaagatgccaatcgcgtgatcaaacctacgtcttctaatactgcacagggcagattcgacacctcgatcttaccaatttgtaaggattctctgggctggatgtttaataaactggacatgaattatgacctgctattagatccttccgagattaatgctatttatcttgacaaatatgagccatgcatcaagccgctgtttaattcctgtgattccttcaaggacggcaagctctccaacaatgagtggtgctattgttttcaaaaacctggggggttgccctgccagaatgagatgaatagaatccagaagctaagtaagggaaagtctctactgggtgccttcatccctcgttgtaacgaggagggttactacaaggccactcagtgccatggatccaccggtcagtgttggtgcgtggataaatacggcaacgagctggctgggtcacgcaagcagggcgccgttagctgcgaggaagaacaagagacttcaggggattttggcagtggaggttcagtcgtgttattggatgatttggaatacgagcgagagctggggcccaaggacaaagagggaaagctccgggtgcacactagagccgtcacagaggatgacgaagacgaggatgatgacaaagaggatgaggtcggttacatctggtag

SEQ ID NO: 6017 - DNA, 3687 bp, Artificial Sequence
  Description of Artificial Sequence: Synthetic coding sequence
atgaaaggtgcgagacttttcgtcctgctctccagcctctggagcggcggtattggcttaaacaacagtaaacattcatggaccatacccgaagacggtaattctcagaaaacaatgccgtctgcctcagtgcctcctaataaaattcagtctctccaaatcctgcctaccacgcgggtcatgtctgccgaaatcgccaccactcccgaggcacgcacctcagaggactcactgcttaaaagcaccctcccaccttccgagacgtcagccccagccgaaggagttcgtaaccagaccttaaccagcactgagaaagctgaaggagtcgtcaagttgcagaacttgactctacctacaaatgcatccatcaagttcaacccaggcgcggaatccgtggtgttgtctaacagcactttgaaattcctgcagagctttgctcgcaagtcaaacgagcaggcaacttccctcaatacagtgggcggcactggagggatcgggggcgtaggagggacaggtggagtgggcaacagggcaccacgcgaaacatacctgagccgaggtgactccagtagctcccaacgcacagactatcagaaatccaattttgaaactaccaggggtaaaaactggtgtgcctatgtgcacacacgtcttagcccaacagtcatccttgataaccaggtcacttacgtgcctggcgggaaagggccgtgcgggtggacaggcggaagttgtcctcagagatctcagaaaatcagcaatccagtgtataggatgcagcataagatcgtgacttccctggattggcggtgctgccccgggtattcaggccccaagtgtcagctcagggctcaggagcagcaaagcctgatccacaccaaccaggctgaatcccataccgctgtgggccgaggtgtggctgaacaacagcaacagcaaggatgcggagacccggaggtcatgcagaaaatgaccgaccaggtgaattaccaggcgatgaagctcacactgctccagaagaaaatcgataatatctcactgacagtaaatgacgtcagaaatacttactcatctctcgagggaaaggtgagtgaggacaaatcccgggagtttcagtcgctcctgaaggggctgaagagtaagagcattaacgttcttatcagggatattgtgagggagcaattcaagatttttcagaatgatatgcaggaaacggtcgcacagctgtttaaaactgtgagctccttgtccgaggatcttgaaagcacaaggcaaatcattcagaaagtcaacgagtccgtcgtatcaatcgccgcccaacagaagttcgttctggtccaggagaacaggccgaccctgacggacattgtcgagctgcgtaatcacatcgtaaatgtcagacaggaaatgacactaacgtgcgagaagccaattaaggagctggaggtcaaacagacccacctagaaggggctttggaacaggaacattcccgctcaatactctactacgagagtctgaacaaaaccctctccaaactgaaggaagtccacgagcaacttctctctactgagcaggtcagcgatcaaaagaatgctccggcagccgaatcggtgtctaacaacgttactgagtatatgagcacactccatgagaacataaagaagcaatccttaatgatgctgcagatgtttgaggatctccatattcaagagagtaagatcaacaacctgactgtaagtttagagatggagaaggaatcgctgaggggtgaatgtgaagatatgctgtctaagtgtagaaacgactttaaattccaactgaaggacaccgaagagaaccttcacgtgctcaaccaaactttagcagaagttttgtttccaatggacaataaaatggataagatgagtgagcaactgaacgatctaacatacgacatggagatactgcagcctctcctggaacagggcgcctcactgagacaaacaatgacgtacgaacagcccaaagaggccattgtcatccgcaagaaaatcgagaacttgacatccgcggtaaattctctcaatttcatcatcaaggagctgaccaaaagacataacctgcttcgaaacgaggtgcaaggccgcgacgatgccctggaacgaagaattaatgagtacgccctagagatggaagatggcttgaacaaaacaatgacaatcataaataatgctattgactttatacaggataactacgccttgaaagaaaccctgtctaccatcaaggataattccgagattcatcataagtgtacctctgatatggagacaatattaaccttcatacctcaattccaccggctgaatgattctatccagaccctggtaaacgacaaccagcggtacaacttcgttctgcaagtggcgaaaactctggctggcattccgcgggacgaaaagctgaatcagtcaaatttccagaagatgtatcaaatgttcaatgagacaacaagccaggtccgtaagtatcaacagaacatgtcccacctcgaagagaaactgctgctgacaactaagatttctaagaattttgaaacacggcttcaagatatagaatcaaaggtgacacaaacactgatcccatactatatcagcgtaaagaaggggtcagtggtgacaaatgaacgagaccaggccctgcagctgcaggtactgaactctaggtttaaagcactagaggcaaagagcatccatctatctatcaacttcttctcactgaacaagaccctgcacgaggttcttaccatgtgccacaacgcctcgacttcggtgagcgaactcaatgccacaatacctaagtggatcaagcactccttgcccgacatccaactcctgcaaaagggattaacagaatttgttgagcctatcatccagatcaagacgcaagctgctctgtccaatctcacctgctgtatcgaccgcagtctgccaggatcattggccaacgtggttaaaagtcagaaacaggtgaagtcactccctaagaagataaacgctctcaagaagcctacggtaaacttaactacagtcctgataggccggacccagcggaacactgataacatcatttatcctgaggagtactcatcctgttccagacacccctgtcagaatgggggtacgtgtattaatggacggaccagctttacttgcgcgtgtcggcaccccttcactggtgacaactgcacaatcaaattggtcgaagagaacgccctggcacccgacttctcaaagggcagttacagatacgcccctatggtggcatttttcgccagtcacacttacggtatgaccatccctggtccaatcttatttaataacctcgatgtgaattacggcgcttcttatacccctcggactgggaagtttaggataccttaccttggggtgtacgtgttcaaatataccatagagtcattctcagcgcatatctccgggttcctggtcgtggacggtattgacaagctggccttcgagtccgagaacatcaatagcgaaattcattgtgatcgggttcttacgggggacgccctcctagagctgaattatgggcaggaggtttggttgcgcctggcgaaaggaaccatccccgccaagtttcctcctgtgacaacattcagtggttaccttctgtatcgaacctag

SEQ ID NO: 6018 - DNA, 1596 bp, Artificial Sequence
  Description of Artificial Sequence: Synthetic coding sequence
atgaaaggagcccggttgtttgtgctgctatcatccctctggtccgggggaattggccttaacaactccaaacattcctggaccatacctgaagatgggaattcccagaaaacgatgccctccgcgtcagtgccacccaataaaatccaatctctgcaaattctccccacaactcgggtgatgagcgctgagattgccactacccctgagaaggctgagggtgtagtgaagctgcaaaacttgacactgccgactaatgccagtataaagttcaatcccggtgctgagtctgtggtgctctccaactcgactctgaagttcctgcagagtttcgcacgaaaaagtaacgagcaagcaacctcgctcaatactgtgggcggaactggggggattggaggggtcggtgggaccggaggcgttggtaaccgagcaccccgtgagacttacctatccaggggagactcttctagctcccaacgtacagactatcagaaaagcaacttcgaaactactcgcggaaagaattggtgcgcatatgtacacactagattgtcacccaccgtcatcctggataatcaggtgacttacgtaccaggaggaaagggaccttgtgggtggaccgggggcagttgtcctcagcggtcccaaaagattagcaatcccgtgtataggatgcagcataagatcgtgacctctctggactggcggtgctgccccggctacagcgggcccaagtgccagttgagggcccaggaacagcagtctcttatccataccaaccaggctgagagccataccgcggtgggccgaggtgtcgcagagcagcagcagcagcaaggctgtggggaccctgaggtgatgcagaagatgactgaccaagtgaactatcaggctatgaagctgactctcctccagaagaagatagacaatattagtctcaccgttaacgatgtcagaaacacctactccagtctagaaggcaaagtctccgaagataagtcacgggaattccagagtcttcttaaggaggagtacagtagctgttccaggcacccctgtcaaaatggtggtacctgcataaacggacgtaccagttttacctgtgcctgtagacatccttttacaggggacaactgtacgatcaagttggttgaggagaatgccctggcacccgactttagcaagggctcatacaggtacgcccctatggtggctttcttcgccagtcacacctatggtatgacaatcccggggcctattctgttcaacaacctggacgtgaattacggggcatcttatacccctcgaactgggaagtttaggataccctacttaggtgtgtatgtgttcaagtatacaatcgaatccttctccgcccatatttctgggttcctcgttgtcgacggaattgacaagttggcttttgaaagcgagaatattaacagcgagatccattgtgatagggtgctcacaggcgacgcactgcttgaactgaattatggtcaggaggtctggctacgccttgcaaagggcaccattcctgcgaagttccctccagtgacgaccttctcgggttatctgctgtatagaacctag

SEQ ID NO: 6019 - DNA, 942 bp, Artificial Sequence
  Description of Artificial Sequence: Synthetic coding sequence
atgtccgatttactcctcttaggattgatcgggggcttgaccctgttgctgctgctgacactcctggcgtttgctggctactctggattgcttgccggtgtggaagtctctgcgggaagcccgcctattcggaacgtcactgttgcttataagtttcatatgggactgtacggggagactggtcgcctgtttacagagtcttgttccatcagtcccaaactcaggtcaatcgctgtctactacgataaccctcacatggtgcctccagacaagtgtagatgtgctgtaggcagcatcttatccgaaggggaagaaagtccctcaccggaactcattgatttgtaccagaagtttggattcaaggtattcagcttccccgcaccttctcacgtggtgactgcaactttcccctatacgacaatcctgtccatatggctggcaactcggcgggtgcacccggctctcgacacatacattaaagaacggaagctttgtgcataccctaggctcgaaatctatcaggaggatcaaatacacttcatgtgcccactggcgagacagggggatttttacgtccctgaaatgaaagagacagagtggaaatggcgggggctggttgaggctattgacacacaggtcgatggaactggcgcagacaccatgagtgatacctcaagcgtgagcctggaggtgtctccggggagtcgagagacctccgccgcaacactctcacccggagcatcctctagaggctgggacgatggggacaccagatctgaacattcttattctgagagcggcgcctctgggtcctcttttgaagagctggacttggaaggtgagggaccgctgggggagtctcgtcttgatccggggaccgagcccctcggaaccactaagtggttgtgggagccaaccgctcctgagaagggaaaggagtag

SEQ ID NO: 6020 - DNA, 834 bp, Artificial Sequence
  Description of Artificial Sequence: Synthetic coding sequence
atgtgcactgtcgtagacccccgaattgttcgccgatatcttctcagacgtcagctgggccaaggagcctacggcatagtgtggaaagcagtcgatcgtaggacaggagaggtcgtcgccatcaaaaaaatctttgacgccttcagagacaaaaccgatgcccagagaacttttagagaaatcaccctcctgcaggagttcggagatcaccccaacatcatcagcttacttgatgttatcagagcagagaatgaccgggatatctatctagtgtttgagttcatggggtgcccgccatctccccctccaccaaccgctgtgaggacactctctgccgacactgatttgaacgcagtcataaggaaagggggactgctccaggatgtacatgtacgctcaatcttctaccaactgcttcgagccacccgtttcctgcatagcggtcacgtggtgcaccgcgatcaaaaaccatcaaacgtgttgctggatgctaactgcaccgtgaagctgtgtgatttcggattagccagaagcttaggcgatctgccagagggcccagaagatcaggcggtcaccgaatacgtcgccactcgctggtatcgcgcacccgaggtgctgctgtccagccatcggtacacactgggcgtggacatgtggtcacttggctgtatactcggggaaatgctgcgaggcagacccctgttcccagggactagtacattgcatcagcttgagctcattctggaaacaatacctccacccagcgaggaagatctgctggccttgggtagcggctgcagggccagcgtgctccatcagctcgggtcacggtag

SEQ ID NO: 6021 - DNA, 765 bp, Artificial Sequence
  Description of Artificial Sequence: Synthetic coding sequence
atgtgcacggttgtcgacccacgcatcgtgcgtcgctatcttcttagacggcagctaggacagggtgcctacggtattgtgtggaaggcagtggatcgacggacaggcgaagttgtggccattaaaaagatattcgatgccttccgtgacaagaccgatgcgcagagaacattccgggagattactttgctgcaggaattcggggaccacccaaatattatcagcttactcgacgttattagggcagagaatgatagggacatttacttggtgtttgaattcatggacactgacctgaacgcagtcatcaggaagggagggctcctgcaggacgtgcacgtgcgctccattttttatcagctcctgagggcgaccagattcttgcattcagggcacgtggtacacagagaccaaaagccctccaatgtgctgttagacgcaaactgtacagtgaagctgtgcgattttggtctggctcggtcactgggagatctcccagaggggcccgaggaccaggccgttaccgaatatgttgctacacgctggtatcgcgccccggaagtgcttctttcttctcacagatacactcttggtgtggacatgtggagcctgggctgcattttgggcgagatgcttcgcggtagacctctatttccgggtacttctacgttgcaccaactcgaactgatccttgaaacaatcccacccccctcagaggaaggagctcaaacggcctgtcgaagtggaactggagctagcacctag

SEQ ID NO: 6022 - DNA, 474 bp, Artificial Sequence
  Description of Artificial Sequence: Synthetic coding sequence
atggcccttctcttatgtctcgtgtgtttgacagccgccctggcacacggttgtctacactgtcattcgaacttctctaagaagtttagcttttatcggcatcacgtcaattttaagagctggtgggtgggggacattcctgtcagcggcgctcttctgaccgattggtccgatgacacgatgaaggaacttcaccttgccattcccgccaaaatcaccagggaaaagctcgatcaggtggccactgccgtgtaccaaatgatggaccagttataccagggcaaaatgtactttcctggctattttccaaatgagttaagaaatatctttcgtgaacaggtgcacctgattcagaatgctatcattgaacgtcatctcgcgccaggctcctggggaggggggcaattgagtagggaaggtccctccttggcccccgaagggagcatgccatcacctcgcggagacctcccgtag

SEQ ID NO: 6023 - DNA, 699 bp, Artificial Sequence
  Description of Artificial Sequence: Synthetic coding sequence
atggccctgctactctgtctcgtgtgcctgaccgcagccctggcccacggctgcctccactgccactctaattttagcaaaaaatttagcttctaccgtcaccacgtgaacttcaaaagctggtgggtgggagacatccctgtgtccggcgcgctgctgaccgactggagtgatgatacgatgaaggaattacaccttgcaatccctgccaagatcactcgggaaaagttagaccaagttgctaccgctgtttatcagatgatggaccagctgtatcaaggtaagatgtatttccctggctactttccaaacgagttgagaaacatcttcagggagcaggttcacctgatccagaacgccatcattgaatccaggatcgattgccaacaccgttgcggtatctttcagtacgaaacgatctcttgtaacaattgtacagattcccatgttgcttgttttgggtataactgtgagtcctctgcccaatggaagtctgccgttcagggtctgctcaactacattaacaattggcataagcaggacacctcaatgaggcctaggagctcagctttctcctggcctggcacccacagagctactcctgcttttcttgtttctcctgctttgaggtgtctggaacctcctcacctggcgaacctgactcttgaagacgccgctgaatgtcttaagcaacactag

SEQ ID NO: 6024 - DNA, 396 bp, Artificial Sequence
  Description of Artificial Sequence: Synthetic coding sequence
atgggcggcgacggacgttacgtgcttaacggacactgggtggtaagtcctcccgggacttacgaagctgctggcactcacgtggtgtacacacgggataccggcccacaggagaccctgcaagccgcgggcccgaccagccatgacctgctgctgcaggtcctgctccaggaacccaatccagggatcgagttcgagttctggttacctcgcgagagatactccccttttcaggcgagagtgcaggcattgggttggcctctgcgccagcctcaacccagaggggtggagccgcagccccccgcggcgcccgccgtcacaccagctcagacacctactctcgctcccggaccatccgccggccctccgccaccaggaccaggggaccccttatag

SEQ ID NO: 6025 - DNA, 447 bp, Artificial Sequence
  Description of Artificial Sequence: Synthetic coding sequence
atggctcggatcccaaccgccgccctgggttgcatcagccttctttgtcttcagctccccggctcactgtcaagatcgctcggcggtgatccaagaccagtcaagccccgggaacccccagccagatccccctcatcatcccttcagcctcgccatccagcccctaggcccgtggtgtggaagcttcacagggccttgcaagcccaaaggggcgcaggcctggccccagtgatgggacaacccctacgcgatggcggcagacaacatagcggcccaaggagacactctgggcctaggcggactcaggcacagttgctccgtgtgggatgcgttttgggtacttgccaggttcaaaatctgtcccacaggctctggcagctgatgggacccgctggacggcaggattcagcacctgtcgatcctagctcccctcactcttacggctag

SEQ ID NO: 6026 - DNA, 447 bp, Artificial Sequence
  Description of Artificial Sequence: Synthetic coding sequence
atggcacggattccaactgcagccctgggatgtatctctctgctgtgtctgcagttgcctggaagtctcagcagatctctgggcggggaccccaggcctgtaaagccccgggagccacctgccagaagcccctcatcatcgctgcaaccacggcacccagccccccgccccgtggtgtggaaattgcatagggctctgcaggcccagagaggggcgggactcgcccccgtgatgggacagccactacgcgacgggggccgccaacattccgggccacggcggcactctggaccccgcagaactcaggcccagttgctacgcgttggatgcgtgctggggacctgccaggttcaaaacctgtctcatcggctttggcagttgatggggcctgctggccgacaggacagtgcacctgtggaccccagctctcctcattcttacgggtag

SEQ ID NO: 6027 - DNA, 537 bp, Artificial Sequence
  Description of Artificial Sequence: Synthetic coding sequence
atggaccgcgccgctcgctgttcgggggcgtcttcgcttcccttacttttggccttagctctcggactggtcatacttcactgtgtggtggccgacggaaattccacaagaagcccggaaaccaacggccttctttgcggtgacccagaggaaaattgcgcggccaccaccacacaatcaaaacgaaaaggccacttttcccgatgccctaagcagtataagcactattgtattaaaggtcggtgccgcttcgtcgtggccgagcagacaccttcttgtgtttgcgatgaggggtacatcggcgctcggtgtgaaagggtggacttgttctatctgcgcggcgacagaggacagattttggtgatctgcctcatagccgtaatggtggtgttcatcattcttgtaattggcgtctgtacatgttgtcaccctctgcgcaagcgccggaagaggaaaaagaaagaggaagagatggagacgttgggaaaggacattacaccaatcaacgaggacatcgaggaaacaaacatcgcttag

SEQ ID NO: 6028 - DNA, 1251 bp, Artificial Sequence
  Description of Artificial Sequence: Synthetic coding sequence
atgtccattagccttagctcactcattctgctgcccatctggatcaatatggcgcagattcagcagggaggcccagatgagaaggagaagacaaccgcacttaaagatctgctctcccgcatcgacctggacgagctcatgaagaaggacgaaccaccgctcgactttcccgacacccttgaaggcttcgagtacgcttttaatgaaaaagggcagctgagacatattaagacgggagagcccttcgttttcaactacagggaggaccttcatcgttggaaccaaaaacggtatgaagccctgggcgaaattatcaccaaatacgtgtatgaactgttggagaaagattgcaacctgaagaaggtgagtatcccggtggacgcgacggaatccgagccgaagtctttcatttttatgagcgaggatgccctgacaaacccacaaaaattgatggtgctgattcacggctctggggtcgttcgggccggccagtgggctcgcaggctgattattaacgaggatctagattccggaacccagattccttttataaagagggcagtggcagagggttacggggtgatcgttctgaaccctaatgaaaattacatagaagtggaaaagcctaagatccacgtgcagtccagttctgattcctctgacgaaccagctgaaaagcgcgagcggaaagacaaagtaagcaaggaaactaaaaagaggcgggacttttatgagaaatataggaatccacagagagagaaggagatgatgcagctctatattcgggaaaatggctcacccgaagaacacgccatttacgtttgggaccacttcattgcccaggccgcggcggagaatgttttctttgtcgcgcatagctacgggggactggccttcgttgagctcatgattcagcgggaggccgacgtgaaaaataaggtaaccgctgtggcactgactgatagcgtgcacaacgtgtggcatcaggaggctggcaagacaatcagggagtggatgcgagagaactgttgtaattgggtgtcatcaagcgagcccctcgacacgtctgtggaaagcatgctgccagattgccctcgagtgagcgccggaaccgataggcacgaactcacatcttggaagagcttccccagtatcttcaaatttttcacagaggcatccgaagctaaaaccagctctttaaaaccagcggtgactagacgaagccatcggattaagcacgaggaactgtag

SEQ ID NO: 6029 - DNA, 840 bp, Artificial Sequence
  Description of Artificial Sequence: Synthetic coding sequence
atgaagataatcatacttttgggatttcttggagccactttgtccgccccattgattccccagaggcttatgtccgcctctaattcaaatgaactactgcttaatctgaacaatgggcaacttctgcctctgcaactgcagggcccactgaattcttggatccctccgttctccggcattctccaacagcagcagcaggcccagattcctggcctttcccagttttccctgtctgcactggatcagttcgcaggattgctaccaaaccaaattcccctgacaggcgaggcgtcgttcgcgcagggcgcccaggctgggcaggtggaccccctgcagctccagacccccccccagactcagcccggtcccagccacgtgatgccctacgtctttagtttcaagatgccgcaggaacagggtcaaatgtttcagtactaccctgtgtacatggttcttccatgggaacagccacagcagactgttcctagatcaccgcagcaaacccgccaacagcaatacgaggaacagatcccattttacgcacaatttggttacatcccacagctggccgaaccagccatctcaggcgggcagcagcagctggctttcgatcctcagttgggcacagcgcctgaaatagcggtgatgtcaactggggaggagattccatacctacagaaagaagctattaacttccgacacgatagtgctggcgtgtttatgccatccacctcaccgaaaccatccactacgaatgtatttacgagcgccgtcgaccagacaatcacacccgagttgccggaggagaaggataagaccgacagcctccgggaaccatag

SEQ ID NO: 6030 - DNA, 444 bp, Artificial Sequence
  Description of Artificial Sequence: Synthetic coding sequence
atgggcccagaggcactctcctcgctcctccttctactgctggtcgctagtggggacgcggatatgaaggggcattttgatcctgctaagtgtcgttatgctttgggcatgcaggaccggactattcccgacagcgacattagcgcctcttcctcctggagcgactctactgccgctcggcactcgaggcttgagtcgtctgatggagacggcgcttggtgtcccgccgggagcgtcttccccaaagaagaggaatacctgcaagtggacttacagaggctgcacctggtagcattggtaggcactcagggacggcacgctggaggccttggaaaggaattcagtcggagctatcgactgcgctacagtcgcgacggaagaagatggatggggtggaaggatcgctggggtcaagaagtgatctccggaaatgaggacccctag

SEQ ID NO: 6031 - DNA, 618 bp, Artificial Sequence
  Description of Artificial Sequence: Synthetic coding sequence
atgggcggacccgttagagagcctgccctttccgtggccctttggctgtcatggggagccgcactcggcgccgtggcttgtgctatggctttgttgacgcagcagacagagcttcagtctctgcgtcgcgaggtgagtcggctgcaggggaccgggggaccctctcagaatggcgaagggtacccctggcaatctctgccggagcagcactccgttcttcatttggttccaataaacgctaccagtaaggacgattcagacgtaaccgaggtgatgtggcagcctgcattgaggagaggtcgaggcctccaggcccagggctatggagtcagaattcaagatgcaggggtctatctgctctattcacaggtactcttccaagacgtaacttttacaatgggccaggtagtgagcagagagggtcagggaagacaagagactctgttcaggtgtatccggagcatgcccagccaccctgacagagcgtataattcctgttactctgccggcgttttccacctgcaccagggcgacatcctttccgtgatcattccaagggcgagggctaaactgaatttgtcccctcatggtaccttcctgggatttgtgaaactctag

SEQ ID NO: 6032 - DNA, 744 bp, Artificial Sequence
  Description of Artificial Sequence: Synthetic coding sequence
atgccagctagctccccgtttctgctcgctcccaagggaccaccagggaacatgggggggccagtcagggaacctgcactctccgttgctctctggctgagctggggcgcagctttgggcgctgtcgcctgcgcgatggcactgttgacccagcagaccgaactgcagtcattgagacgggaggtatctcgtcttcagggcaccggggggccctcccagaatggggagggctatccctggcagtctctgcctgaacaaagtagcgatgccctggaggcatgggagaacggggaaaggtctcgcaagcggagggctgtactgactcagaagcagaagaagcaacactccgtactacatctggtgcccatcaacgccacttcgaaagatgactccgatgtaacagaagttatgtggcagccagcactgaggcgcggaagagggctccaggcacagggatacggagtacgcatacaagatgcaggagtgtacctgctgtattctcaagtcctgttccaggacgtgacctttacaatgggacaggtggttagtcgcgaagggcaggggcgacaagagaccctgttcaggtgcatccgctccatgccgtcccacccagatagggcttataattcatgttattccgcaggcgtattccacctgcaccagggcgatattctgtcggtcattattccaagagccagggccaaactaaacctgtccccccacggaacattcctgggattgtag

SEQ ID NO: 6033 - DNA, 39 bp, Artificial Sequence
  Description of Artificial Sequence: Synthetic coding sequence
atgggcaagtccgagtcactccagtcgcttcagcgatag

SEQ ID NO: 6034 - DNA, 4266 bp, Artificial Sequence
  Description of Artificial Sequence: Synthetic coding sequence
atgatgctgccccaaaacagctggcatatcgatttcggacggtgttgttgtcatcagaatctgttttccgcagtggtgacttgtatcctgctgttaaactcctgcttcctaatcagttcctttaacggaacagaccttgagctcaggcttgttaacggagacgggccgtgtagtggtacagtagaagtgaagttccagggacagtggggtactgtgtgcgacgacggatggaatacaaccgcctctacagttgtgtgcaaacagttgggatgtcctttttcgttcgcgatgttcaggttcggacaggcggtaacacggcacggtaagatctggctcgatgatgtgagctgctatggcaacgagtctgcgctgtgggaatgccagcaccgagagtggggttcacataattgctaccacggtgaagacgtcggggtgaactgctacggcgaggccaatctggggctgaggctggttgacggaaacaactcctgttccgggagggttgaagtcaagttccaggaacggtggggaacgatctgtgatgatgggtggaatcttaatactgctgctgtagtatgtcgccagctgggctgtcctagttcctttatttctagcggagtagttaactcacctgccgtcctgagacctatctggctagacgacattctttgccagggcaatgagctggctctctggaactgccggcaccgaggctggggtaatcatgactgctcccataacgaggatgtgacgctaacctgctacgactcgtccgatcttgagttgagactagttggaggtacaaacaggtgcatgggaagagtcgagctcaagatccagggcagatggggtaccgtctgtcaccataagtggaataacgctgctgccgacgtcgtgtgtaagcagcttggctgcggcacggccctccacttcgccggtctgccacatttgcagagtggctctgacgtagtgtggttggacggtgtcagctgcagcgggaatgagtcgtttctttgggactgtaggcactcaggcacggtgaatttcgattgcttgcatcagaacgacgtgagtgtcatctgcagcgatggggctgatctagaactacgcctcgccgacgggagcaacaattgctctggacgagttgaggtgcgaattcatgagcagtggtggacaatctgtgaccagaattggaagaatgagcaggcattagtcgtttgcaaacagcttggctgtccattctccgtgtttggaagtaggcgggcaaaaccttccaatgaggcccgcgatatatggattaatagtataagttgtactggcaacgagtccgcattatgggactgtacctacgatggcaaggcaaagcgcacgtgcttcagaaggtccgatgccggcgttatttgcagcgataaagctgacctcgaccttcgcttggtcggcgcacactcaccatgctacggtcggctcgaagtgaagtatcagggggaatggggcactgtgtgtcatgatcgttggagcactaggaacgcagctgtcgtctgtaagcaactggggtgtggcaaaccactacacgtattcggtatgacctatttcaaggaagctagcggacctatttggctggacgacgtctcatgtattggaaacgagtccaacatctgggactgcgagcacagcggttggggaaagcacaactgcgtgcatagagaagatgtgatcgtaacctgcagcggcgatgctacgtggggattgcgtttagtcgggggctccaacagatgcagcggaaggctggaagtgtattttcagggacgttgggggaccgtgtgtgacgatggatggaattccaaagccgcagctgtggtttgttcacagctggattgcccaagctctataatcggaatgggtttggggaacgcttcaacggggtatggcaagatttggttggacgatgtttcatgtgatggtgacgagtcagatctgtggagctgtagaaattccggatggggtaataatgactgtagccactctgaagacgtcggggtgatatgttctgatgctagcgatatggaactccgactcgtgggtggaagttcccggtgcgccggcaaagtagaggtcaacgtccagggtgccgttgggatcctctgcgcgaatggatggggcatgaatatcgcagaagtggtctgcagacagttggagtgtgggtccgctatccgggtgagtagagaacctcacttcacagaaagaactctccacattctgatgtctaattctggctgcactggcggcgaagcatccctgtgggactgtattcgttgggaatggaaacagacagcttgtcatctaaatatggaagcgtccctgatttgctccgcccatagacagcctcgcttggtcggagcagatatgccctgcagcgggcgtgtcgaggtgaaacatgctgacacatggaggtccgtatgtgacagtgatttcagccttcacgcagcaaatgtcctgtgccgggagttaaactgtggagatgcaatctccttgagcgttggggaccactttggaaaaggcaacgggctaacatgggccgaaaaatttcagtgcgagggatcggagacacacctggccctgtgtccaatagtgcagcatcccgaagacacctgtattcacagcagggaagtgggcgtggtgtgttcaaggtacactgatgtaaggttagttaatggaaagtcccagtgtgatggacaggtggaaatcaacgtgctgggacattgggggagcctctgtgacacacactgggatcctgaagatgcccgagtcctgtgtcggcagctgagctgcggaaccgccctgagtaccactggtggaaaatacatcggtgagagatctgtgcgcgtctggggccacagatttcactgccttggcaacgaatcactgctggacaattgccaaatgacagtccttggtgccccgccctgtatacacgggaacaccgtctctgtgatttgtacaggatctctcacccagcccctgtttccctgcctggctaatgtttccgacccttatctcagtgctgtgcccgaaggctcagcgctgatctgtctagaggacaaaagactgaggctggtcgatggagacagccggtgtgcaggccgagtggagatctaccacgacgggttctgggggaccatctgcgatgatggctgggacctgtcagatgctcacgtggtgtgccaaaaactcggatgcggggtggcttttaatgctactgtgtctgcccattttggcgaagggagtgggcccatttggttagacgatcttaattgcactggcatggagtcccatttgtggcagtgtccttcccgcggatggggccagcacgactgtcgacacaaggaggacgcaggagtcatctgctcagaatttacagccctccgcttatacagcgagaccgagactgagtcttgcgccgggcggctggaggtgttttacaacgggacatggggctctgtgggtcgacggaatattactaccgcaatcgcggggattgtatgccggcaattagggtgcggcgaaaacggcgtcgtaagtctggcccctctgagcaagacaggatctggattcatgtgggtggatgatattcagtgccccaaaacccatatttctatttggcagtgcctttcagccccctgggagaggagaatctccagccccgctgaggagacctggattacctgtgaagacaggatccgggttaggggcggagacaccgagtgttcggggcgcgtggagatctggcacgcgggatcttggggtacagtgtgcgatgattcctgggacctagccgaagccgaagtggtgtgccagcagctgggttgcggcagtgctctcgcagccctgcgggatgcttctttcggacagggcaccggcacaatttggctggacgatatgagatgtaaaggcaatgaaagtttcctctgggattgtcatgccaaaccctgggggcagagcgattgcgggcataaggaggacgctggagtgcggtgtagcggacagtccctaaagagccttaacgctagtagcggacacctcgctctgatactgtcttcaatttttggcctgctgttactggttctgtttattcttttcctaacttggtgcagggtgcagaagcagaaacacctgccactgcgggacgatactccaaaccacggatgcgaggatgccagtgacacgtctcttttgggcgtgttgccagctagcgaagccactaaatag

SEQ ID NO: 6035 - DNA, 1410 bp, Artificial Sequence
  Description of Artificial Sequence: Synthetic coding sequence
atgatcaccgagggagcacaggcgcctagactgctgctccctcctttactcctactgcttactctgcctgctacggggtccgacccagttttatgttttacacagtatgaagaatcctctggcaaatgtaaaggtctactgggaggcggggtgtccgtggaggactgttgccttaacacagcttttgcctaccagaaaaggtcaggggggctctgccagccctgcaggtccccccgttggtctctgtggagtacttgggctccctgctccgtgacctgtagtgaaggatctcaactgagataccgtcgctgcgtcggttggaacgggcagtgcagcggaaaagtggcacctgggacattagagtggcaactacaggcatgcgaggatcagcaatgctgtccagaaatgggcggctggtccggctggggaccttgggagccgtgcagcgttacatgcagcaagggcaccaggaccagacggagagcctgcaatcacccggcccctaagtgtggcggacactgcccgggacaggcgcaggagtctgaggcatgtgacactcagcaggtttgccccactcatggcgcctgggcaacttggggaccgtggacaccatgctctgcatcatgtcatgggggcccacacgagcctaaagaaacccgctcacgtaagtgctctgcccctgaaccctcgcagaagccaccaggaaaaccctgtccaggcctggcatacgagcagaggcggtgcacagggctgcctccctgtccagtggctgggggatggggcccctggggccctgtttctccatgtcccgtgacatgtggattgggccagacaatggagcagcgtacatgcaaccaccctgttccacagcacggaggacccttttgtgccggtgatgcaacaaggacgcatatctgtaacaccgcagtcccctgtcccgtggacggggaatgggattcttggggagaatggagtccttgcattcggcgcaacatgaaatcgataagctgccaggaaattcccggccagcaatcccgaggcagaacatgcaggggccggaagttcgacggccaccgctgcgccggccagcaacaagatatacggcattgctattccatccaacactgccctctcaagggatcctggagcgagtggagcacctggggactgtgtatgcccccatgtggaccaaacccgacgagagcgcgtcaacggctgtgcaccccactgcttcccaaatatcctcccacagttagcatggttgagggccagggtgaaaagaatgttaccttttggggacgtcccctccccagatgtgaggagctacaggggcagaagctggtcgtggaggagaaacggccctgcttacacgtcccagcttgtaaggaccctgaggaggaagagctgtag

SEQ ID NO: 6036 - DNA, 837 bp, Artificial Sequence
  Description of Artificial Sequence: Synthetic coding sequence
atgcagtggctgcgagtgcgggaaagcccgggagaggcaacggggcaccgggtcactatgggcaccgcggccttgggccctgtgtgggctgccctccttctttttctcctcatgtgcgagatccctatggtcgaactcacatttgaccgcgctgtcgcttccggctgccagagatgctgcgactctgaagaccctctagaccctgcccatgtgtcttcagcctcatcgagcgggcgtccacacgcacttccagagatccgcccttatatcaacatcacaatactgaagggcgacaagggtgaccccggccctatgggactgccgggatacatggggagagaaggtccccagggtgagcccggaccccagggatcgaaaggcgacaaaggtgagatggggtctcctggtgccccgtgccagaaaaggttcttcgcattttcagtggggcggaaaactgccctgcacagcggagaggactttcaaactctgctgttcgaaagagtgtttgtcaatctcgacgggtgcttcgacatggctaccggacagttcgcagccccgctacggggaatttacttcttctctcttaacgtgcactcctggaattataaggagacatatgtccacatcatgcacaatcagaaggaggccgtgattctctacgcacagcctagtgagcgctcaatcatgcagtcgcagagtgtgatgctcgatctcgcctacggcgatcgggtgtgggtgcgcctctttaagagacagagggagaatgccatctactcaaacgacttcgatacctatattacattcagtgggcatctgataaaggcagaagacgattag

SEQ ID NO: 6037 - DNA, 1128 bp, Artificial Sequence
  Description of Artificial Sequence: Synthetic coding sequence
atggagtttgagatcactttccgcccggattctggcgacggcgtgttattatatagctatgataccggctctaaagatttcctctcgatcaacctggctgggggccacgtggaatttcgctttgattgtgggagtggaaccggtgtgctgcggtctgaggatcccttgacactggggaattggcacgaactcagagtctcccggacggctaaaaatggcatacttcaggttgataagcagaaaatagttgagggtatggcagaaggaggtttcacacagatcaagtgtaacaccgatatctttatcgggggtgtacccaactatgacgatgtgaagaaaaatagtggcgtactaaagcctttttctggctcaatccagaaaataatcttaaacgaccgtactatccacgttaagcacgatttcacctctggcgtgaatgttgagaacgccgcccatccctgtgtgcgggctccctgtgctcatggcgggtcctgcaggccacggaaagagggttatgactgcgactgtcccctgggattcgagggcttgcattgtcaaaaagccatcatagaggccatcgagatccctcaattcatcggaagatcctaccttacatacgacaatcccgacatcctgaaaagggtgtccggaagcagatcaaatgtttttatgcggtttaaaaccactgcaaaggacggcctgcttctgtggagaggtgatagccctatgcgccccaacagtgacttcatcagtctgggcctgagagacggcgctcttgttttctcctacaaccttggcagtggcgtggcatctatcatggtgaacggttctttcaacgatggtagatggcacagagtaaaagccgtgcgtgatggacagagcggaaagatcacagtggatgactatggtgcaaggacgggcaaatcacccggaatgatgaggcagctgaacatcaatggcgcattgtatgtcgggggaatgaaagaaatcgcgcttcacactaacaggcagtatatgcgggggctggtggggtgcatttcgcactttactctgtccacagactaccatatttcactagtcgaggatgctgtggacggtaaaaatataaacacttgcggggcgaaatag

SEQ ID NO: 6038 - DNA, 459 bp, Artificial Sequence
  Description of Artificial Sequence: Synthetic coding sequence
atgcggtttaagactacagccaaggatgggttgctcctgtggcgaggcgactctcccatgcggcctaactccgacttcatcagtttggggcttcgtgatggggcactggtgttttcctacaacctaggctccggtgttgcttccattatggtgaatggttcttttaacgatggacgttggcatagagtgaaagcagtgagggatggccaatccggcaaaatcaccgtggatgattacggggccagaactggcaaatctcctggaatgatgcggcaactgaacataaacggtgccctgtatgtcggcggtatgaaggagatcgccctgcacacaaataggcagtacatgcgcggccttgtcgggtgcattagccactttaccttatcaacagactaccatatctccttggttgaggacgcagtggatgggaagaatataaacacctgtggagccaagtag

SEQ ID NO: 6039 - DNA, 1050 bp, Artificial Sequence
  Description of Artificial Sequence: Synthetic coding sequence
atgaccgctttaccaggccctctttggctgctgggtcttgctctgtgtgccctaggcggcggggggccgggactgaggcccccccctgggtgtccccaacgtcgattaggggccagggaacggagagatgttcagcgggaaatactggccgttctgggattgcctggcaggccgcgtcctagggcgcctcccgctgcctctaggctcccagcctccgcccccctgtttatgctcgatctgtaccatgctatggccggcgatgatgacgaagacggggccccggccgaacgcaggctgggcagagcagatttggttatgtccttcgtgaacatggtggagagagatagggcacttgggcatcaggaacctcattggaaggagtttcgctttgacttgacccagatccctgccggcgaagcggttaccgctgctgagttcaggatatacaaagttccatcgattcatttgttgaataggactttgcacgtgagcatgttccaggtagtacaagagcaatcaaaccgggagagcgatctcttttttctggacctccagactctaagggcaggcgatgaaggttggttggtgctggacgttacagcagctagcgactgttggctgctcaaaagacacaaggaccttggactgcgactttacgttgagactgaagatggagagacatggaccgggtggggatggacaaaggacagccgtctgcaaatgtggaagttacgcctctctcggaccccatgggttttgtccttgcatgccccagggccagcccaggctcctgctgaacgtccactgctgtgcctgttacaggggcactgtcctgccagcccttcacccataaggaccccaagagcggtcagaccactgcgtaggaggcagcccaagaaaagcaacgagctgcctcaggccaaccggctgccaggaattttcgatgacgtccatggaagccatggccgccaggtttgcaggcgccacgaactgtacgtgtccttccaagatctgggatggctggtaatcgcagatagctcctgtttttag

SEQ ID NO: 6040 - DNA, 1617 bp, Artificial Sequence
  Description of Artificial Sequence: Synthetic coding sequence
atgagcttctctgccactattctgtttagtccgcctagcggaagtgaagctagatgttgctgttgtgcctgtaaaagtgagaccaacggtggcaatactggctctcagggaggtaaccctccgccttcgacaccaatcaccgtgaccggacatggcctggccgtccaatcctcagagcagttgctgcatgttatctaccagagggtggataaggcagtcgggttggccgaagcagcccttgggctagcacgcgccaacaatgagcttcttaagcggcttcaggaggaggtgggggacctgcgccagggaaaggtgagcattcctgacgaagacggtgaaagccgcgcccactcctcaccccctgaggaacccggccctctcaaggaatcaccaggcgaggccttcaaagccctgagtgctgtcgaggaggaatgcgactccgtaggttccggggtgcaggtcgtgatcgaagagctgcgccagctcggtgctgcatcagtgggccctggccccctgggcttccccgccacccagcgtgacatgaggcttccaggttgtaccctcgcagcttctgaggcggcccccttgctcaaccccctggtggatgactatgtggcgagtgagggcgctgttcagcgcgtcctggtgcccgcctacgccaagcagctgagccctgccacccagctggccattcaacgcgctactccagagactggacccgagaatggcaccaagctccccccccctcggcccgaagatatgctgaacgctgcggcagccctcgacagtgcattggaggagtcaggtccaggctcgacgggcgagcttagacactctcttggactaaccgtctctccgtgcaggactagaggctctggacagaagaatagcaggaggaagagggatttggtgttatctaaacttgtccataacgtgcacaatcatattactaatgataaacgatttaatgggtctgagagcattaagtcaagctggaatatttccgtggtaaagtttttacttgagaaactgaaacaggagctggttaccagcccacataactacacagataaagaactgaaaggggcctgtgtggcttactttcttaccaaacggagagagtaccgaaactccctcaaccccttcaagggtctgaaagagaaagaagagaagaaactgagatcacggcgatatcgtctctttgccaatagatcctcaattatgaggcacttcgggcccgaagatcagagattatggaacgacgtaacggaggaattaatgtcagatgaggaagattcgcttaatgagcctggagtgtgggtcgcgcgacccccacgcttcagggctcaaaggctgaccgaactgtgctaccacttggatgccaattcaaaacacggtaccaaggctaatcgggtctatggaccaccctccgatcgtttgccctctgccgaagctcagctgctaccacctgaactgtacaacccaaacttccaagaagaggaggacgagggcggggatgaaaacgctccaggttccccttccttcgatcagccgcataaaacttgctgccccgacctgaacagcttcatagagattaaggtggagaaagatgagtag

SEQ ID NO: 6041 - DNA, 630 bp, Artificial Sequence
  Description of Artificial Sequence: Synthetic coding sequence
atgtcgttcagtgctacaatcttgttctctccaccctctggatcggaggcccgctgctgttgctgtgcttgcaagagcgaaacaaatggtggcaatacaggttcacaggggggaaatcctccaccctccactcctatcacagttacgggacacggacttgccgtgcagagctcggagcagctgctgcatgtgatctaccagcgcgtagacaaggccgtagggttggcggaagccgccctgggccttgcccgggcgaataacgagctgctcaagagacttcaggaggaagtgggagatcttcgccaggggaaagtttctatccccgatgaggacggagaaagccgggctcactcctcccccccagaagaacccggccctctcaaagaatctcctggcgaagcttttaaggccttgagcgcagtcgaagaagaatgcgattcagtgggctctggcgtgcaggtggtgatcgaggagcttagacagctcggcgcggcctctgtgggccccggcccactgggctttccagcaactcaaagagacatgcggctgccaggttgcacccttgcggctagcgaggccgctccactgcttaaccccctggtggacgactatgtagcgagcgaggggtag

SEQ ID NO: 6042 - DNA, 1617 bp, Artificial Sequence
  Description of Artificial Sequence: Synthetic coding sequence
atgagtttcagcgcaacgatccttttcagtccaccttctggctctgaggcccggtgttgttgttgcgcctgcaagtccgaaaccaacggaggcaatactggctctcaaggcggcaatccccccccaagcacgccaatcactgttacaggacacggtctggctgttcagagcagtgaacagctgcttcacgtcatttatcagagggtggacaaggcagtggggttggctgaggctgctctagggctggcgagagccaacaatgaattacttaagcgtctccaggaggaagtgggcgacctgagacagggaaaggtgtccataccggacgaagacggggaaagccgagctcactcttcacctcccgaagagcctggccctttgaaggaaagcccaggagaggcctttaaagctctttccgccgttgaggaggaatgcgacagtgtgggcagtggcgtgcaagtagtgatcgaggaactgcgtcagctgggtgccgcaagcgttggcccagggcccctgggatttcctgcgacgcaacgcgacatgcgtctccccgggtgcactctggcagcctccgaggccgcccccctgctgaatcctttggtggacgactatgtggcctctgagggagccgttcaaagggtgctggtgccagcttacgccaaacagctgagtcccgcaacccagttggcaatacagcgagctaccccagagaccgggcccgaaaatggcacaaaactgccgccacctcgcccagaagacatgcttaacgcagctgctgccttggacagcgccttggaggagagcggccctggttccacaggcgagttgagacacagtttaggtctcaccgtttctccatgcaggacccgcggtagcgggcagaaaaattccagacggaagcgcgacctggtcctctccaagctggtgcacaatgtgcacaaccacattacgaatgataaacggttcaatggtagcgaatcaataaagagctcatggaacatttcggtagtaaagttcttactggagaagctgaaacaggagctggtcacgtcccctcacaattataccgacaaagagctcaaaggcgcgtgtgtcgcctactttctgaccaagcgcagggaatacaggaattcgctgaatccatttaaaggactgaaggagaaggaggagaagaagctgaggagcagaagatacaggttattcgctaatcggtcgtccataatgagacatttcgggccggaagaccagagactgtggaacgacgtgacagaggaactgatgtcagatgaggaggacagtctgaacgagcccggcgtttgggttgcacgcccccctaggtttcgggcacagaggttgactgaactgtgttaccacttagacgccaacagcaagcacggtactaaagccaaccgcgtttatggccccccctcagataggttacccagtgccgaagcccagctccttcctccggaactttacaaccctaatttccaggaggaagaggacgagggaggcgacgagaacgccccaggcagcccgtccttcgatcagccccataagacctgttgtccagatttgaattctttcatcgaaattaaagtggagaaggatgaatag

SEQ ID NO: 6043 - DNA, 1524 bp, Artificial Sequence
  Description of Artificial Sequence: Synthetic coding sequence
atgtgtactaaaaccatcccagttctgtggggctgtttcctgttgtggaacctttatgtcagtagcagccagactatataccccgggattaaagctagaattactcagcgagctctcgattacggggtgcaggcgggcatgaagatgatcgagcaaatgctcaaagaaaagaaactccctgatctctcaggaagtgagagcctggagttcttaaaagtggattacgtaaactacaactttagcaacattaaaataagtgcattttcctttcctaacaccagcttggcctttgttcctggagtgggaattaaagctcttacaaatcacggcacggcaaatatctccacggattgggggttcgagagccctctttttcaggacactggcggggccgatttatttctcagcggagtgtactttaccggcattatcattctaaccaggaatgattttgggcatccaacattgaagttgcaggactgttacgcgcaactgtcccatgcacatgtgtcattctcaggagagctgtcggttctctataactcattcgccgaaccaatggagaaacctatactgaaaaacctgaatgagatgctctgtcctataattgcctccgaagtgaaggccctcaatgccaatttgtcaactcttgaggtactgaccaagattgataactatactctcttggactacagccttattagcagtcccgaaatcacggaaaattacctggacctgaatctgaaaggagtgttttatccactcgagaatttgacggatccccctttcagcccagttcctttcgtgctgccggaacgttcaaattccatgctttatattgggattgctgaatatttcttcaaaagcgccagttttgcgcatttcaccgccggggttttcaatgtcaccttgagcactgaagagatctccaaccatttcgtgcaaaatagccaggggcttgggaatgtgctgtctcgcattgcggagatctacatcttatcgcaaccattcatggtccgtattatggcaaccgaaccccctatcattaacctgcaacccggaaatttcaccctcgacattcctgcctcaatcatgatgctgacacagcccaagaattccacggtagagacgatagtttctatggactttgtggctagtacgagtgtgggtcttgtgatcctcgggcaacggttggtctgctccttgagcctgaaccgcttcagattagcattgccggaatccaacagaagcaatatcgaggtgctccgctttgagaatattctgtcatccattctccacttcggtgtgcttccgctagccaatgctaagctccagcagggctttcccctgtccaatccccataagttcctgttcgtcaacagcgacattgaggtcctggaaggattcctcctgattagcaccgacttaaagtacgaaacctcatctaaacagcaaccctctttccatgtgtgggagggactcaatctgatcagtcggcagtggcgcggaaaatcggccccctag

SEQ ID NO: 6044 - DNA, 753 bp, Artificial Sequence
  Description of Artificial Sequence: Synthetic coding sequence
atggcctctgagaggcttccaaaccggcccgcctgtttactcgttgcttcgggcgccgctgagggggtcagcgctcagtctttcttacactgctttacgatggcctccactgcttttaaccttcaggtcgccacacctggcggcaaggctatggagttcgtcgatgtgaccgaatccaacgccagatgggttcaggatttccgcctcaaggcctacgccagtccagcgaagctcgaaagcattgatggtgccaggtatcatgcgctgctaatacctagctgtcccggagccctaacggatctagcgagctctggatcattggctaggatcctccaacatttccactcggagagcaagcctatctgtgcagtgggtcatggggtcgcagccctctgctgcgcgaccaacgaggacagatcatgggtcttcgattcgtactccttgactgggccttctgtgtgcgaacttgtccgggctcccgggttcgctcggttgcctctcgtggtggaagacttcgtgaaggactcaggggcctgcttctccggagctgcagcgtcttgtccaaaggctgatagacattggcagcattttcctgtcgaggaaatcttcctggcatgtggcttcaaagttgccggcttgggagcggccccaggctggggacgcggcgggaagcaggaggacaggccacctgaggagcagcgacgtgcaggggaggactttcctatctatcagtgtgttttcatttatccgtag

SEQ ID NO: 6045 - DNA, 1386 bp, Artificial Sequence
  Description of Artificial Sequence: Synthetic coding sequence
atgtcattggacatccaatctcttgacatccagtgcgaagaactgtctgatgccagatgggccgagctgctgcctttattacagcagtgccaggtcgtacggctcgacgactgcgggctgaccgaggcgagatgcaaagatatctccagtgcgctcagggtaaatcctgccttagccgaactcaacttacggtcaaatgaacttggagacgtcggagtccactgtgtgttgcagggattgcaaactccctcttgtaaaattcagaagctgagtctgcaaaactgctgcctcactggagctggatgcggtgttctcagctccacccttcggactctgccaactctgcaagaactgcacctgagcgataacctactcggcgatgctggtctccaattattgtgcgagggtctgctggatccacaatgtcgactcgagaaattgcagctagaatattgtagtctgtccgcggcttcatgtgagccattagcatctgtcctcagagcaaaacccgattttaaagaattaacagtgtccaataacgacatcaacgaagccggcgtaagagtgctgtgccaagggcttaaggatagtccctgccaactggaagctctgaaattggagagctgtggcgtgaccagtgataattgtcgtgatctatgcggaatcgtcgcgagtaaagcctccctcagggagctggcacttggcagtaacaaactgggcgacgtgggcatggccgagctctgtccaggactgctccatcctagctctcggttgcgcacattatggatctgggaatgtggaattaccgccaaaggttgcggcgatctgtgcagagttcttagggccaaagagtctctcaaggagctttctcttgctggcaacgagctcggagatgaaggcgcaaggctgttgtgtgagacactgcttgaacccggctgccagctagaatccctgtgggtaaaatcttgctcatttacagccgcttgctgcagtcacttcagctcagtcttggctcagaacaggtttcttcttgagctccagattagtaacaataggctagaggatgctggggtgcgggaactgtgccaggggctcggccagcccggctctgtactgagagtgctgtggctggccgattgcgacgtttcggatagctcttgctcatccttggcagccacactcttagcaaatcacagcctacgtgaactcgatctgtctaacaattgcctgggcgatgctggtattctacaactggttgagagtgtgcggcagccagggtgccttctggaacagcttgtactgtacgatatttattggtccgaagagatggaggaccggctgcaggctcttgagaaggataagcctagcctccgcgtcatcagttag

SEQ ID NO: 6046 - DNA, 1386 bp, Artificial Sequence
  Description of Artificial Sequence: Synthetic coding sequence
atgtccttggatatccagtccctcgatatccagtgtgaggagctgagtgacgctcggtgggccgaattgctgcctctgctgcagcaatgtcaagtcgtacgattagatgattgcggccttaccgaagcacggtgtaaagatatttctagcgctctcagagtgaaccctgccctggctgaactgaaccttagatcaaatgagctcggcgatgtaggagttcactgtgtactacaaggacttcagaccccatcttgcaagatccagaagctgtcactacaaaactgttgtctgaccggcgccggttgtggtgtactgtcctccacccttcgcacattacctacactacaagagcttcacctgagtgataacctgcttggtgacgccggcctgcaactgctgtgcgagggattgttggatccccagtgtcgcctcgagaaactccaacttgaatactgcagcctgagcgccgccagttgtgaacctctggctagcgtcctgagagctaaaccagatttcaaagagttaacagtgtccaacaacgatatcaatgaagccggcgtaagggtactctgtcagggattgaaggattcaccctgtcagctcgaagccctgaagcttgagtcctgtggcgtgacatccgacaactgccgtgatctctgcggcatcgtagccagcaaggcctcactccgtgagctggcacttgggagcaacaagctcggggatgttggcatggcagagttgtgtcccggcttgctgcacccttcctccaggctgcgcaccctatggatctgggagtgcggaataaccgctaagggctgtggcgacctctgtcgggtcctgagagcaaaagagtcactgaaagagctgagcctcgccggaaatgagctcggggacgaaggcgctcgcctgctgtgcgaaactctacttgaaccgggctgccagctagaatctttgtgggtgaaaagctgttctttcactgccgcctgttgcagtcatttctctagtgttctagcccagaatagatttctcctcgagctgcagatctcaaacaacagactggaggatgccggagtgagggaactttgccagggtctcggccagcccggatctgtgctgcgtgttctctggctcgctgactgcgacgtatctgatagtagctgttcctccctggctgcgaccctcctggcgaaccactctctgagagagctcgacctctctaataattgccttggagacgccggcattcttcagctggtggaatctgtgcgacagccgggttgtctgttagagcaactcgtgctctacgacatttactggagcgaagagatggaagatagactgcaggccctagaaaaggacaaaccatcgctcagggtgatctcttag

SEQ ID NO: 6047 - DNA, 1386 bp, Artificial Sequence
  Description of Artificial Sequence: Synthetic coding sequence
atgagtctggatatccaatctctcgatatacagtgtgaggagttaagtgatgcaagatgggcagagctgcttcctctcctgcagcagtgccaagtagtgaggctcgatgattgcggcctgactgaagctcgctgtaaggatatttcatcggcgctgcgtgtcaatcccgcactggccgagctcaacctgcgcagcaatgaactcggcgacgtcggagttcactgcgtgttgcaggggctgcagaccccatcttgtaagatccagaaattgtccctgcaaaattgttgcctcactggtgccggatgtggggttcttagtagcacgctcagaaccttgcccacactccaagagctgcacttgagcgacaacctactgggcgacgcgggtctccaactgctgtgcgagggactcctggatcctcagtgtagactggagaaactgcaattggagtattgtagcctctcagccgctagctgtgaacccctggcatctgtgcttcgcgctaaaccggactttaaggaactgaccgtctccaacaacgacatcaatgaagccggagtaagggttttgtgccagggtttaaaggattctccttgccaactcgaagcactcaagctggaatcgtgtggggtcacatcagataactgccgcgatctttgtgggatcgttgcttccaaggcctctctgcgtgaactagcactcggatctaacaaactcggcgacgtcggaatggctgagctgtgtcctgggttattgcatccgtcatcacgtttgaggacactctggatctgggagtgtgggatcaccgctaagggatgtggcgatttgtgtcgggtattgagagcgaaagaatcactgaaggagctgtctctggccgggaacgaattaggagatgagggggcccgtctgctgtgtgagactctgctagaacccggttgccagcttgagtctttgtgggttaagagctgcagcttcacagctgcctgctgtagccatttcagctctgtactggcccaaaatcggttcttgctggagttgcagatttccaataacagattagaagacgctggagtgcgggagctatgccagggactgggtcagcctggcagcgtcttaagagtgctctggctggccgactgtgatgtgtctgattctagctgtagcagccttgccgccaccttactggctaatcactcattacgcgagctggacctgagtaataactgcctcggtgacgccggtatactgcagctcgtcgaaagcgtgcgccaaccaggatgccttttagagcagctggtactgtatgacatctattggtcggaggagatggaggaccgtttgcaagctctggaaaaggataaaccatccctgcgggtaatcagttag

SEQ ID NO: 6048 - DNA, 1452 bp, Artificial Sequence
  Description of Artificial Sequence: Synthetic coding sequence
atgattacagcccactgttcactcgatttactgggaagcgttgcagtactgtgtgtgtgcgacctgagccccgctcaatgcgatatcaactgttgctgcgaccccgactgtagcagcgtggacttttccgtgttctcagcttgttcggtgccagtggttacaggtgactctcaattttgctctcagaaagcagtaatctacagtctgaacttcaccgcaaatcccccccagcgtgttttcgagctggttgatcagatcaatccctctattttttgtattcacatcactaactacaaaccagcgctgtcgttcatcaatcccgaagtgccggatgaaaataatttcgacacgttgatgaagaccagcgatggattcacactgaatgccgagtcctacgtgtccttcactaccaaactcgatataccaactgctgccaagtatgaatatggtgtgcctttgcagacttctgacagcttcttaagatttccgtcttcgttaacaagcagcctgtgtaccgacaataacccagccgcttttctcgtgaatcaggctgtcaaatgcactagaaagattaatctcgaacagtgtgaagaaatcgaagcccttagtatggcgttttacagttccccagaaattctgcgggtccccgactctcgtaaaaaagtgccaatcactgtgcagtctatcgtgatccagtctctgaacaagaccctgacacggagagaagacactgacgtgctgcagcctacgcttgtgaatgcggggcacttcagcctctgcgtgaacgttgtgctggaggtaaaatactctctgacatacacagatgcaggggaggtgacgaaggccgaccttagttttgtacttggcactgtctcatctgtggtggtgccacttcagcagaaattcgaaatacacttcttacaggaaaatacccagcctgtacctttgtcaggaaatccaggttatgtggtgggtctacccctggccgctgggttccagcctcacaaaaccggggccctcccatgccaactggtggcacagaaggtgaagtccctgctctggggccaaggttttcccgactacgtagcccctttcggcaactcacaggctcaagatatgctggattgggtgccaatccacttcatcacacagtcctttaatcggaaacattttgttttgcaagactcctgtcagcttccaggcgccctcgtgatcgaagtgaagtggactaagtacggcagcctgttgaacccccaagctaagatcgttaatgtgaccgccaatttgataagttctagttttcctgaggcaaactcaggaaacgaaagaacaattctaatctcaactgcagtaactttcgtcgatgtatccgccccagccgaagcgggcttccgcgctcctccagccatcaacgccaggctgcctttcaactttttctttccctttgtatag

SEQ ID NO: 6049 - DNA, 1596 bp, Artificial Sequence
  Description of Artificial Sequence: Synthetic coding sequence
atgtgtcagcttctcgagagtacggtcattcaaccccagggagacagcccagtggccgtgctgtgcgtttgcgatctgtctcctgcccagtgcgacatcaactgttgctgtgacccggattgtagtagtgtagacttctccgtgtttagtgcatgttcggtgccggtggtgacaggcgatagccagttttgtagccaaaaggccgttatctactcgctgaattttaccgccaacccacctcagcgtgtttttgaactggtggatcagataaatccttctatcttctgcattcacatcacaaactataaaccagccctgtcatttattaatcccgaggttccggacgaaaataattttgatacccttatgaaaactagcgacggctttacactcaatgctgagagctacgtcagcttcacaacaaaactggacattccgactgcagccaagtatgagtacggggtcccattgcagacttccgatagctttttaaggttccctagctctctgacctcatccctgtgtaccgataacaacccggccgcatttctggtcaatcaggctgtgaagtgtaccagaaagattaatctggagcagtgtgaagaaatagaagcacttagcatggccttttacagttctccggaaattctgcgtgtgccagatagtagaaagaaagtccccattacagtgcagagtatcgtaatacaaagcctgaataagacgctcacgcgtcgggaagatacagatgtgctacagcccactctggtaaacgcgggccacttttcattatgcgtgaacgttgtgctcgaagtaaaatactcattgacctacactgatgcaggggaagtgactaaggccgatctgtcattcgtgcttggcactgtatcttctgtagtggtacctctgcagcagaaattcgaaatacattttttacaagagaacacccagccagtgccgttgtccggcaaccccggctacgtggtcggcttacccctcgcagcgggctttcagccacataagatgagtggcatcatccagactacaaacagatatggccagctgacaattctacatagcacaacagagcaggattgcctggcgttagaaggcgtgaggacacccgtgttgttcggctacacaatgcaatctggctgtaaactcaggcttacaggagcccttccatgccagctggtggctcagaaggtgaaaagtttactttggggccagggcttcccagattatgttgcacctttcggcaatagtcaggcccaggacatgttggattgggtgccaatccacttcatcactcagtcttttaacagaaaagactcctgccaacttcccggtgccctcgtgattgaggtaaagtggacaaaatatggcagcttattgaacccacaggcgaagatcgtcaacgtcaccgcaaaccttatctcatcttcctttccagaggccaattctggcaatgaacgcacaatcctcatcagtacagccgtaacatttgtcgacgtgtccgcaccagcggaagctggattcagagccccacccgccattaacgctagacttcctttcaatttttttttcccctttgtgtag

SEQ ID NO: 6050 - DNA, 1722 bp, Artificial Sequence
  Description of Artificial Sequence: Synthetic coding sequence
atgagacctcgcggcctgccccccctgctggtggtgcttttagggtgctgggcatcggtcagcgcgcagacggatgcaaccccagccgtgaccacagaaggcctgaactcaacagaggcagccctggccacattcgggacattcccatcgactcgccccccgggtacgcctcgagctccagggcctagttcaggccctaggcccacacccgtgactgatgtcgccgtattgtgtgtctgcgatttgtcccccgcacagtgtgatataaactgctgttgtgatcccgactgttcctccgtggatttcagtgttttctctgcctgtagtgtcccagttgttactggagactctcagttctgttcccagaaggcggtcatttattccttgaactttactgcgaaccccccccaacgtgtatttgagctggtggaccaaatcaacccatccattttttgtatccatataacgaactacaagcccgctctgagcttcatcaatccggaggtcccggatgagaacaactttgatacactaatgaaaacgtctgatggttttaccctgaatgcagaaagctacgtgagttttacaaccaaactagatatcccaacggctgccaaatacgagtacggcgtccccttacagactagtgattcttttctgcgcttcccatcgtcactcacttccagtctgtgcacagataataaccccgcgggtcaggcatattggttcacccccgtaattccagcactgtgggaggctgaagcacgtggatcactcgaggtgccggattcgagaaaaaaggtacccatcaccgtgcaatccatcgttatccaatctttgaacaagacactgaccagaagagaggacactgacgtcctgcagccaaccctggtcaacgccgggcacttcagcctgtgtgtgaatgtagttttggaagtgaagtactcgctcacctataccgacgccggcgaagtgactaaggcggatttgtcattcgttctgggaaccgtctcatcagttgtggtacctttgcagcagaaattcgaaatccactttttacaggaaaacacgcagccagtgccactgagcggtaatccaggctacgtggtgggcctgcctctggccgccgggttccagccacacaagggaagtggcatcatccagaccactaatcgatatgggcagctcactattcttcattctaccacagagcaggattgccttgctcttgagggcgtcaggactcctgtgctgtttgggtataccatgcagagcgggtgtaaactgcggttgaccggggcacttccatgtcaactggtggcccagaaggtgaaatcattactctgggggcagggttttccagattacgtggcaccgtttggtaatagccaggctcaggatatgctagactgggtccccatccatttcatcacgcagagctttaatcggaaggattcttgtcaactgcccggggccctcgtaatcgaagtgaagtggactaaatacggcagtcttctaaacccacaggccaagattgttaatgtgacagctaacctgattagcagttcttttcccgaggcaaattccgggaacgagcggaccatcctgatctcaaccgctgtgactttcgtggatgtgtcagctcccgccgaggccggctttagagcccccccggccattaatgcgcgattgccctttaattttttctttcctttcgtgtag

SEQ ID NO: 6051 - DNA, 1230 bp, Artificial Sequence
  Description of Artificial Sequence: Synthetic coding sequence
atgaagacctccgacggcttcacattaaacgccgaatcttacgtctcctttactactaagctcgatatacctactgcggccaaatacgagtatggggtgcctttgcagacatcagattcgttcttacgctttccatcttcactcactagcagcctttgtaccgataacaatcccgctgctttcctagtcaatcaggccgttaaatgcacgcgtaagatcaacttggagcagtgcgaagagattgaggctttgagcatggccttttacagctctcctgagattctgagggtcccagactcccggaagaaagtccctattacagtccagagtattgtcatacagtctctgaacaagaccctgacccggagagaggacaccgatgtcctgcagcctaccctcgtaaatgccggtcatttctcactctgtgtgaacgtcgtcttagaggtcaaatatagtctgacatacacagacgctggggaggtcaccaaagcagatctttcgttcgttctggggacagtatcatcagtcgtggtgcccttgcaacagaagtttgagatacatttcctccaggagaacactcagcctgtccccctgtccggtaaccccggctatgtggtgggattgcccttggcagcagggtttcagccccacaagggatcgggaattattcagactacgaaccgctacggccagttaactatactgcactccacaacagagcaggactgtctcgccctggagggcgtgcgtaccccggtgctgttcggttatactatgcagtcaggctgcaagctgcgactgaccggggcgctgccgtgccagctcgtggcacagaaggtgaaatccctgctctgggggcagggattccccgactacgtggcaccattcggcaatagtcaggcgcaggacatgctcgactgggttccgatccatttcattactcagagttttaatagaaaggattcctgccagctccccggtgcactcgtgattgaagtgaagtggactaaatacgggtcccttctgaatcctcaagcgaaaatagtaaatgtcacagcgaatctgatttctagcagttttccagaggccaattctggaaacgagagaaccattctgatctcaacggctgtcacgttcgtggacgtgagcgccccagctgaggctggatttcgagccccacctgcaattaatgccaggttaccatttaatttctttttcccctttgtctag

SEQ ID NO: 6052 - DNA, 1779 bp, Artificial Sequence
  Description of Artificial Sequence: Synthetic coding sequence
atgaggccaaggggactgccccctcttcttgttgtattgctcgggtgctgggcctcagtgtccgcccaaacagatgcaaccccggccgtcaccacagaggggctgaacagcacagaagccgcgctagctacatttggcacttttccatccaccaggcctccagggactccacgcgcacccggtccttcttctgggccgaggcccacaccagtaactgacgtggccgttttatgtgtctgcgacctaagccctgcccagtgtgacatcaactgctgttgcgatccagactgctcatccgttgattttagcgttttcagcgcatgcagtgtgccagtggtcacaggagacagccagttctgtagtcagaaagcagttatatacagtttgaacttcaccgcaaatccgcctcagcgtgtgttcgagctggttgaccaaattaacccttccatcttttgcatacatatcaccaactacaagcctgcactcagcttcatcaatccagaagtgcctgatgaaaataattttgatactctcatgaagacatctgacggatttacgctgaacgctgagagttacgtgagctttacaactaagttggacatacccacagcggcaaagtacgaatacggggtgcccctgcagacaagcgactccttcttgaggttcccatcaagcctcacaagctccctgtgcacagataacaatccggccgcatttctcgtcaatcaagctgtgaagtgcacgcgtaagattaatctagagcagtgtgaagagatcgaggctctgtcaatggccttttattcttcacccgaaatacttcgcgttcccgattcaaggaagaaagtccccatcacagtgcagagcatagttatacagtcgctgaataaaaccttaacacgcagagaagacaccgacgttttgcagcccaccctcgtcaatgccggtcattttagcctctgtgtgaatgtcgtgctagaggttaagtattctctgacttacaccgatgcgggagaggtgacaaaggccgacctgtctttcgtcctggggacagtatccagtgtggtggtgcccctgcagcaaaaatttgaaatacattttctgcaggagaacacccagccagtgccattgtccggtaatccggggtacgtagtggggttgcccctcgctgcagggttccagccacacaaaggctctggaattattcagacaacaaaccgttacggccaacttacaatactgcattccaccacagaacaagattgcttagccctggaaggtgtgcggacccccgtgttgttcggttacacaatgcagtcaggctgcaaattgagactgaccggtgcattaccatgtcagctggttgcgcagaaggttaagtccttgctgtgggggcagggattccctgattacgtagctccgtttgggaatagtcaggcccaggacatgcttgattgggtgcccatccactttattacccagtcttttaatcgtaagcactttgtgcttcaggatagctgccagcttcctggggctctggtgattgaagtaaaatggacgaaatacggatctctgctaaacccacaggctaagattgttaacgtgaccgccaatctgatcagtagctccttcccagaagcaaatagcggcaatgagcgaacaattctcattagcacggctgtaactttcgtggatgtgtcagctcctgcggaggcaggcttccgcgcgccgcccgccatcaatgctcgcctgccctttaacttcttcttcccattcgtctag

SEQ ID NO: 6053 - DNA, 552 bp, Artificial Sequence
  Description of Artificial Sequence: Synthetic coding sequence
atgatcttcctgctgctcatgctcagcctggagctacaattgcaccaaatcgcggcgttgttcaccgtgaccgtacccaaagaactgtacatcatcgagcatgggtccaatgtaactcttgagtgcaacttcgacaccggctcacacgtaaacttgggcgccataaccgcttccctgcagaaagtagaaaatgacacttctcctcatcgggaacgtgcaactctcctggaggagcagttaccacttggcaaagcttcctttcacatcccacaagtgcaggttcgtgacgagggtcagtatcaatgtatcatcatctatggcgtagcctgggactacaaatacttgacgcttaaggtcaaaggacagatggagcctagaacacaccccacttggctcctgcatatcttcatccccttctgtattatcgcttttatctttatcgcaacagtaattgccctgagaaagcaactgtgtcagaagctgtacagctctaaggacaccactaagagacccgtgaccaccacaaaaagagaggtgaactccgccatttag

SEQ ID NO: 6054 - DNA, 822 bp, Artificial Sequence
  Description of Artificial Sequence: Synthetic coding sequence
atgatcttcttgctgctcatgctctcactagaactgcaactgcatcaaattgccgctttattcacagtcacagtgcctaaggagctttatattatagagcatggaagtaacgtgaccctggagtgcaactttgacactggttctcacgttaatctcggggcaatcacagccagcttgcagaaggtggagaacgacacctctccgcacagggaacgcgccacattactcgaggaacagctaccgctgggtaaggcaagcttccatataccccaggttcaggtcagagacgaaggacagtaccagtgcattattatctatggggtcgcttgggactacaagtaccttacactgaaggtaaaagcgtcctaccggaagataaacacgcatatccttaaagtgccagaaaccgatgaggtggagctgacttgtcaggccaccggctacccactggccgaagtctcttggcccaatgtatcagtgccagccaatacgagccactcgcgcaccccagaaggcttgtaccaggtgacaagcgtgcttagacttaaaccgccgcctggaagaaatttctcctgtgtcttctggaacactcatgtgagggagcttactctggcaagcatcgatttgcaatcacaaatggaaccgcgcacccatccgacgtggctgctgcatatttttatccctttctgcatcatcgcttttatctttattgctacggtgattgccctgagaaaacagctgtgtcaaaagttatatagctctaaggatactacaaaaagacccgtgaccactacgaagagagaggtgaactctgcgatctag

SEQ ID NO: 6055 - DNA, 372 bp, Artificial Sequence
  Description of Artificial Sequence: Synthetic coding sequence
ctgggagacaggcggggccgtagctccggcgcccgcgctgcggccgtgggcagtaccggcgagcgtttggagatggaggaagatatactgcagctgcaagcggaggccactgctgaggttcttggagaagtggcacaggcacagaaagtgctgagggactccgtccagaggcttgaggttcagctcagaagcgcctggcttggccctgcttaccgggaatttgaggtccttaaggctcacgccgataaacagtcccacattctctgggccctaactgggcacgtccaacggcagcgccgggaaatggtcgcccagcagcacagactgcgtcaaattcaggaaagattacatacagctgctctccctgcgtag

SEQ ID NO: 6056 - DNA, 345 bp, Artificial Sequence
  Description of Artificial Sequence: Synthetic coding sequence
atggcttcatttaagctggccgattccgtgtgggaggacagtttgtctaagcgacagaggaaccagggccgcatgaaaacgttgcctgtgctggttctcagtttgacactcctgaccgtgtttagcgaaacttcacctattttaaccgagaagcaggctaaacaactactaagaagtcgaaggcaagaccgccctagcaagccaggatttccagacgaaccaatgcgggaatatatgcatcacttgcttgcgttagagcatagggcggaggaacagtttctggagcattggctgaatcctcactgcaagccccactgcgacaggaatcggatacaccccgtctag

SEQ ID NO: 6057 - DNA, 345 bp, Artificial Sequence
  Description of Artificial Sequence: Synthetic coding sequence
atggctagctttaaactagcagatagcgtgtgggaagacagtctcagcaagcggcagcggaatcaggggaggatgaaaactctgccagtgctggtcttatctctgaccttactaaccgtgttctcggagacgtctcccatcctgaccgaaaaacaggccaaacagcttctgagatcccggcgacaggatcggcccagtaagcccgggtttcctgacgagcccatgagggaatatatgcaccatctcctggctttagagcatcgcgctgaggagcagtttctcgagcactggctgaatccacactgtaagccacactgtgaccgaaatcgaattcaccccgtctag

SEQ ID NO: 6058 - DNA, 444 bp, Artificial Sequence
  Description of Artificial Sequence: Synthetic coding sequence
atggccttacaacggacacatagcttgctactccttttgctcctcacgcttctgggtctcggcctggtacagcctagctatggacaggacggaatgtaccaacgattccttcgccagcatgtgcatcctgaggagaccggcggcagcgataggtactgtaacctaatgatgcagcgcagaaagatgacactttatcactgcaagaggttcaacacttttatccatgaagacatttggaacataaggtctatctgttcaacaaccaacatccagtgtaaaaacgggaagatgaactgccacgagggagtggtgaaggtcaccgattgcagggatacaggtagcagtcgcgccccaaactgtcggtacagagctatcgcctctacaaggcgagtggttatcgcatgcgaaggtaacccccaggtgcctgtccacttcgacggctag

SEQ ID NO: 6059 - DNA, 1302 bp, Artificial Sequence
  Description of Artificial Sequence: Synthetic coding sequence
atggaaccgcaactgggtcccgaagctgctgctttaagaccagggtggctagcacttctactgtgggttagtgccctgtcctgtagcttttcattacctgcctcctccctgtctagcctagttccccaggtacgcacctcctacaacttcggccggacctttctcggactggataaatgcaatgcatgtattggaacatctatatgtaagaagtttttcaaagaagagattcgctctgacaattggctggcttcccatctcggcctgccaccggacagcttacttagttatccggccaattactccgatgactccaagatatggcgaccagtggaaatctttcgactagtaagcaaatatcaaaacgagatttcagacagacggatctgcgcctctgcctccgcgcccaaaacctgcagcattgagagagtgctgagaaagaccgagcgcttccagaaatggctgcaggctaagaggctgacgcctgacttggtgcagggcttagcctcccctctgttgaggtgcccctcccaaaggctgctggatcgtgtagttagacggtacgccgaggttgctgacgctggttccatcttcatggatcactttaccgatagggacaagctccggctgttgtatactcttgcagttaacagccacccaatcctgctgcaaatttttcctggcgccgagggatggcctctcccaaagtacctaggcagttgcggcagattccttgtgagtacgtctacccgcccactgcaggaattctacgatgctcctccagaccaggcagccgatctggcctaccagctgctgggagtccttgaaagcttgcgaagcaatgacctaaattactttttctacttcacccatatcgacgccgggatgtttggcgtgttcaataacgggcacctattcatcagggatgccagcgccgttggcgtgattgacaaacaggagggaagccaggaagctaatcgcgccggagagaataaggacatatttagctgccttgtgtccggatgccaagcacagctcccctcttgtgagtccatctccgagaaacagtcactggtccttgtctgtcaaaaactcctgccaagactgctgcaggggcggttccctagccccgtgcaggacgatatcgactctatactggtgcagtgcggcgatagtataagacccgacccagaggtgttaggggccgcgagccagttgaaggatatccttcgccctttacgtacctgcgacagccggttcgcataccggtacccagactgtaaatataacgataaattctag

SEQ ID NO: 6060 - DNA, 600 bp, Artificial Sequence
  Description of Artificial Sequence: Synthetic coding sequence
atggaaactttcccactgcttctgctgagtctgggactggtgctggcagaagcctccgaatcgactatgaagataatcaaggaggaattcaccgatgaggagatgcagtacgacatggcgaagagcggtcaggaaaaacagacgatcgaaattctgatgaacccgatattactcgtcaagaatacgagcctttccatgtctaaagatgacatgtcctctaccctgcttacatttcgctccctgcattacaacgaccccaaagggaacagctcaggtaacgataaagaatgttgcaacgacatgaccgtctggagaaaggtgtccgaagctaacggaagctgcaagtggagtaacaactttattcgtagcagcacagaagtgatgagaagagtgcacagagcgcctagctgcaagttcgtgcagaaccctggtatcagctgttgtgaaagcctggagctggaaaacaccgtttgccagtttacaaccgggaagcagttcccgcgctgtcagtaccattcagtgacttcactggagaagatcctgacagttctgacgggacactctttaatgagctggttggtgtgcggtagtaagttgtag

SEQ ID NO: 6061 - DNA, 600 bp, Artificial Sequence
  Description of Artificial Sequence: Synthetic coding sequence
atggaaactttccccctccttcttctgtcgttagggctggtgctggctgaggcctcagagtcaactatgaaaatcatcaaggaggagtttacagacgaagagatgcagtatgacatggctaagagtggccaggaaaagcaaactattgaaattctgatgaacccgattttgctagtcaagaatactagcctgtcaatgagtaaagatgacatgtccagcacccttctcaccttccgctcattgcactataacgaccccaaaggcaactcatctggcaatgacaaggagtgctgcaacgatatgacagtgtggagaaaagtctcagaggctaatggttcgtgcaaatggtcaaacaactttatacggagttccaccgaggtgatgaggcgcgtgcaccgtgcccccagttgcaagttcgttcaaaatccaggaatatcctgctgtgaatccctggagcttgagaatacggtttgtcagtttaccaccggtaaacaattcccccgctgccaataccactctgtgacaagtctggagaagatcctgacagtattaacgggtcactctcttatgtcatggctcgtgtgtggttccaagctctag

SEQ ID NO: 6062 - DNA, 291 bp, Artificial Sequence
  Description of Artificial Sequence: Synthetic coding sequence
atgttgccctgtctggccctcctcctcttaatggaactgagtgtgtgcaccgtcgccggagacgggggggaggagcagaccctgagcaccgaggcggaaacatgggagggtgcaggaccaagcatccagcttcagctacaggaagtaaagacgggcaaggctagtcagttctttggcctgatgggtaaacgagtcggggcgtatcagctcgaacatacattccaggggcttctggggaagcgtagcctgtttacagaaggaagggaggacgaagcccaaggatccgaatag

SEQ ID NO: 6063 - DNA, 981 bp, Artificial Sequence
  Description of Artificial Sequence: Synthetic coding sequence
atgaccggcctgtgcggctactctgctccagacatgcgcggcttgagacttattatgatccccgtcgagctcctgctgtgctatctcctgttgcatcccgttgacgctacttcatatggaaaacagactaacgtactaatgcattttccactgagcctggaatcccagacacctagttctgatccattgagctgccagttcctgcaccccaaatcactgccgggttttagtcatatggctcctctccccaagtttctggtaagcctagccctgcgaaatgcactcgaagaggcaggttgccaagccgatgtgtgggccctgcaactgcagctatacagacagggaggggtgaacgctactcaagtcctgatccagcacctgcgcggcctgcagaaaggccgcagtaccgaacgaaacgtgtccgtggaggcattggcaagcgctcttcagctgctcgccagggaacagcagtccactgggagggtaggaaggtccttgccgacagaagactgcgagaatgagaaggagcaggccgttcataacgttgtccagttattgcccggagtgggtacattctacaacctcggaactgctctttattatgctacacagaattgtttggggaaagcccgggaacgaggccgcgacggagcaatcgacttaggatacgacctgctgatgactatggccgggatgagcggggggcccatggggctcgctataagcgcggctctcaagcccgcccttaggagtggagtgcaacaactaatacaatactatcaagatcagaaggacgctaatatctcgcagccagaaaccacaaaagaggggctgagagccatcagcgatgtgtcggacctggaggagacgacaaccctcgcttcctttatttctgaggtggtgtctagtgctccatactggggatgggccattataaagtcatacgatcttgaccccggcgcaggtagcctggagatctag

SEQ ID NO: 6064 - DNA, 1476 bp, Artificial Sequence
  Description of Artificial Sequence: Synthetic coding sequence
atgaggtggatactctgctggtctttgactttgtgtctgatggcgcaaacggccctgggcgccttacacacaaagcgaccacaggtcgtgacaaagtacggtacgctccagggtaagcagatgcatgtgggaaagactcccatccaagtgttcctgggcgtgccattctctagacctccgctgggcatacttcggtttgctccacccgagccccccgagccatggaaggggatccgggacgctacaacataccccccagggtgcctgcaagagtcctggggacagctggcctcaatgtacgtaagcactagagagcggtacaagtggctgcggttctccgaagactgtctttaccttaatgtgtatgcaccggccagggctcctggcgacccacaattgcctgtgatggtgtggtttccaggcggcgccttcattgtgggtgcggcctcctcttacgaggggtctgatctagctgctagagaaaaagttgtgctggtatttctgcagcaccgactgggtattttcggctttttatcaacagacgattcgcacgctagaggtaactggggcctgttagaccagatggcagcattacgttgggttcaggagaacattgcggcatttgggggcgaccccggaaatgtcaccttgttcggccagtctgccggcgcaatgtcaatctcgggcctaatgatgagccctctggcaagcggactgtttcaccgtgctatcagccagagcggcaccgctttgtttcgtttgtttatcacctccaacccacttaaggtggctaaaaaagtggctcatctcgctgggtgcaatcacaattcaacccaaattttggtgaactgtctcagagccctgtctgggactaaagtgatgagagtctcaaacaagatgcggtttctgcagctcaatttccagagggacccagaggagattatatggtcaatgagccctgttgtagatggagtcgtgattccagacgatccattggtgttattaacgcaggggaaggtttcttctgtgccttatctcctgggggtaaataacttagagttcaactggcttctgccctacaatattaccaaggaacaggtgcccttggttgtggaggagtatctggataacgtgaacgagcacgattggaaaatgctgcgcaaccggatgatggacatcgtgcaggacgcgaccttcgtctatgcgactctgcaaacggctcattaccaccgggggctgagcatgggaaaagaaaaggcactgagccttcagatgatgaagtactgggctaattttgctagaactggtaaccccaatgatggcaatctgccttgctggccacgttacaataaggatgaaaagtatctccagctggacttcaccacaagggtaggtatgaagctcaaggagaaaaaaatggccttttggatgtccttgtatcagtcgcagcggccagagaagcagcggcagttttag

SEQ ID NO: 6065 - DNA, 285 bp, Artificial Sequence
  Description of Artificial Sequence: Synthetic coding sequence
atggcagccttcccacataaaatcatattttttctggtgtgttctaccctgactcatgttgccttcagcggaatttttaacaagcgggacttcacaaggtggccaaagccccgctgtaagatgtacatccctcttgatccagattataatgccgattgtccgaacgtgacagcgccagtttgtgcttctaacggacacacatttcagaacgaatgctttttctgtgtggaacaacgggagttccactaccgcatcaaattcgaaaagtacggcaagtgtgattag

SEQ ID NO: 6066 - DNA, 402 bp, Artificial Sequence
  Description of Artificial Sequence: Synthetic coding sequence
atgcgacagcggctgctccccagcgtcacaagcttgctgctagtggcactgcttttcccaggctcatcccaggctaggcatgtcaatcactctgccaccgaggccctcggggagttacgcgaaagggctcccggacagggcacgaatggatttcagttgttacggcatgcagttaagcgggatcttctgccaccaagaacccccccctaccaaggagacgttcctccgggaattcggaacaccatctgccacatgcaacagggaatttgcaggctctttttctgtcatagtggcgagaaaaagcgagacatttgctctgacccatggaacagatgttgcgtaagcaacactgatgaagaaggaaaagagaaacccgaaatggatggtcggtcgggcatttag

SEQ ID NO: 6067 - DNA, 564 bp, Artificial Sequence
  Description of Artificial Sequence: Synthetic coding sequence
atggggtgctgcggctgctcaggtggctgcggctctggctgcggcggatgcgggagcggctgcggtgggtgtggcagttcatgctgtgtgcctatctgttgctgcaaacccgtctgctgttgcgtgcccgcctgcagctgctcgtcctgtgggtcctgcggagggtcaaagggaggccggggatcatgtggggggtcaaaaggggactgtggcagctgcggcggaagcaagggtggctgtggctcctgcggttgttcacagtgcagctgctataaaccatgctgttgcagctcaggatgcggaagctcttgctgtcagagttcatgctgcaaaccatgctgctctcaatcctcctgttgcaaaccttgcagctgtagctctggctgcggcagttcttgctgtcagtcatcttgttgcaagccgtgttgctcgcagtccagctgctgcaagccatgctgttgttcatccggctgcgggtcctcatgttgccagagtagttgctgtaagccctgctgctcacaaagtagctgttgtgtgcctatctgctgtcaatgtaaaatttag

SEQ ID NO: 6068 - DNA, 564 bp, Artificial Sequence
  Description of Artificial Sequence: Synthetic coding sequence
atgaggccactagccggtgccccggtgcctaagcgccagaaatgtgatcactggaccccttgcccctccgacacttacgcctacagactgctgtccgggggcggccgttccaagtacgctaagatctgctttgaagacaacttgctcatgggtgaacaactgggaaacgttgctcgcgggataaacattgccattgtgaattacgtgaccgggaacgtcaccgctacccggtgcttcgacatgtacgagggcgataactctggcccaatgacaaagtttatccagtccgccgctcctaaatcactattgtttatggtgacgtatgacgacggttccactaggctgaataatgacgccaagaatgcaatcgaggctcttggttccaaggaaattagaaatatgaaatttcggtcatcctgggtctttatcgccgccaaagggttggagttgccctctgagattcagagagaaaagataaaccacagtgatgcaaaaaataacagatatagcgggtggccagctgagattcaaatcgagggttgtatccctaaggagcgctcttag

SEQ ID NO: 6069 - DNA, 249 bp, Artificial Sequence
  Description of Artificial Sequence: Synthetic coding sequence
atgaaaattctatgtatctttctcacatttgtcttcaccgtgtcctgcggccctagtgtgccacagaagaagactcgggaggttgcagagcgcaaacgcgagtgtcagctggtgcggggggcatgcaagcccgaatgcaactcctgggagtacgtatattactactgtaacgtgaatccgtgctgtgctgtgtgggagtaccaaaaaccaatcataaacaagattacctctaagttacaccagaagtag

SEQ ID NO: 6070 - DNA, 186 bp, Artificial Sequence
  Description of Artificial Sequence: Synthetic coding sequence
atgaaaatccatgtgtttctatttgtgctgttcttttttctagttccaatcgcaactagagtgaaatgcgcggtgaaagacacttactcatgcttcataatgcgcggcaagtgcagacacgaatgccatgattttgaaaagcccatcggattctgcactaagttgaatgcaaattgttacatgtag

SEQ ID NO: 6071 - DNA, 1056 bp, Artificial Sequence
  Description of Artificial Sequence: Synthetic coding sequence
atggggaatctgttcatgctatgggcagccctggggatctgttgtgctgcattttctgcgtcggcatggagcgtcaataactttttaataaccggccccaaagcctacctgacctacactacctcagtcgcgctcggggcccaatccggaatcgaagaatgtaagtttcagtttgcttgggaaagatggaattgcccggaaaatgccctgcagctttcgacacataaccggctcagatcggcaacacgcgaaacctcctttatacatgccataagctccgcaggcgtgatgtatatcattaccaaaaattgtagcatgggcgacttcgagaattgtggctgcgacggttccaataacggcaagacgggcggtcatggatggatttggggaggctgctctgacaatgtcgaatttggggagcgcattagtaagctgttcgtcgactcactcgagaagggcaaagatgcaagagctctgatgaacctccacaacaaccgtgccggccgtttagccgtgagagctacaatgaagcgcacctgtaagtgccatggcatttcaggctcctgttctatacagacatgctggttgcagctggcagaatttcgtgaaatgggagactaccttaaagcgaagtatgaccaggccctgaaaatcgaaatggataagcggcagctcagggctggtaactcagcggagggacattgggtccccgccgaagcgttcctcccttccgccgaagcagagctcatctttctcgaggagtcgcccgattattgtacctgcaattctagcctgggaatatatggtaccgaggggcgcgaatgtctacagaatagtcacaataccagtaggtgggagaggaggtcttgcggacggttgtgcaccgagtgcggcctccaggtggaagaaaggaagactgaagtgatctccagctgcaattgtaagtttcagtggtgttgcactgtgaagtgcgatcagtgtcggcatgtggtctccaaatattattgcgcccggtcccccggctcagcacagagcttggggaaggggtctgcctag

SEQ ID NO: 6072 - DNA, 1446 bp, Artificial Sequence
  Description of Artificial Sequence: Synthetic coding sequence
atgcaaagcaggctgctgctcctgggcgcgccaggaggacatggtggtcctgcttcccgcaggatgcgtttattattgcgccaagtggtgcagcgccggccgggcggcgaccgacagaggccagaagttcgcctcctgcacgccggctcaggtgccgacacaggcgatactgtgaacattggtgatgtgtcttacaaactcaagattcctaaaaaccccgagctcgtgccccaaaactacatttccgactccctggctcagtcagtggttcaacacttgaggtggatcatgcaaaaagacctgctcggacaagacgtgttccttatagggcctccagggccactgcgcagatcaattgcaatgcagtatctggagctcacgaaacgggaggtcgagtatattgccctcagccgcgataccacggagaccgacttgaaacaacgcagagaaattagggccgggactgccttttatatcgatcagtgcgcggttagggctgccaccgagggccggactctcatcctggaggggttggagaaggctgagcgaaatgtcctgccagtcctcaataacctgcttgagaatcgcgagatgcagctggaggatggcagatttctgatgagcgcagagcggtacgacaagctccttagagatcatactaaaaaggagctcgactcatggaagatagtgagagtgtctgaaaattttcgagtgattgccctaggcctacccgtgcctcggtatagcggcaatcccctggacccgcccctccggagtcgctttcaagctcgggatatctactatttgcccttcaaggatcagcttaaactgctgtacagcataggcgcaaatgttagtgcagaaaaggtcagccagttgctgtcatttgcaactactctctgttctcaggagagcagtaccctcggtcttccggacttccctctagactcactcgccgccgcggtgcagattttggactccttcccgatgatgccaataaaacacgccattcagtggttatacccctacagcatactcctgggccatgaaggtaagatggcggtggaaggggttctgaagcgttttgaactgcaggacagcggctcttccctgctgccaaaagagatcgtcaaggtcgagaagatgatggagaatcatgtgtcccaggcctcggtgacgatccgcattgccgataaagaagtgacgatcaaagttcccgccggtaccagactcctgtctcaaccctgcgccagcgacagatttatccagacattgtcgcataaacagctgcaggctgagatgatgcagagtcacatggtgaaggacatttgtctaattgggggcaaggggtgcggtaagaccgtgatagcgaagaactttgcagatacgctcggctacaacatcgaacccattatgttgtatcagcacaaagtgccccacatctag

SEQ ID NO: 6073 - DNA, 786 bp, Artificial Sequence
  Description of Artificial Sequence: Synthetic coding sequence
atggcaagtctcgccgtgagcaactggcctaagcccatgcccctgataccatgtctgtcttggtctaccgccagtggtgtgtttaccacaggcgtgctgagcaaatcaatcaactggcgggagctggaaaagcagtattatacccaaacggtttatgaagaagaaattattcacatgcttgagtactgcggcactgacagctttaagatgggtcaggaatttgtgaaacattttacatcttccgctgacaaactgacaaatctcaacttggtatcgcggacattaaatttagatatttccaatcaggttgtgagccagaagcccgccgattgtcacaacagctccaagacctccgtgagcgccacgtctgagggccttctccttcaagacacaagcaaaatgaagagatttaaccagaccctgagtaccaacaaaagtggctatacatctcgtaatccccagtcctatcatctgttaagtaaagagcagtcacgtaattcactgaggaaagagagtctgatcttcatgaaaggcgttatggacgaatgcacccacgtggccaacttcagcgtccccgtggaccctagtcttatcattgtggtgcaagccaaagaggatgcgtatattcctagaactggcgtccgcagcctgcaggaaatttggcccggttgtgagattaggtatttagaaggtggccatattagcgcttatcttttcaaacagggcctctttaggcaggcaatctatgatgcttttgatagattcctccataagtacgccaactag

SEQ ID NO: 6074 - DNA, 1245 bp, Artificial Sequence
  Description of Artificial Sequence: Synthetic coding sequence
atgggagtatccaaacttgacatcctgtatcgtcggctgttgctcaccaagctgtttattcgcggctggggccggcccgaagacctgaagagactgttcgagtttcgaaagatgatcggtaatcgggagaggtgccagaatttggtctcttccgactacccggtccatatcgataagatcgaggagcagtctgactgtaagatcctagatggtcattttgtcagccccatggctcactacgtaccagacattatgccaatcgaaagcgtcatcgctcgatttcagtttatcgtacctaaggagtggaacagcaaatataggccagtttgcatccatttagcagggactggcgatcaccactattggcggagaagaaccctgatggccaggccaatgattaaggaagctcggatggcaagcctgctcttagaaaacccctattacggatgtaggaaacctaaagatcaagtcagatccagcctgaagaacgtgagcgatctgttcgtgatgggcggcgccttggttctcgagtccgcagctttactacactggcttgaaagggagggatacggccctttgggaatgaccggcatcagcatgggaggccacatggcgtcactggctgtttctaactggcctaaaccaatgccacttataccctgtctaagttggagcactgcctcaggcgtgtttaccaccaccgatagcttcaaaatgggtcaggaatttgtaaaacacttcacatctagcgctgacaagttaacaaacctgaacctggtatccaggactcttaatctcgatatttccaatcaagtcgtgtcccagaaaccagccgattgtcataactcatcaaagactagtgtgtctgccactagtgagggattgctgctccaagacacatctaaaatgaagcgctttaaccagactctgtccaccaataagagcggctataccagtcggaatcctcagagctaccatctgttaagcaaggagcagagcaggaatagtcttcgtaaggagtctctgatttttatgaagggtgtgatggatgaatgtactcacgtggccaacttctcagtgccagtagacccttccctcattatcgtggtccaggccaaagaagatgcctacattcccaggacaggcgtccggtccctgcaggagatctggcccggctgtgagatccggtatctcgaggggggacatatatcagcatacctgtttaagcagggcttatttaggtag

SEQ ID NO: 6075 - DNA, 747 bp, Artificial Sequence
  Description of Artificial Sequence: Synthetic coding sequence
atgaaactgacgttttttcttggactgctcgctctaatctcctgcttcacaccctcagaaagccagcgcttcagccgaagaccctacttaccaggccagctgccacccccccccctttatcggccacgttgggtgccgccaagcccacctccaccatacgactcgcgcctgaatagccccctttcactgccatttgttcccggccgtgtgccgccaagctcattcagtcggttctcccaggcagttattctctctcaactctttcctctcgagagcatccggcagcctagattgtttcctgggtaccccaacctgcatttccctctcagaccctactatgtaggtcctattcggattctgaaaccaccttttcctcctattcctttctttctggccatatacttgcccatctccaatccagaaccccaaattaacatcactacagctgacactacgataacaacaaacccaccgaccactgctacagctaccacctcgaccagcactaagcccaccatgaccatctccagcagcacggtgcctattagttcaactcccgagccggctacgtcaatctctgccgccacccccgccgctagtacagagaacaccacgcagatactggcaaatcggccccatacagtcctgctcaacgctacagtgcaagtgactactagcaatcagactattctcagttctcccgctttcaaaagcttttggcagaagttattcgctatttttggatag

SEQ ID NO: 6076 - DNA, 231 bp, Artificial Sequence
  Description of Artificial Sequence: Synthetic coding sequence
atgggagccgccatctctcagggagcgttgatcgccattgtgtgtaatggactggtgggctttctactcctgctgctttgggtcatcctgtgctgggcttgccatagtaggagtgctgacgtcgactccctgagtgaatccagtccgaactcttcacccggaccatgcccagaaaaggccccacccccccaaaagccaagtcacgagggaagctatctgctacagccctag

SEQ ID NO: 6077 - DNA, 1536 bp, Artificial Sequence
  Description of Artificial Sequence: Synthetic coding sequence
atgttagttgacgggcctagcgaaaggccggccttgtgttttctgctcctcgcagtggccatgagtttctttggtagcgccttatccatagatgagacccgagcccacctcctgctcaaggagaagatgatgcggctgggcggcaggttagtactaaacacaaaggaagagttggcaaatgagaggctaatgaccctgaaaattgcagaaatgaaggaagccatgaggaccttgattttcccacccagcatgcacttttttcaagccaagcacctgatcgagaggtcacaggtgtttaatatcctaaggatgatgccaaaaggtgcagcattgcatctgcacgatatcggcatcgttacaatggattggctggtccgaaacgtgacgtatcgcccacattgtcatatctgcttcacccctagaggtataatgcaattcaggttcgctcatcctaccccccgcccctcagaaaagtgttctaagtggatacttctggaagactatcgcaagagggtccagaacgttaccgaatttgacgattcactgctgagaaatttcacacttgtgacacagcacccagaagttatctacaccaatcagaacgtagtctggtcgaaatttgagaccatattttttactatctccggcctcatccattacgccccggtgttccgggactacgtgttcagatcgatgcaggagttctatgaggacaatgtgttgtatatggaaatcagggcccggctccttccagtgtacgaactcagcggagagcaccatgatgaggagtggagtgtaaagacctatcaggaggtggctcagaagtttgttgagactcatccagagtttattggcattaagataatctattctgatcataggagtaaagacgtggccgtaatcgccgagtcaattcgtatggccatgggcttgcggattaagtttccaaccgtcgtggctggtttcgacttagtaggccatgaggacactgggcactccctgcatgattataaggaggctctgatgatccctgcaaaggacggcgtgaaactcccctatttttttcatgccggcgagaccgattggcagggtactagcattgatagaaacattttagatgccctgatgttgaatacaacacgaattgggcatgggtttgctctgagcaagcacccagcagtccgtacttactcctggaagaaagacatacccatcgaggtctgcccaatctccaaccaagttctgaaactggtttctgatctcagaaatcaccccgttgcaaccctgatggccacaggccatccgatggttatcagtagcgacgaccccgccatgtttggagcgaagggtctctcttacgacttctacgaggtttttatgggtattggcggcatgaaggccgatctccgcacccttaaacaattggcgatgaattcaataaagtacagcacactgctggaatccgagaaaaacacattcatggaaatttggaagaaacgctgggacaaattcatcgccgacgtcgccaccaagtag

SEQ ID NO: 6078 - DNA, 1536 bp, Artificial Sequence
  Description of Artificial Sequence: Synthetic coding sequence
atgctggttgacgggccttctgagagacccgccctgtgcttccttctgctggccgtggcaatgtccttttttgggagcgcactgtcaattgatgagacccgggcacatctcctgctgaaagagaaaatgatgcgtctcgggggtaggttggtactcaacacaaaggaagaactagcaaacgagcggctgatgaccctgaagatcgctgaaatgaaagaggctatgcggactctaatcttccctccctccatgcatttctttcaggctaaacatcttatcgaacggtcccaggtgtttaatattctgcgcatgatgcctaaaggcgccgcactgcacctacacgacataggcatcgttactatggactggctggtgagaaacgtcacctataggcctcattgccatatctgcttcactcccaggggcataatgcaattccgatttgcccaccccacaccaaggcccagtgaaaagtgttccaaatggattctgctggaagactaccgtaaaagagtccagaacgtgactgaattcgacgactctttattacgcaactttaccttggtgactcaacatcccgaggtgatttatacaaatcagaatgtagtgtggtccaagttcgagacaatcttcttcactatctctggcctgattcactacgcgcccgtgtttagggactatgtcttccgctcgatgcaggaattttacgaggacaatgtcctgtacatggagattcgtgctcggctcctcccggtgtatgagctaagcggcgaacatcacgatgaagaatggagcgtgaaaacctaccaagaagtcgcccaaaaattcgtcgagactcatccggagtttattggtattaagattatctactcagaccaccggtccaaggatgtagcagtgatagctgaatcaatccgtatggccatgggtttgcgtatcaagtttcctacagtcgtcgccggcttcgacttggttggacatgaagacacaggacattctctgcacgactataaggaggccctgatgattcctgccaaagatggtgtgaagctcccctacttcttccacgctggcgaaaccgactggcagggcacgtcgattgatagaaatatcctcgacgccctgatgctcaacacaactcggatcggtcatggatttgccctgtccaagcacccagccgtgcggacctattcatggaagaaggacatcccaatcgaggtttgtcctataagtaaccaagtcctgaagttggtgagtgacttaaggaaccacccagtcgcaacattgatggcgacaggtcaccctatggttatctcaagcgatgacccagctatgttcggcgctaaaggcttatcctacgatttttacgaagtgttcatgggaataggcggaatgaaggcagaccttcgtactctaaagcagctcgccatgaactcaatcaagtacagtacgctcctggagtcagagaaaaatacatttatggaaatttggaagaagagatgggacaaattcatcgcggatgttgccacgaagtag

SEQ ID NO: 6079 - DNA, 240 bp, Artificial Sequence
  Description of Artificial Sequence: Synthetic coding sequence
atgaagctgcactccttaatctccgtcctcctactgtttgtcacgttaatcccaaaagggaagactggcgtcataccaggccagaaacagtgcattgctctgaagggcgtgtgcagggacaaactgtgctccaccctggacgacacgatcggaatttgtaatgagggaaagaaatgttgccgcaggtggtggattcttgaaccctatcctacgccagtgcccaaaggtaaaagcccctag

SEQ ID NO: 6080 - DNA, 351 bp, Artificial Sequence
  Description of Artificial Sequence: Synthetic coding sequence
atggcagctggatctgcacctatgcaactgcacttgcgcgccaccataaggatgaaggacggcctatgcgtccccaggaagtggatttaccatctcaccgaaggaagcactgatttgagaaccgagggcaggccagacatgaaaactgaactcttcagctccagttgccccgggggtatcatgctgaacgaaaccggacagggataccaaagattcttactgtataaccgctcccctcatccaccagagaagtgcgtcgaagagttcaagtctctgacttcctgtctggattccaaagcttttctgctgacgccccgcaatcaagaagcttgtgagctctctaataactag

SEQ ID NO: 6081 - DNA, 543 bp, Artificial Sequence
  Description of Artificial Sequence: Synthetic coding sequence
caagtcattccaattaactccggggatctgtttgtacatcccctttggaatcggtcctgcgttgcgtgtggaaacgatatagcacttataaagctgagccgatcagcccagctgggcgacgcagtgcagctggcatccctcccgcctgctggagacattctgcccaatgaaacaccctgttatatcaccggctggggacgactctacaccaacggacccctccctgataaactccaggaagccctgctacccgtagtggactacgagcactgcagccgttggaactggtggggatctagtgtcaagaagactatggtctgcgccggcggcgatataaggtcaggctgtaacggtgattctggagggcccctaaactgtcctaccgaggacggagggtggcaagttcacggtgtcacgtccttcgtgtccgcctttgggtgcaatactcggcgcaagcctacagtgttcactcgcgtgtcagctttcatagactggatcgaggagaaactccagggcaacaaagcacccgaatccagaacatag

SEQ ID NO: 6082 - DNA, 1215 bp, Artificial Sequence
  Description of Artificial Sequence: Synthetic coding sequence
atgccccccttcttgatcactctgttcttatttcacagttgttgcctcagagccaatggccacctgagggagggcatgaccttgctaaaaaccgagtttgcgctacacttgtaccagtcggtagccgcatgccggaatgaaacaaacttcgtgatcagcccagccggagtctccctgccgcttgagatcctccagtttggggcagagggctccaccggtcagcagttggccgatgctctcggatacacggtccatgataagagagtgaaagactttcttcatgccgtgtacgccacactgccaacctcaagtcaaggtactgagatggaactggcatgctcgctctttgtccaagttggcacacccctgtctccctgttttgtggaacacgtttcatggtgggccaactcctctcttgagcctgctgacctgtccgagcctaactcaactgcaatccagaccagtgagggcgcctctcgtgaaacagcagggggcgggccctccgagggtccagggggttggccttgggaacaggtgtcagctgcctttgcccagctggtgttagttagcaccatgtcattccaaggcacatggcgaaagcgcttttcctcaacagacactcaaatccttccattcacctgcgcatatggccttgttttgcaggtccccatgatgcaccagacaactgaggttaattatggacagttccaggacacagccgggcaccaggttggtgtgctggaattaccctatctgggctcagccgtctccctgtttctcgtgctaccccgggacaaggacaccccattgtcccacattgagcctcacctgacagcctccacaatccacctttggactacttccctgcgcagagcccgcatggacgtttttcttccacggttcaggattcagaaccagttcaacctgaaaagtatcctgaactcttggggtgtgactgacctcttcgaccccctgaaggcaaacttgaaaggaattagtgggcaagacggattctacgtgagtgaagcaatacataaggcaaagatcgaggtgttggaagagggcactaaagcctcaggtgccacagccctgctgctgcttaagcgctcaagaattcccatttttaaggccgaccgtccctttatatactttctgcgcgagcccaatactggattcgtcttttctattggacgcgtgagcaacccgctagattag

SEQ ID NO: 6083 - DNA, 444 bp, Artificial Sequence
  Description of Artificial Sequence: Synthetic coding sequence
atggggcccgaggccctttctagtttgctgctacttctgttggtggctagcggcgacgcagatatgaagggacacttcgatcctgccaagtgtcgctatgcacttggtatgcaagatcggacaatcccagactcggacatctcagccagctcctcttggagcgacagcactgccgccaggcatagtcggttggagtcaagcgacggtgacggggcctggtgccccgccggtagcgtgttccccaaagaggaagaatacctgcaggtggacttacagagactgcacctggtcgcactggttgggactcaggggcggcacgcaggtggcctgggcaaggagttcagtcgctcctacaggctgcgatattctcgggacggccgtcggtggatgggctggaaagaccgctggggccaggaggtcattagtgggaacgaagacccatag

SEQ ID NO: 6084 - DNA, 2631 bp, Artificial Sequence
  Description of Artificial Sequence: Synthetic coding sequence
atgggcccagaggcactgtcaagccttctgctcctcctcctcgtggcctcgggggatgcagacatgaaagggcatttcgaccctgcaaagtgtcgctacgcactgggcatgcaggaccggaccattcctgatagtgacattagtgcttcctcttcatggtcggattctaccgccgcccgccacagccgactagaaagtagcgacggagatggagcttggtgtcccgccggctctgtcttcccaaaggaagaagaatatttgcaggtcgatctccagcggctgcatctggtcgcacttgtggggacacagggcagacatgccggagggctgggtaaggagttttcaagaagctaccgcctccgctactcgcgggatggtcgccggtggatgggttggaaggatcgttggggccaggaggtaatctccggaaacgaggaccctgaaggggttgtcctcaaagatctcggccctcccatggtggctcgcctggtaagattctacccacgggccgaccgtgtgatgagcgtttgcctgagggtggaactctacggttgcctctggagagacggattgctgtcctacactgctcccgttggccagacaatgtacctgtcagaggctgtttacctgaacgattctacttatgatggccacacagtgggaggacttcagtacggagggctgggccagctggctgacggggtagttggacttgatgattttcgtaagtcccaggaactgagggtgtggccagggtacgactacgtgggctggagcaaccatagtttttctagtggatacgtggagatggagtttgaattcgaccggttgcgagccttccaggccatgcaggtgcactgcaataatatgcacaccctgggagcgagacttccagggggggtcgagtgtcgctttcgccggggaccggccatggcatgggaaggtgagcctatgcgccacaatctaggtggcaacctgggcgatcccagagcccgggctgtgtccgtgccgttaggtgggcgggtggccagatttctgcaatgccggttcctgtttgctggcccctggctgctgttcagcgagatcagctttatttctgatgtcgtgaacaatagctcccctgcactcggcgggacatttccccctgcaccctggtggcctcccggtcccccacccacgaatttcagctccctggagctggaacccagaggacagcaaccggtggccaaggctgaaggttcaccaactgcgatcctcatcggttgccttgtcgcgattattcttctactcttactgattatcgccctgatgctttggagactgcactggagaaggctcctcagcaaggcagagagacgtgtgttggaggaggaactcaccgttcacctgagtgttcccggcgacacaatcctgataaacaacagacccggccctcgggagcccccaccttaccaggaaccgcggccgcgaggcaatccaccccattccgcgccctgtgtacctaacgggtccgcttactcaggtgactatatggagccagaaaagcccggcgctcccttgctcccaccccctcctcagaacagcgtgccgcactatgccgaggccgacattgtaacattgcaaggggtcaccggaggcaacacatatgctgtgcctgcattgcctcctggagctgtgggcgatggacctccacgcgtcgactttcctcggtcaaggctccgatttaaagaaaaactcggtgaggggcagtttggcgaggtccacctatgtgaggtggacagcccgcaggacctggtatctttagactttccacttaatgttcgaaaaggccatcctctgttggttgccgtgaagattctaaggcctgatgccacaaagaatgctcgtaacgactttctgaaagaagtgaaaataatgtcgcgtctcaaagatcctaacatcatacgcctactaggggtgtgcgtgcaggacgaccccctgtgcatgatcactgattacatggagaacggcgatctgaaccagtttctcagtgcccatcaactagaggacaaggccgcagagggcgctccaggagacggccaggccgctcagggtccaacaatcagctatcccatgctgttgcatgttgcagcccagatcgcttccggtatgcgctatctggcgacactgaactttgtgcatcgagatctcgccactcgtaattgcctggtgggggagaactttaccattaagatcgcagatttcggaatgagccgcaatctctacgcaggggattattatcgcgttcagggaagggccgtactgcccatacggtggatggcttgggagtgtatcctcatggggaagttcactacggcttccgatgtgtgggccttcggggtcacattgtgggaggtactaatgctctgtagggcacagcctttcggacagctgaccgacgagcaggtgatagagaatgctggggagttcttcagagatcagggaaggcaggtgtatctgtccagaccccctgcatgtccacaggggttatatgagttgatgctgcgttgctggtccagggagagtgaacagcgtccacctttctctcagctgcaccgattcctggccgaagacgctctgaatactgtgtag

SEQ ID NO: 6085 - DNA, 2631 bp, Artificial Sequence
  Description of Artificial Sequence: Synthetic coding sequence
atgggccctgaagctcttagctccctgctgctgctgctgctggtagctagcggagacgctgacatgaaaggccactttgatcctgcgaagtgccgctatgcactggggatgcaggatcgcaccatccctgatagcgatatttctgcctccagttcctggagcgacagcaccgcggccagacattcacggctggagtcatccgatggcgatggagcttggtgcccagcaggaagcgtgtttccaaaggaagaagaatatttgcaggtggatctgcagcgcttgcacctcgtggctctagtcggcactcaaggcaggcatgccggaggcctcggcaaggagttctcgagatcttatagattgcgctatagccgcgatggcagaagatggatgggctggaaggacaggtgggggcaggaagtcatatccggtaatgaagatcctgaaggtgtggttttaaaggacctcggaccacctatggttgcccgtctcgtgcgtttctacccccgcgctgatcgggtaatgtcagtgtgtctgagagtcgagctctatggatgcctctggagagatggactgttatcgtatacagctcccgtcggacaaacaatgtacctctccgaagcagtttatctcaacgactcaacctatgacgggcataccgtcgggggtctgcaatacgggggcctcgggcagttggccgacggcgttgtgggcctcgacgacttccgaaaatcacaggagctcagggtctggccagggtatgactacgtgggatggtccaatcactccttttcatctgggtatgtggaaatggaatttgagtttgacaggcttcgggcctttcaagcaatgcaggtgcattgcaacaatatgcataccctcggggccagactcccggggggcgtggagtgcaggtttagacgcggacctgccatggcctgggagggagaacccatgaggcacaatctggggggaaacctgggagaccctagggcccgggcagtctccgtacctttgggtggccgcgttgcccgtttcctgcagtgccgctttctgttcgcaggtccgtggctcctcttctctgagatcagtttcatcagcgacgtggtgaacaacagctctcccgccttgggcggcacgtttcctcccgccccatggtggcccccagggcctccaccgaccaatttctcatccttggaattggaaccaaggggacagcaacctgtggctaaagctgagggcagtcccactgctattctgattggatgtctggtcgcgataattttattactactactgatcattgccctgatgctttggagattacactggagacgcctcctgtcaaaagccgaacgacgcgtcctcgaggaggaattaacggttcacctgtccgtacccggcgacaccatacttattaacaacaggcccggtcctagagagccgcccccttaccaggaacctagaccaagggggaatccccctcattccgccccctgcgtacccaatggtagcgcatatagcggcgattatatggaacctgaaaaacccggcgcaccactgctgcccccaccaccccagaactcggtgcctcattatgctgaagctgatatagtaacgttgcaaggcgtcactggtggcaacacctacgccgtgcctgccctccctccaggtgctgtcggggacggaccgcccagggttgatttcccgcgctcacggcttagattcaaggaaaaactaggagaaggccagttcggggaggtgcacctgtgtgaggttgactcaccacaagacttagtatctctagactttcccctgaacgtgcgcaagggccatcctctgcttgtcgcggtcaagatccttcgccctgacgccactaagaacgcccggaatgatttcctgaaagaggtcaaaataatgtctagactgaaggaccctaatataattcgacttctaggagtgtgtgtgcaggatgacccactgtgtatgatcacagattacatggagaatggggacctgaaccaattcctgtcagcgcaccagcttgaggacaaggctgctgagggggctcccggagatggacaagccgctcagggcccaactataagctatccgatgttgctgcatgtggccgcacaaattgcctccggcatgcgatatcttgctacccttaattttgtacatagagatctggcaaccaggaattgcctcgtcggcgagaactttaccatcaagattgcagattttggcatgagccgaaacctctatgccggggactattatcgggtccaggggagagccgtgctgcccatccgatggatggcatgggagtgtatcctcatgggaaagttcaccactgctagcgacgtgtgggcattcggcgttactctatgggaagttctgatgctctgtagagctcagcccttcggacagcttacagacgaacaagtgatcgagaacgcaggggagttctttcgagaccaaggtcggcaggtgtacctcagcaggcctcctgcgtgtcctcaaggcctgtacgaactgatgcttcgttgctggagcagagagagtgagcaacgaccccccttctcacagctccatcgctttctggcggaggacgcccttaacactgtgtag

SEQ ID NO: 6086 - DNA, 2742 bp, Artificial Sequence
  Description of Artificial Sequence: Synthetic coding sequence
atgggtccagaggccctcagcagcctgctgctcctgttattggtcgcatctggtgatgccgatatgaaaggccacttcgacccagcaaaatgccgctacgcactgggcatgcaggataggactatccctgactccgacatctcagcttcctcctcctggtcggactcaacagccgcccgccactcccgccttgaatcgtcggatggagacggcgcctggtgccccgctggtagtgtgtttccgaaggaggaagaatacctccaagtggatctgcagcgcctgcacttggtcgctcttgtcgggactcagggccggcatgccggaggacttgggaaggagttctctaggagctatcgccttcgctacagccgggacggaagaaggtggatggggtggaaggatcgctggggtcaggaagttatctctgggaacgaggatcctgagggtgttgtcctgaaagacctagggccacctatggtggccaggcttgtaagattctaccctagagctgacagagttatgtcagtatgcctgcgcgtggaattgtatgggtgcctctggcgggacggattactttcctacacagccccagtggggcaaacaatgtacctgagcgaggcagtgtatctcaacgactccacatatgatggccataccgtgggcgggctgcaatacggggggctcggccagctggccgatggcgtagtgggacttgacgatttccgaaagtcccaagagctgagggtgtggccaggttacgattacgtgggatggagtaatcattcgttctccagcggatatgtagagatggagtttgagtttgaccggctaagggctttccaggccatgcaggtacactgtaataacatgcataccctcggtgcacgtcttccgggcggggtggaatgcagattcaggagaggtccagcaatggcgtgggagggcgaacccatgcgtcataatctgggcgggaatctcggcgatccaagggctagggctgtgagcgttcccttaggcggacgcgttgcccggtttttacagtgcagattcctgtttgcaggcccctggctgctatttagcgagatcagctttatttcagatgtggtgaacaactcatcaccggcgctgggtggcacgtttcctcctgcaccttggtggccgcccggtcctccgcccacgaacttttcaagtctagagctggaacccaggggccagcagccggtggctaaagctgaaggcagcccgactgccatcctgattggttgcctagtggcaataatactcttgctactccttatcatagccctgatgctgtggaggctgcactggcgcaggttactgtcaaaggcggagcgcagagtgctggaggaagagttgactgttcatctgtctgtgccaggcgacaccatcctgataaataatcggcccggtcccagggagcctccgccttatcaggaaccacgcccaagaggcaaccctccacacagcgctccctgcgtgcctaatggatcagctctcctgttgtcaaacccagcttacaggttgctgctagccacttacgctcgaccccccagagggcccggcccccccacacccgcctgggctaagcccaccaatactcaggcctatagcggagactacatggaacccgagaagcccggggcccctttgctgccacctccgcctcagaattccgtgcctcactatgccgaggctgatatcgtgaccctgcagggggtcaccggtggaaacacctacgcagtgccagctcttcctccaggcgcagttggagacggccctcctcgggtggattttccacgttctcggctgcgatttaaggagaaactaggcgaaggccagttcggggaggtccacctctgtgaggttgactccccacaggatcttgtgtccctcgacttcccgctgaacgttcggaagggacatccccttctcgtggctgtaaaaatcctaagacctgacgcaacaaagaacgcccggaatgacttcctgaaggaagtgaagattatgtcacgattgaaggatcctaacataatacgcctgctgggcgtttgcgttcaagatgatccactatgcatgattactgactacatggagaacggagatctgaaccaattcttatcggcgcatcagcttgaggacaaggccgcagaaggcgccccaggcgatggccaggccgcccaggggcccacaatctcttaccccatgctactccatgtggccgcgcagatagcttctggtatgcggtaccttgccacactcaatttcgttcacagggacctagcaacacggaactgcctcgtaggagaaaacttcacaatcaaaattgccgatttcggtatgagcaggaacctttacgcaggcgactactaccgggttcaggggagagcggtcttgcccattaggtggatggcttgggagtgtatccttatgggcaaattcacaactgccagcgacgtttgggcattcggcgttaccctttgggaagtgctgatgctttgccgggcccagccgttcggacaactcactgacgagcaagtaattgagaacgcaggagaattttttcgggatcagggccgccaggtctatctgtctcggccccccgcgtgcccacagggcctgtacgagctgatgctccggtgttggtctagggagtctgaacagcgaccccccttttcccagcttcaccgctttctcgctgaggacgcactcaataccgtctag

SEQ ID NO: 6087 - DNA, 444 bp, Artificial Sequence
  Description of Artificial Sequence: Synthetic coding sequence
atgggacctgaagccctgtcaagtctgcttctgctactcctggtagcctcgggagatgcagatatgaagggccatttcgatccagcaaagtgccggtacgccctcggtatgcaggacagaacaattcccgactctgatatcagtgcctcaagcagctggtccgattccacagcggctcgtcactcaaggctggaatcttccgatggcgatggcgcttggtgtcccgccgggagcgtcttccccaaagaggaagagtacctccaggtggacctacagcgtctccacctcgtcgcactcgttggaacacaaggcaggcatgctggcggcttgggtaaggaattctctcggagttatcggctccgatactcacgggatggaagacgatggatgggctggaaggacagatggggtcaagaagtgatatctggcaacgaagacccatag

SEQ ID NO: 6088 - DNA, 2631 bp, Artificial Sequence
  Description of Artificial Sequence: Synthetic coding sequence
atgggcccagaagctctgtccagtttgctgcttctgcttttggtcgcttccggagacgctgacatgaaagggcacttcgatcctgccaagtgcaggtatgcattgggtatgcaggaccgtacgatccccgactcggacattagcgcctctagctcttggtctgattcaaccgccgcccgccactcgcgcttagagtcatctgacggcgatggagcctggtgtccagccggttcggtttttcctaaggaagaagaatacttgcaggttgaccttcaacgcttgcacctcgttgccctggtgggtacgcaaggtaggcacgctggtggcttagggaaggaattctcaaggagctacaggctccgttactcacgcgatggtcgccggtggatgggctggaaagaccgttggggccaggaggtaatctctggaaatgaggatccggaaggtgttgtattaaaggacctggggcctcccatggtcgctagactagtgaggttctacccccgggccgatcgtgtcatgagcgtgtgcctgagggtggagttgtacggctgcctgtggagagatggactgctgtcgtatacagcccccgtggggcaaaccatgtacttgagcgaagccgtgtacctgaatgactcaacttatgatgggcataccgtcggagggctacagtatggagggctcgggcaacttgctgatggcgtggtggggctcgacgatttcaggaagagccaagaattgcgggtctggccgggatatgattatgtcggatggtccaatcatagcttttcttcaggttacgtcgagatggaattcgagtttgatcggcttagggcttttcaagccatgcaagtacattgtaataacatgcatacgctaggtgctaggctgcccgggggggtcgagtgcaggtttcggagaggccccgcgatggcctgggaaggagagcctatgcgccataacttgggcggaaatctcggagatcctagggcccgggccgtgagtgtgcctctcggaggacgggtcgccagattcctgcaatgccgcttcctgttcgccgggccttggctgttgttctctgagatctcattcatctctgacgtggtcaacaactcctcccccgccctgggaggtacattcccacccgcaccatggtggccccccggtcctccgccaaccaatttctcatcattggagttagagccgcggggccagcagccagttgctaaggccgagggatctcctacggccatcctgataggctgcctggttgctataatccttttactcctcttaataatcgcccttatgctttggaggctgcattggagaagactgctatcaaaggctgagcggagggtcctggaggaagaactgacagtgcatttaagcgttccaggcgacacaatattgattaacaatagaccaggtccccgggagcctcccccataccaggagccgcgacctagaggcaatccaccacatagtgccccatgcgttccaaacggcagcgcctattcaggtgactacatggaacccgagaaacctggcgcccctctgcttcctcctcctccccaaaattccgtgccccattatgctgaggcagacatcgttacgctccagggcgtgacgggcggcaatacatacgccgtcccggccctcccaccgggcgcggtcggggacggtcctccaagagtggacttccctagatcacggctgcgttttaaggaaaaactgggtgaaggtcaatttggagaagttcacctgtgtgaagttgattctccccaagacctggtttctttggacttcccgttaaatgtccgaaaggggcaccctctgctagtagcagtcaagattctgcgtccagatgccactaagaacgccaggaatgactttctgaaagaggtaaagatcatgagtagactaaaggaccctaatatcatccggctgttaggggtctgtgtgcaagacgatcccctctgcatgattactgactacatggagaatggcgatctgaatcagttcctctccgcccatcaactggaagataaggcagccgaaggggccccaggtgatgggcaagctgcccaggggcccaccatctcgtacccaatgttactgcacgtggccgcccagattgcctctgggatgcggtacctcgcaaccttaaattttgtgcatagagatcttgccacaaggaactgtctcgtgggagagaactttactatcaagattgccgacttcggcatgagcaggaatctttacgccggggattactacagagtgcagggtcgcgccgttcttcctatcaggtggatggcatgggaatgcatcctgatgggcaaattcactacagcttccgacgtttgggcattcggcgtgacactgtgggaggttcttatgttatgcagggctcagccttttggccagttaactgacgaacaggtgatcgaaaacgctggggagtttttccgggaccagggtcgacaagtctacctgtcccggcctcccgcatgcccgcaggggctttatgaattgatgctccgctgttggtccagagagtcagagcaacgtccccctttcagccagctgcaccggtttctggctgaggacgctttaaacacggtctag

SEQ ID NO: 6089 - DNA, 2631 bp, Artificial Sequence
  Description of Artificial Sequence: Synthetic coding sequence
atgggaccagaggctctttcctctcttctcctcctactgcttgtagccagtggagatgcagacatgaagggccactttgatccagccaagtgtcgatatgccctcggaatgcaagatagaacaattcctgattcggacatatctgccagcagcagctggagcgactctacggctgcgagacactctcggctggaatcaagcgatggagatggagcatggtgtcctgccgggtccgtttttcctaaggaggaagagtatctgcaggtggacctccagagactccatttggtagccttggtcgggacccaggggcgccacgctgggggccttggcaaagaattttctcggagttacaggttgcggtatagtcgtgacggacgaagatggatgggctggaaagatcgatggggccaagaggtgattagcggaaatgaggaccctgaaggagtcgtcctaaaagatctgggtccccccatggttgcgagacttgtgcgcttctatccgagagccgatcgtgtgatgagtgtttgccttagggtcgagctatatggctgcctttggagagatggtttgctgagttatacagcccccgtgggccagacgatgtacctttctgaggccgtgtatttaaatgactcgacttatgacgggcacaccgtgggcggactgcagtacggaggattggggcagctcgctgatggggtcgtgggcctcgacgacttccgaaaatctcaggagcttcgagtgtggcctggctacgattatgtcgggtggtctaatcactcgtttagttccggatatgtggaaatggagtttgagttcgatagactgcgggcttttcaggcgatgcaggtacattgcaacaatatgcatacgctgggtgccagactaccaggaggggtagagtgtaggttccgaagagggcctgccatggcctgggagggcgagccgatgagacataacttaggcgggaacttgggggatccccgtgcacgggccgtgagtgtgcctctcggcggcagggtggcgcgcttcctgcagtgccggttcctgtttgcaggtccttggctcttgttcagtgagattagcttcatatccgacgtcgtaaacaattcctcaccagcactgggtggtacctttccacccgctccttggtggccccctggcccaccccccacgaattttagcagtctggaattggaaccaagagggcagcagcctgttgccaaagctgagggctcaccgactgcgatcctcatcgggtgcttagtcgctataatcctcctgctgctgttgattatagcactgatgctgtggcgtttacactggaggcgattgctgagcaaagcagaacgccgggtgttggaggaggaactgaccgtgcatcttagcgtccctggcgacactatcctgattaacaatagaccaggcccccgggagcctcccccataccaggagcccagacctcgaggcaatcctccacactccgcgccatgtgtgcctaatggctctgcctactccggcgattacatggaacctgaaaaacccggtgccccactgctgcctccccccccccagaactccgtgcctcactacgccgaggccgacatcgtaactctgcagggcgtaacgggcggaaacacgtatgccgtgccagctctgccacccggcgcagtcggtgatggtcctccccgggtagacttcccacggagtcggttgcgcttcaaggaaaaactgggagaggggcagttcggtgaggtgcacctgtgcgaagttgacagccctcaagatttggtgtccttggatttccctctcaatgtcaggaaaggccacccgcttctcgtagccgtgaagatactgcggcccgacgccaccaaaaatgcccgcaacgattttctgaaggaggtcaaaataatgtcacgcctgaaggacccaaacatcatacgcctgttgggagtgtgcgtccaggatgaccctctctgcatgatcacagactacatggagaatggagacctgaaccagtttctcagcgcccatcagctggaggacaaggcagcggagggagctccaggggacgggcaggctgcacaagggccaaccatttcttaccccatgctactgcatgtagctgctcagatcgcgtctgggatgagatatttggctacactgaacttcgttcatcgcgatctggccacacggaactgccttgtaggagagaattttacgatcaagatcgccgatttcggcatgagtaggaacctgtatgccggcgattattatagggtccagggcagagcggtcctgcctatccgatggatggcttgggaatgtatccttatgggaaaatttactacagcaagcgatgtttgggcgttcggcgtcactctgtgggaagtgcttatgctgtgtagggctcagcctttcggtcagctgactgatgaacaggtcatcgagaacgcgggtgagttctttagagaccaaggacggcaggtctatctgagtcgcccccccgcatgccctcaaggcctttatgagctcatgctccgatgctggtcacgagagtcagaacaaaggccgcccttctcacaactacacaggtttttggccgaggatgctctgaacaccgtgtag

SEQ ID NO: 6090 - DNA, 2631 bp, Artificial Sequence
  Description of Artificial Sequence: Synthetic coding sequence
atgggccctgaagcgctctcatcgctcctgctgctcctgctagtggctagtggcgacgccgacatgaaaggacattttgacccagccaaatgccggtatgccctaggcatgcaagatagaactattcccgactctgacatcagtgcctcatcctcctggtccgacagcactgctgcacgtcatagtcgattggaaagttcagacggtgatggcgcctggtgccctgcaggcagcgtattccccaaagaggaggaatatctgcaggttgaccttcagcgcctccacctagttgcattggtgggcacacagggtcggcacgcagggggccttggtaaggagtttagtcgctcctacagactccgctactcacgggatggacggcggtggatgggctggaaagatagatggggtcaggaggtaatctctggcaacgaagaccctgagggagtcgtgcttaaggatctgggcccaccaatggtagcgcggttggttcggttctaccctcgggccgacagggtcatgtcagtatgtctgagggtggagctttacggttgcctatggcgagatggcctgttgtcatatacagcccccgtggggcaaacgatgtatctgtctgaggccgtgtatcttaacgattccacatacgatggccatacagtcggcggcctccagtacggtggcctgggacagcttgcagacggagtggtgggtctggacgactttcgtaagtctcaggagctccgtgtctggcctggttacgactatgtgggatggtcaaatcacagcttttccagcgggtacgtagaaatggaattcgagtttgacaggctaagagcctttcaggctatgcaggttcattgcaacaacatgcacacactcggcgccagactgcctgggggcgtcgaatgtaggttccgacgtgggccggctatggcttgggagggagagccaatgcgccacaacctcgggggcaacctgggtgaccctagagcacgagctgtgtccgtgccgctcggcgggcgcgtggctcgatttctacagtgcaggtttctttttgccgggccgtggctcctgttttccgagatctcttttatcagcgacgtggtgaataactcttcacctgccctgggggggacatttcccccagccccttggtggcccccaggtcctcctcctaccaattttagcagtctggaattggaacctagaggccaacagcccgtggctaaagccgaaggcagtcccactgcgatcctcatcgggtgtctggtcgctatcatactcctgctcttgcttatcatagctctcatgctatggcgattacattggagaaggctcttgagcaaggctgagcggcgcgtgttggaagaggagttgaccgtccatctgtcagttcctggggacactattctgatcaacaatcggccaggaccaagggagccaccaccataccaggaaccccggcctcgggggaatccaccgcactccgccccatgcgtgccgaatggtagcgcctattctggggattacatggagcctgaaaaacctggagcccctctgctaccaccaccgccacaaaacagcgtgccccactacgcggaggccgacatagtgaccctgcaaggcgtgaccggcggcaatacatacgcagttcctgccctccccccgggagcagttggcgacggacccccaagagttgacttcccacgttctagactgcgattcaaggaaaaactgggagaaggacaattcggtgaagtgcatctctgcgaggttgattcgccgcaggatctcgtgtcattagatttccccctgaacgtgagaaaaggtcatcccctgctggtggcggtcaagatcttgaggccagatgcaacaaagaacgcccggaacgacttcctgaaggaggtgaagataatgtcaaggctgaaggatccgaatattatacgcctgctgggggtgtgtgtgcaggatgaccctctgtgcatgattaccgactatatggagaatggcgatttgaatcaattcctctctgcgcatcagcttgaggataaggctgccgaaggggctcctggcgatggacaagctgcgcagggtcctaccatatcctacccaatgttgcttcatgtggccgcccagattgccagcggcatgaggtacctggccaccctcaacttcgtgcacagagatctagcaacgaggaactgtctggtaggggagaacttcacaataaagattgcagactttggaatgtctagaaatctgtacgcaggtgactactaccgcgtgcagggtcgggcagtgttacccatccggtggatggcttgggaatgtattttaatgggtaaatttacgacagcatcagacgtgtgggctttcggggttaccctatgggaggtcctgatgctgtgtcgagcacaacctttcggacagctgaccgatgagcaggtgattgagaatgctggcgagttctttagagatcagggccgtcaggtgtatctgtctaggcctccagcgtgtcctcaggggctgtacgagttgatgttacgctgttggtctcgggaatccgagcagagacctccattttcacagcttcataggttcctggctgaagatgccctgaacaccgtctag

SEQ ID NO: 6091 - DNA, 2742 bp, Artificial Sequence
  Description of Artificial Sequence: Synthetic coding sequence
atgggccccgaggccctcagctctcttctgctgctgctgctggtcgcttctggagatgccgacatgaaaggacattttgaccctgcaaaatgcaggtatgccttggggatgcaggaccgcactattccagactctgatatcagcgcctcctcctcctggtctgattcaacagccgcacggcacagtcgcctggagtcttccgatggagacggcgcttggtgccccgcaggcagcgtgtttccaaaagaggaggaatatctccaggtggatttgcaacggctgcacctcgtggctctggttggcacccagggacggcatgctggggggctgggcaaggagttcagcaggagttacagactaaggtattctcgcgatggccggaggtggatgggctggaaggacaggtggggccaggaggttatctccgggaacgaagatcccgagggggtggttctgaaggatctgggtccccctatggtggcaagactggtgcgattttaccctcgcgcggacagggtgatgagcgtgtgcctgcgggtcgaactgtacggatgtctctggagggatggattattaagctataccgcccccgttgggcagacgatgtacctctctgaagccgtgtacctcaacgacagtacttatgacggccatactgtgggtggcctgcagtacggaggactgggacagttagcagatggcgtcgtggggctagatgattttaggaagtcccaggagctccgcgtttggccagggtacgattatgtcggctggagcaatcattcatttagctccgggtacgtggaaatggagtttgagttcgaccgcctgcgggcattccaggccatgcaagtgcactgtaataacatgcacacactaggcgcccgcctcccagggggagtggagtgcagattcagaagggggcccgctatggcgtgggagggtgaaccaatgcgacataacctcggtggaaatctcggagaccccagagccagggctgtgtcggtccccctgggtggaagggtggcacgtttcttacagtgtcgctttctgtttgccgggccttggttactgttcagtgagataagctttatcagtgatgttgttaacaattcctccccagcacttggaggcacgtttccgccagccccttggtggccccccggtcctccacccactaattttagttcactggaactggagcctcgtggccagcaacctgttgccaaagccgaaggttccccaacggccatactcatcggttgtttggtggcaattattttgcttctgctgctcattatcgcactgatgttgtggagacttcactggagacgcctccttagcaaagctgaacgacgggtactggaggaagagctgacagttcacctgtcagtgcccggcgatactatcttgataaacaaccggcctggcccgagagagcctccgccatatcaggagccacgcccccgggggaacccacctcattcagctccttgtgtgccgaatggaagcgcattacttctctcgaaccccgcctatcggctgctccttgccacgtatgcgcggccacctaggggccccggtccaccaacacccgcttgggcaaagccaacaaacacccaggcatacagtggcgattatatggaacctgagaagccgggcgccccacttctaccacctccgccgcaaaacagcgtgccccattatgccgaagccgacatagtgactttacaaggtgtcacaggtggaaatacttacgcagtgcccgcattgcctccaggcgctgtgggcgacgggccgccaagggtggactttccaaggagcaggctgcggttcaaggagaagctgggcgaaggccagttcggagaggtccatctgtgcgaagttgattctccacaggacctggtgtccttagacttcccactcaatgttagaaagggccacccccttctcgtagccgttaaaattctgcgcccggacgccacaaaaaatgccagaaatgatttcttgaaagaagtgaagattatgagccgactcaaggaccccaatataattagactgctgggggtgtgtgttcaggatgaccctctctgcatgattactgactatatggagaatggtgatctaaatcaatttctgtctgcgcatcagcttgaagataaagcggcagagggcgcacccggagatggacaggccgcccaaggtcccacaatctcctatccaatgttgctgcatgtagccgcccagatagcctcggggatgcggtaccttgccactctgaacttcgttcatcgggatctcgcaacccgaaattgcttggtaggggagaactttacaattaagatagctgatttcgggatgtccagaaatctctacgctggcgattactaccgggtgcagggaagggcggtactccccatcaggtggatggcttgggagtgcatcctgatgggcaagttcactacagcctcagatgtgtgggcttttggtgtgactctctgggaggtcctgatgctgtgtagagctcaacctttcggccagctgactgacgagcaagtgattgaaaatgccggagagttctttcgcgatcagggacggcaagtgtacttatctaggccgccagcatgtcctcaaggtctgtatgagctgatgcttagatgctggagccgcgaatctgaacaacgcccacctttctcccagctccaccgctttctcgccgaagatgcgcttaataccgtttag

SEQ ID NO: 6092 - DNA, 2742 bp, Artificial Sequence
  Description of Artificial Sequence: Synthetic coding sequence
atgggccccgaggctctctcttccctacttctgttacttcttgtagcttctggtgatgccgacatgaaaggccacttcgacccagctaagtgcaggtatgccctgggtatgcaggatagaacaatccccgatagcgatatctccgcttcgagcagttggtccgattcgaccgccgctaggcactctcggcttgaatcctccgatggcgacggagcttggtgtccagccggaagcgtctttccaaaggaggaggaatacctgcaggtcgatctacagcgcctgcacctagttgcactcgttggtacacagggacgccacgctggcggtctgggcaaagagttttcacgctcctacaggcttaggtattcccgagacggcaggcgttggatgggctggaaggatagatgggggcaagaggtcatctctggtaacgaagacccagagggcgtggtgcttaaggacctaggtccaccaatggttgcacgtctcgtgagattctatccccgtgccgaccgagtgatgagcgtctgtcttagggtggagctttacgggtgcctgtggcgggatggtttgctctcatacactgcccccgtcggccaaaccatgtacctgagcgaagctgtttacctgaatgacagcacttacgatggacacaccgtggggggcctgcagtacggtggactcggccaactcgcagacggcgtggtggggctggatgattttcgaaagtcgcaagaactcagagtttggcctgggtatgactatgtaggatggtccaaccactcattttcatctggttatgtggaaatggagttcgaatttgatcggctcagagcattccaggctatgcaggtgcattgcaataacatgcataccttgggtgcccgactgccaggcggtgtggagtgccgctttagacggggtcctgctatggcgtgggaaggtgaacccatgcggcataatttggggggaaacctgggagatcctcgggcgcgcgctgtcagcgtgcctctgggggggagagtggctcgctttctgcagtgccggtttctgtttgcaggcccatggttgctgttctccgagatcagcttcatctccgatgtggttaataacagttctccggccctggggggaacatttccccccgctccatggtggccaccaggccctccgccgactaacttttcatcccttgagcttgagcctcgcggccagcagccagtggctaaagccgaagggtcccctacagcaatattgatcggctgcctggtggctattatcctccttctgctgttgattattgccctgatgttatggagactgcactggcgcaggttactcagtaaggccgaaagaagggtgttagaggaggagctgacagtgcatctatccgtaccaggggatacaatactcattaacaaccggcctggtccacgggagccaccaccttaccaggaaccaaggcccagaggcaacccaccacacagcgctccctgcgtgcctaatgggtctgccttgctgctcagcaatcccgcttacaggctgctgctggcaacttatgctcggcctccacgggggccagggccacccactcccgcctgggcaaaacctactaacacacaggcttatagcggagactatatggaacctgagaagccaggcgccccactgctgccacctccaccccagaactccgtgcctcactatgctgaggcggacatagtcacactccagggcgtgactggcggaaatacatacgccgtgccagcacttccaccaggcgcggtgggtgacggccccccccgagtcgactttccaagaagccggttacggtttaaggaaaaattgggggaggggcagttcggagaggtgcacctttgcgaagtcgattctccccaggatctggtgagcttggacttccctttgaatgtgcgcaaaggccatcccctgcttgtggccgttaagattcttcgaccggatgccacgaaaaatgcccggaacgatttccttaaggaggttaagattatgtcaaggctgaaagatcccaacattatcagactgctaggagtctgcgttcaagacgaccccctgtgcatgatcaccgattacatggaaaacggagatttgaatcagtttctgagcgcccatcagctggaggataaagcagctgagggagcaccaggcgacgggcaagcagcccaggggcccaccataagttaccccatgctcctccatgttgcagcccagatcgcgagcggaatgagatatcttgcaacccttaacttcgtccacagggacctggctacccgcaattgtttagtcggtgagaactttaccataaagattgcggattttggaatgtcgaggaacctctacgcgggagactactaccgtgtgcagggcagagccgtgctacccattaggtggatggcatgggagtgtattctgatggggaagttcaccacagcctcagatgtgtgggcttttggggtcactctatgggaggtgttgatgttatgccgcgcccagcccttcggccagctgaccgatgagcaggtaatagaaaacgccggggagttctttagagaccaggggagacaggtatatctgtcccgtccaccagcttgtcctcagggcctctacgaattaatgcttaggtgctggtcacgggaaagcgagcagcgtcccccattttcgcaactccacagatttttagccgaggacgcattgaatacagtttag

SEQ ID NO: 6093 - DNA, 309 bp, Artificial Sequence
  Description of Artificial Sequence: Synthetic coding sequence
atgtccgtgatgaaaccttgccttatgaccatcgccattctcatgatactggctcagaagactcccggaggcctgttcaggtcacataacggcaaaagtcgagaaccatggaatccttgtgaactttaccaggggatgtgtcggaatgcatgtagggaatatgagatccaatacctgacatgccccaacgaccagaaatgctgcttgaagctaagcgtaaagatcacatccagcaaaaatgtgaaagaggattacgactctaattctaatctaagcgtcactaactcttctagttattctcatatctag

SEQ ID NO: 6094 - DNA, 267 bp, Artificial Sequence
  Description of Artificial Sequence: Synthetic coding sequence
atgctgccagaccacttttccccactctcgggtgatataaagcttagcgtactggctcttgtcgtgctggtagtcctcgcccagacagcgcccgacggatggattagacgctgttattatgggaccggcaggtgcagaaagagctgcaaggagatcgaaagaaagaaagaaaagtgcggtgaaaagcatatttgctgcgtgccaaaagaaaaggacaagctgagtcatatccatgaccagaaagagacctctgaactgtacatatag

SEQ ID NO: 6095 - DNA, 1401 bp, Artificial Sequence
  Description of Artificial Sequence: Synthetic coding sequence
atgaaaccaccactgctggtgttcattgtttgtcttctgtggttgaaagattctcattgcgcccctacatggaaagataagacggcaatcagtgaaaatctcaagtccttctctgaggtgggggagattgatgctgacgaggaggtgaagaaggctcttacgggtataaagcagatgaaaattatgatggaaaggaaagagaaggagcatactaatttgatgtccaccctgaaaaagtgcagggaagagaagcaggaggcactgaagctgctcaatgaagtgcaggagcacctggaggaagaagaaaggttatgtcgggaaagtctggcggatagctggggagagtgcaggtcatgtttggagaataattgcatgcggatatatactacctgtcaaccctcttggagctccgttaaaaacaagattgagaggttcttcagaaaaatctaccagtttctattcccttttcacgaggataacgagaaagacctgccaatcagcgagaaacttattgaagaggacgcacaactgacacaaatggaggatgtgttcagccaactaaccgtggacgttaacagtctgttcaacaggtcctttaacgtgtttaggcaaatgcagcaagaattcgatcagacttttcaatctcattttatctctgatactgacctcaccgagccctattttttcccagcattctctaaggaaccaatgacgaaagccgatctggagcagtgctgggacatacccaatttctttcagcttttctgtaatttttcagtgagtatttatgagtctgtctctgaaactattacaaagatgctgaaggctatagaggatctgccaaagcaggacaaggcccccgaccatggtgggctgatatctaagatgctcccaggacaggatagagggctgtgcggagaactcgatcaaaatctatcgaggtgctttaagttccacgagaagtgtcagaagtgtcaagctcacctttcagaggattgcccagacgtccccgccctgcacaccgagctggacgaggccatccggctggtaaatgtgtccaatcagcaatatggccaaatcctgcagatgacaaggaagcacctggaggacactgcttacctagtcgagaaaatgcgtggtcagtttggttgggtgtccgagttagccaaccaggcccctgagactgagatcattttcaactctatccaggtggttccacggatccacgaggggaacatctccaaacaggacgaaacgatgatgacagatctgagcattttgccgtcgagcaactttaccctgaagatcccgcttgaggagagcgccgaaagctctaactttataggctatgtcgtggccaaagcacttcagcactttaaagaacattttaaaacatggtag

SEQ ID NO: 6096 - DNA, 207 bp, Artificial Sequence
  Description of Artificial Sequence: Synthetic coding sequence
atgaaactctgcgtaactgtcctgagcctgctcgtccttgtggccgctttctgctctctggctttgtcagctcctactaaatcatcagagtggaaactacagggggtgtgcttccagtgttgcagtggaaaagaccccatccatcaaagctgtccaacgtggacaatggtgcgccagaggaagatgcccacaaccggaaagggctag

SEQ ID NO: 6097 - DNA, 420 bp, Artificial Sequence
  Description of Artificial Sequence: Synthetic coding sequence
atgtataaactcgccagttgttgcttgctgtttattggcttcctcaaccccttactatctctgccactgctggattccagggaaatttctttccagttgagcgctccccacgaagacgcacgtctgaccccagaggagcttgagagagcctcacttctgcagatactgccggaaatgctgggagctgagcggggagatattttacggaaggccgacagctcgacgaacatctttaacccaagaggaaacttacgtaagttccaggatttctcaggccaagatcctaacatcttgctgagccaccttctggctaggatatggaagccctacaaaaagcagcggcgaaagcttcggcaggacctgcggctttggaagaaggaacccgggctccgtatatttaaaaactacgtttacatatag

SEQ ID NO: 6098 - DNA, 1974 bp, Artificial Sequence
  Description of Artificial Sequence: Synthetic coding sequence
atgagaaccgtagttctcacgatgaaagcatcagtgatcgaaatgttcctcgtcctcctcgtcactggagtgcattctaacaaagagacggcgaaaaaaataaaacgcccgaagttcacggttcctcagatcaactgtgatgtaaaggcgggcaaaatcatcgaccccgagttcatagtcaaatgtcctgcaggctgtcaggaccccaaatatcacgtatatggcacagatgtgtacgcaagctacagttctgtgtgtggcgcggcagtgcatagtggggtcctggacaactctggggggaagatcctcgtgcggaaagtcgcaggccagtcaggctataagggtagttactcaaacggcgtacagtctctatcattgccaaggtggagggagtctttcatagtgctcgagtctaaaccaaagaagggcgtcacctatccatccgctctgacatactcatctagtaagtccccagcagcccaggcaggggaaacgaccaaagcgtatcagagacccccaatcccagggaccacagcccagcctgtaacattgatgcagcttctagcagtgacagtggccgtcgccacacccactactcttccacgacctagcccatcagcagcaagcactacttcgatcccacgccctcagtcagttgggcaccgctcccaagaaatggatctgtggagtaccgccacctatacctcttcccagaatcggcctcgcgcagatcctggcattcagaggcaggacccttccggtgccgcttttcagaagcccgtgggcgctgatgtgagcctggactgcaagatcgacttatcgttccttattgatggcagtacttcaataggcaaacggagatttcgaattcagaagcagttgttggccgatgtggcgcaggccctggatatcggacctgctgggcctctcatgggggttgtgcagtacggagataatcctgcgacccacttcaatctgaagacgcatacaaatagtcgggatctgaagactgccattgagaaaataacgcaaagaggcggtctatcaaatgtgggcagagcaattagtttcgtgactaagaatttcttcagcaaggcaaacgggaatagatctggggcacccaacgtcgtagtggtgatggtggatggctggcccacagataaggtcgaggaggcgagccgcctggccagagagtccgggatcaacattttttttattacaattgagggcgcggctgagaacgaaaagcagtacgtggtagaaccgaacttcgccaacaaggctgtgtgccggaccaatggcttttactccctgcacgtgcagtcctggtttggactgcacaagacattacagcccctagtcaagagggtgtgcgacacggatagattagcttgtagtaagacgtgtttgaacagcgcagacatagggttcgtcatcgatggctcgtcatccgttggcacggggaactttcgcacagtactgcagttcgtgaccaatctcacaaaggaattcgaaattagcgataccgatactagaattggagccgtccaatacacatacgagcaacgtttagaattcgggttcgacaagtactcttccaaaccggacattctcaacgcaatcaaacgcgtgggatactggagcggggggacatcaactggagcggcgattaatttcgctctcgagcagctgtttaaaaagagcaaacccaataagagaaagctgatgatcctaattaccgatggaagaagttacgatgacgttcggatacctgcaatggccgcacacctgaagggtgtcattacgtacgccatcggcgtcgcatgggccgcccaggaagaactggaagtcatagccacccaccctgctagagaccactcatttttcgtcgacgagttcgacaacctgcaccagtacgtgcctcgtatcattcagaacatctgcactgaatttaattcccaaccccggaactag

SEQ ID NO: 6099 - DNA, 3975 bp, Artificial Sequence
  Description of Artificial Sequence: Synthetic coding sequence
atgcggcacggagtggcgtgggctctcctcgtcgctgcagctctaggccttggagccaggggcgtcagaggcgcagtcgcattggctgatttctatcctttcggagctgagcggggagacgctgttactccgaaacaggatgacggaggcagcggtcttagacccctttcagtgccctttcccttcttcggtgctgaacactctggtttatatgttaataacaacggcatcattagcttccttaaggaggtctcccagtttacgcctgttgcatttcctatagcaaaagatcgttgcgtagtggccgccttttgggctgatgtggataatcgccgcgccggcgatgtgtactatagggaggcaaccgatcccgcgatgcttcggagagctaccgaagatgtaaggcattacttcccggagttactggacttcaacgctacctgggtctttgttgccacctggtatagggtcacatttttcggaggttcatcctcttccccagtcaataccttccagaccgtgcttattacagatggaaagttgagctttaccatttttaactatgaaagtatcgtctggactacgggtacgcacgcctcgagcgggggaaacgctaccggactaggcggcatcgcagctcaggccggctttaatgccggcgacggacagaggtatttcagtattcctggaagtcggactgcagacatggccgaggtggagactaccactaatgttggggttccgggtcgctgggccttccggattgatgacgctcaggtcagggttgggggttgcggtcacaccacctcagtgtgtctcgcactacgaccctgcttgaacggtggcaagtgtatcgatgactgcgtaacgggaaatccatcatatacatgcagctgcctgtcaggctttacagggaggagatgtcacctggatgtcaacgagtgtgccagtcaaccctgccagaacgggggaacatgcacccacggtataaatagctttagatgccagtgccctgcgggattcggcgggccaacttgcgaaaccgcacagagtccatgtgacaccaaagagtgccagcatggagggcagtgtcaggtcgaaaacggatccgcagtttgcgtctgtcaggccggatacacaggtgcagcctgcgagatggacgttgatgactgttctcctgatccatgcttgaacggaggatcttgcgtggatttggttggaaactatacatgcctatgcgccgagccttttaagggccttagatgtgaaactggcgaccacccggtgcccgacgcttgcctgagcgccccctgtcataatggcggcacttgcgttgatgctgatcagggatacgtgtgcgaatgtcctgagggatttatggggcttgattgtagagagagggtccctgacgactgtgaatgccggaacggagggagatgcctgggcgctaacactaccttgtgtcagtgcccactcggctttttcggtttactttgtgagtttgaaatcacggcgatgccctgcaacatgaacacgcagtgcccggacggcggatactgcatggagcacggaggctcctacctgtgcgtatgccataccgatcataacgcctcccacagtcttccttcaccatgtgactccgatccgtgtttcaatggcggatcatgtgacgcccacgacgattcttatacatgcgaatgcccgcgtggattccatgggaagcattgtgagaaggcacgtccccacctgtgtagctctgggccctgcaggaatggagggacctgcaaagaggcagggggagaatatcattgctcatgtccctatcggtttacaggacgccactgtgagattgggaagcctgattcatgcgcatctggaccctgccacaacggcggcacttgtttccactacatcgggaaatacaaatgtgactgcccgcccggcttcagtggccgacattgtgaaatcgcccccagcccctgcttcagatccccatgtgtgaacggaggtacatgtgaggaccgagacacagactttttctgtcactgccaagctggctacatgggccgacggtgtcaggccgaagtggattgtggcccacccgaggaggttaagcacgccactttaagattcaatggaactcggttaggagctgttgccctctacgcctgcgaccggggttactcactttctgccccttcccgtatcagggtctgccagcctcatggggtgtggagcgagccccctcagtgcctggaaattgacgagtgtcggtcccaaccttgtctgcatggaggcagttgccaagaccgggttgcaggatatctctgtctgtgctccacgggatatgagggcgcccactgcgagttagagcgcgacgaatgccgggcccacccttgtaggaatggtgggtcgtgcagaaatctgccaggcgcgtatgtttgtagatgccccgctggcttcgtgggcgtgcactgcgagactgaagttgacgcttgtgattcctctccttgtcaacacggcggtagatgtgagtctggcgggggggcatatctgtgtgtgtgtccagaaagtttctttggctaccactgcgagaccgtgtcagatccatgcttctcttccccgtgtggcggccgaggctattgtctagccagcaacggatcccactcgtgtacttgcaaagtcggctacacaggggaggattgcgccaaggaactgtttcctcccactgctctgaagatggaaagagttgaagagtctggggtctccatctcttggaacccacctaacgggcccgccgcgcgccagatgctcgatggatatgcagtcacctacgtttcatcagacgggtcatacaggcgcaccgactttgttgatcgcacccgctccagccaccaattgcaggccctggctgcaggtagagcgtacaacattagcgttttcagcgttaagagaaactctaataacaagaacgatatctcccgcccagccgtcttacttgcaagaacacgcccccgccctgtggaggggttcgaagtgactaatgtgacagcaagtacaatctctgtgcaatgggctttgcatcggatccgccacgccaccgtctctggcgtgcgcgttagcattcgccaccccgaggcactgcgggaccaggcaaccgacgtagaccggagcgttgataggttcacctttcgcgccctgctgcctggaaaacgttacacaatccagctgaccaccttaagcggattacgaggagaagagcatcccactgagagcctggctaccgctccaacacacgtttggactaggcctctccctcctgccaatctgactgccgccagagtcacagccacctctgcccatgtggtctgggatgcgcctacaccagggagcttgctggaggcctacgtgatcaatgttactacaagccagagtaccaaatccaggtatgtgccgaatggcaaattggccagttacacagtccgtgatttactccccgggcgaaggtaccagctttcagtgatcgccgtccagagcaccgaattgggtccacagcattccgagccggcccatctgtacattattacttccccgagagatggtgccgacagacgttggcatcaggggggtcaccaccctcgggtcctgaagaacaggcccccacctgcccggttgcccgagctcagacttctgaatgaccacagcgcgcctgagactccaactcagcctccccgcttctctgagttggtggatggccgcggacgagtttccgcccgcttcggcggatctccctccaaggctgcaactgtcaggtctcaacctactgcgagcgcccagctggagaacatggaggaggcacctaagcgggtgagcctagcacttcagctgccggaacacgggagcaaagacatcggctctgaaagtgccgctctagtaggtaccctgggattgaccgactgctcccagggaccatag

SEQ ID NO: 6100 - DNA, 732 bp, Artificial Sequence
  Description of Artificial Sequence: Synthetic coding sequence
atggggatcttcctggtttacgtgggtttcgtgtttttcagtgtgctgtatgtacaacagggattatcatcccaggccaagttcacagagtttccccggaatgtcacggccacagagggccagaacgttgaaatgtcttgcgccttccagagcggatcagcatcggtttatctcgagatccagtggtggtttctgcggggtccagaggatcttgatcctggcgccgagggcgccggcgcacaagtagaactcctgccagaccgggatccagactctgatggtaccaagatatctacggtgaaggttcagggcaatgatatttctcataagctgcaaatcagcaaggtgcggaaaaaggatgagggactctatgagtgtagggtgaccgacgccaattacggggagctccaggagcataaagctcaggcctatttgaaagttaacgcaaactcccacgcccgacgcatgcaggctttcgaagcgagtccaatgtggctgcaggacatgaagccaagaaagaacgtgtccgccgcaattccaagcagcatccacggtagtgccaatcagcgaactcactccaccagcagcccgcaggtggtggccaaaatccctaagcagagcccccagtctggtatggaaacgcattttgagccttttatccttcccctgacaaatgcaccgcagaagggacagtcttaccgcgtggatagattcatgaatggtgatttttag

SEQ ID NO: 6101 - DNA, 1218 bp, Artificial Sequence
  Description of Artificial Sequence: Synthetic coding sequence
atgtggtatgtgtccaccagaggggttgctccaagagtgaatttcgaaggcgcccttttttccggctatgccccggacggtgggctgtttatgcctgaggagttgccccagctggataggggcaccctttgccaatggtcaaccctctcttatccgggcctggttaaagaattatgtgcccttttcattggttccgagcttctcccgaaagacgagttgaatgacctaattgatcgcgccttttcccgctttagacatagagaggtggtgcatctctctcgccttcgcaacggtctcaacgttctcgagctatggcatggagtcacatacgcctttaaggatctgtctctttcatgcacaacccagtttctgcagtacttcctggagaaaagggagaagcacgtgacggtagtcgtgggcaccagcggagacaccggatccgcagcgatcgagtctgtgcagggggccaaaaacatggatatcattgtcctgctgcctaagggccattgcacaaagattcaagaactccagatgactactgttctcaaacagaacgtgcatgtcttcggagtggaaggcaattcggatgagctggatgaacctatcaagacagtgtttgctgacgtggccttcgtgaagaagcacaacctcatgtccttaaactctatcaactggagtcgggtactggttcaaatggcacaccacttcttcgcctactttcagtgcactccctctctcgacacgcatcccttaccacttgttgaggtggttgttccaaccggcgcagcaggaaacctagcggccggctacatcgcacaaaagattgggctaccaatcagactcgtggtcgctgtgaaccgcaatgacattattcacagaacagtccaacagggcgatttctccctttccgaagctgtgaagtcaaccctcgccagtgctatggatattcaggttccctacaacatggagcgagtattctggctcctttcagggtctgacagccaagtcacaagggcactgatggaacagttcgaaagaacacaatccgtcaatctacctaaggagctccattcgaagtgggagcgccaggattacgaaaaaatggccgtgatggagtgtgatgggtgctgcgtggagctctgcctaggcaattgcggccctaggagaggaagcgttaccgacatcccgggtaccgcaatggtaagaggagggggatag

SEQ ID NO: 6102 - DNA, 573 bp, Artificial Sequence
  Description of Artificial Sequence: Synthetic coding sequence
atgcggacagtggtcttgacaatgaaggcctctgttatagaaatgtttctcgtgctgctggtgacgggagtgcacagcaacaaggagacggccaaaaagatcaagaggccgaagtttacagtaccccaaattaactgcgatgtcaaggcagggaaaattatcgacccagagttcattgtgaagtgtcctgcaggatgtcaggaccccaaataccacgtctacgggaccgatgtgtacgcctcatatagttcagtctgtggagcagccgttcactccggagtgcttgataactccggtggtaaaattctcgtacgtaaggtggcagggcagtcaggctacaaaggtagctattcaaacggtgtgcaaagcctgagcctgcctaggtggcgcgagagttttatcgtgctggaatccaaacctaagaagggcgtaacatatccttctgccttaacttacagctcatctaagagccctgccgcccaggcggacctttggagtacagctacatacacctcatcccaaaataggccgagagccgaccccgtgcagcggcaaccgtgttactccctgtag

SEQ ID NO: 6103 - DNA, 399 bp, Artificial Sequence
  Description of Artificial Sequence: Synthetic coding sequence
atggcaccctcaccgcggactggctcccgacaggacgcgaccgcccttcccagcatgagctctacgttctgggcctttatgattctcgcttccctgttgattgcgtactgctcacagctggccgcaggaacttgcgaaattgtgacgctggatagagactcatcccagccacggaggactattgctagacagacagctaggtgtgcatgccgaaagggccagatcgccggaaccactagagcccggcccgcttgcgtcgacgcaagaataattaagacaaaacagtggtgcgacatgcttccatgcctcgaaggcgaaggttgcgacctcctgatcaaccgaagcgggtggacctgtacgcagccaggtggcagaatcaagaccacgacagtctcctag

SEQ ID NO: 6104 - DNA, 957 bp, Artificial Sequence
  Description of Artificial Sequence: Synthetic coding sequence
atgctcccccttaccatgacagttctcattctgcttctgctgcccacgggacaggctgcaccgaaggacggagtcactagacctgacagtgaggtacagcaccaacttctgcccaacccctttcaaccgggccaggaacaactggggctcctgcagagttatctgaaaggccttgggcgtacagaggtgcagctggagcacttgtcacgcgagcaggtcctactgtatctgttcgctcttcacgattacgaccagtcagggcagctcgatggcctagaactgctgagtatgcttaccgccgctctcgctcccggggccgctaatagcccaaccaccaaccccgtaatcctaatagtggacaaagtgctcgaaactcaggacctaaacggagatggtcttatgacccccgccgaactcataaacttcccaggcgttgccctcaggcatgtcgaaccaggggagcctttggccccatctcctcaggaaccccaggccgtgggtcgtcaatctttacttgctaaatctcctctcagacaggagacacaggaggcacccggacctcgcgaggaggccaaagggcaggtcgaagctcggagggagtccctcgacccagtgcaagagcctggagggcaggccgaggccgatggcgacgtgccaggcccccggggagaggccgaggggcaagccgaggctaagggggatgcacccggcccacggggcgaagcaggaggtcaggcagaggcagagggcgatgctcctgggccacggggagaagccggcggccaggccgaagccgagggcgacgcacctggtcctagaggagaggccggcggacaggcagaggcgagagaaaatggtgaagaagctaaagagctgcccggtgagactttggaatcaaaaaatacacaaaatgattttgaggtgcacatcgtgcaggtcgagaatgacgagatctag

SEQ ID NO: 6105 - DNA, 399 bp, Artificial Sequence
  Description of Artificial Sequence: Synthetic coding sequence
atgctgcccctaaccatgaccgtgctcatccttttgctgttgccgaccggtcaggcagccccaaaagacggagtcacacgcccagacagcgaagtgcagcatcagctccttcctaacccttttcagccaggtcaggaacagctgggcttgctgcagtcttatctgaaggggctgggtcggacagaggtacagctggagcacctatcgcgcgagcaagtgcttctctatttgtttgcccttcacgactacgaccaatctggccagctcgacggactggagttattgagcatgcttacggccgctctggctcccggggcagcgaacagccccactacaaaccctggaaatttggatgccaggttggatggaggtgagaaagcgatgcagccacagtggtag

SEQ ID NO: 6106 - DNA, 732 bp, Artificial Sequence
  Description of Artificial Sequence: Synthetic coding sequence
atgcttctaagtctcctaggcgcatgcgcggtggtcggccctttccacggccccgagtgggaacccgtccaaggcctgctcagtcaaaatcatagttgtagagacccccaatgctgcggcaatctcctcgttttatgcctcttcctggtctggcaggtgagacattgttggcaccaggtaacgcgcacccgattctctacacgcaatgtgatcaaagtgcccctacagaaaagagctgtgccgagcatgagatgcgagaccgtattcaagcttacacccgaatttttttctcccggcaagagtcggggtctggattcacagcaatgtgcccaaagacagcggtggggttacagaaggtccctgcaggagagttgggcccaaaacctgctgagccctcagcatccctgccctgggccccccagtggggtacacacacacagtgaacccattttctgtaccacgtctatttccaacacatgcctgttgccccagaattcaagttggaaggcctggcaggtgccttggtgcctacacgatggacagactagaccagcactcgacatgtgtcaggagatggagcagctgttactacactcccaggagcgtctggtctcactggaacccgtcatatccgttcgtagccgcccgacgagtatgactcttactacaagcttacccaacctgttgtctgctgaacgattgcagttttgcccgcaacgggcaccagcctag

SEQ ID NO: 6107 - DNA, 2505 bp, Artificial Sequence
  Description of Artificial Sequence: Synthetic coding sequence
atgaagcacaccttggccctgctggcccctctccttggtctggggctgggtctggcactatcccagttagcagcgggtgcaacagactgtaagttcttgggcccggccgagcacctgactttcactcctgccgctagagcccgatggctggcccccagagtgcgagctccaggtcttctggattccttatatgggacagtgagaagattcctgagcgtggtccagctaaacccttttccttctgaactcgtaaaggctctgctgaacgaacttgccagcgtgaaggtaaatgaggtggtgaggtatgaagccggctacgtggtgtgtgccgtgatcgcgggcctttacttactgctagttccaaccgcaggtttgtgcttctgctgttgcaggtgccataggaggtgcggtggaagggtaaaaaccgagcacaaggcactcgcctgtgaaagagctgccctgatggtgttcttgctcctgaccacactcttactgctgatcggcgtcgtctgcgccttcgtcaccaaccagcgcactcatgaacagatgggtccctccatcgaggccatgccggaaacgttgttatccttatgggggcttgtgagtgacgtcccccaggaactgcaagcagttgcccagcagttcagtctacctcaggagcaggtgtctgaggagttagatggcgttggcgtctccataggaagtgcaatccacacccagctacggtcctcagtgtatcctctgttggcagccgtggggagccttggccaggtgctgcaagttagtgtgcaccatctgcagaccctcaatgcgacagtggtagagctgcaagccggccaacaggatctggaaccggcgatcagggagcatcgggaccggctgctggaacttctccaggaagcgcgttgtcaaggtgactgtgccggcgcactctcttgggcgaggacactggagctgggagctgacttttctcaggtgccaagcgttgaccacgtgctacatcagttaaagggcgtgccagaagccaatttttcctcaatggtacaagaggagaatagcacttttaacgcactgcctgctttggccgctatgcagacatccagcgttgttcaggaactgaagaaggcggtggctcaacagcccgagggagttcggacattggcggaaggatttccaggcctggaagcagcaagccggtgggcacaggccctccaggaggtcgaagagagttcaagaccctacctgcaggaggttcagagatacgaaacttatcggtggattgttggttgtgtgctatgttccgtcgtgctttttgtggtgctttgcaacctcctgggtctgaacctcggtatctggggactctccgcccgagacgatccgtcccaccctgaagcaaagggagaagccggggcaagatttctgatggcgggagtcggactttctttcctgttcgcagcccccctaatactgctcgtgtttgcaacctttcttgtcggtggaaacgttcagacgctagtgtgccagagttgggagaatggcgaactcttcgaattcgctgacacgcctggcaaccttcccccgagtatgaacctgtcccagctgctgggcctgagaaaaaacatcagtatccatcaggcataccaacagtgcaaggagggagccgccctgtggacagttctgcagctgaacgactcctacgatctagaggaacatctagacataaaccagtatacaaacaagctgaggcaggagctgcagtctcttaaagtggacacgcagtcactagatctgctgtccagcgccgctcgacgcgacttagaagccctacaatcgtctggccttcagagaattcattatcccgacttcctcgtgcagattcagagacccgtggttaagactagcatggaacaactcgcccaagaactgcaaggcctagctcaagcacaggacaattccgtactcggccaacggctccaggaagaggctcagggactgcgtaacctgcatcaggagaaggttgtgccccaacagtctctcgtggcgaaactgaacctgagcgtccgtgccctggaaagctcagctccgaacttgcagttagagacctccgatgtactcgccaatgtgacatacttaaagggggaactcccagcatgggcagctcggatcctccgcaacgtctcagaatgtttcctagccagggaaatggggtatttttcgcagtacgtggcatgggtccgtgaagaagtcactcagcgcatcgctacctgccagccactgagtggggcactggataatagccgggttattctctgcgacatgatggcggacccttggaatgcattctggttttgcctagcttggtgtacctttttcctgatcccatccatcatttttgccgtgaaaacgtcaaagtacttccggcctatccgcaaacgactgagttcaaccagcagtgaggagacccagcttttccatatcccacgcgtgacatccctcaaactctag

SEQ ID NO: 6108 - DNA, 1185 bp, Artificial Sequence
  Description of Artificial Sequence: Synthetic coding sequence
atgtggaggtgtccactcgggttattgctcttactgcccctcgctggccatctggccctaggtgcacaacagggacggggtcggagggaactggccccgggcctgcacctccgcggaatccgcgacgcgggcggccgatactgtcaagagcaggacctctgttgcaggggccgggctgacgactgcgcactgccctatctgggagccatatgttactgtgatctgttctgcaatcgcactgtcagcgattgctgccctttccctcccatccagggctgcatgcatggaggccgtatttacccagtgctcggcacttactgggacaactgcaacagatgtacctgccaagaaaatagacagtggcagtgtgaccaggaaccatgcttggtcgatccagatatgattaaggccattaaccagggcaattacgggtggcaagccgggaatcatagtgctttctggggaatgacgcttgatgaagggatcaggtatcgactgggcaccatacgtcccagctccagcgttatgaacatgcacgaaatttacactgttctaaatcccggcgaggtcctgccaacggcattcgaggcaagtgaaaaatggccaaatctaatccacgaaccattggatcagggcaactgcgcaggcagctgggctttctccactgccgcagtggcttccgaccgggtctccatccactcactcggccacatgaccccggtcctgagtcctcagaacctgctctcatgcgacacccaccaacaacagggatgcaggggcggtagactggatggcgcctggtggtttttgaggcgacggggagtggtctctgatcactgttacccatttagcgggagagagcgcgacgaggctggtcctgctcccccttgtatgatgcattccagggcaatgggaaggggcaagagacaggctacagcccattgtccaaactcgtatgtgaataataacgatatttaccaggtgacgccagtatatcgcctcggctccaacgataaggagattatgaaggaactgatggagaatggaccagtccaggcactgatggaggtccatgaggatttcttcctttataagggcgggatttacagccacaccccagtaagtctgggccgccctgagcgctataggagacacggtacacattcagtgaagatcaccggctag

SEQ ID NO: 6109 - DNA, 303 bp, Artificial Sequence
  Description of Artificial Sequence: Synthetic coding sequence
atggctgcagcgctggcactcgtcgcaggggtgctctccggggccgtcctgccactctggagcgcactcccccagtacaaaaaaaagatcaccgaccgttgttttcaccatagcgaatgctacagcgggtgttgcctcatggacctggattccgggggtgccttttgtgccccacgtgcccgaatcactatgatttgcttgccacagaccaaaggagctacgaatattatttgtccatgtaggatgggccttacctgcatcagtaaagatctgatgtgttcaagaagatgccacatgatttag

SEQ ID NO: 6110 - DNA, 978 bp, Artificial Sequence
  Description of Artificial Sequence: Synthetic coding sequence
atgagattaccaagacgcgccgccctcggccttcttccccttcttctcctgctgcctccagcgcccgaggctgcgaaaaaacctacgccgtgtcatcggtgccggggcctggtcgataagttcaatcaggggatggtggataccgccaagaaaaacttcggtggtgggaatacggcttgggaggaaaagactctgtctaaatacgagtccagcgaaatcagactgctggaaatactagagggcctatgcgaatcatcagactttgagtgcaatcaaatgctggaggcccaggaagagcacttggaagcttggtggctccagctcaaatccgaatacccggacctgtttgagtggttttgcgttaaaactctgaaggtctgctgcagtcccggaacatatgggccagattgcctggcttgtcaaggagggagtcagagaccatgcagtggcaacggtcattgttcaggtgacggttcgcgccagggggacggatcatgtaggtgtcacatgggctatcaggggcccttatgtactgactgcatggacggatatttcagctcgctgaggaatgagactcactccatctgtactgcctgtgatgagagttgcaaaacttgttctggcctgactaacagggactgtggtgaatgtgaggtgggctgggtcctcgatgaaggagcctgtgtcgaatgcgacagcagttgcgtgggttgcaccggtgaaggaccaggcaactgtaaggaatgcatttccggctatgccagggaacacgggcagtgcgctgatgttgacgagtgctccttggcagagaaaacttgcgttcgaaaaaatgaaaattgttataacaccccggggtcatacgtatgtgtgtgtccagacggattcgaggaaaccgaggatgcttgtgtgccaccagctgaggctgaggccaccgagggtgagagtcccacccagcttcctagtagggaggatctgtag

SEQ ID NO: 6111 - DNA, 459 bp, Artificial Sequence
  Description of Artificial Sequence: Synthetic coding sequence
atgcgtggtcctgggcatcctttgcttctcggtctcctgctcgtgcttggggctgctggccgcgggcggggtggggctgagcctcgggaaccagcagacggtcaggcccttctgagactggtcgtggaactggtccaggaattgaggaaacaccactcagccgaacacaagggcttgcagctgctggggagagactgtgcgctcggccgggccgaagccgcaggcctcggcccgtcaccagagcagcgagtggagattgtgcccagagacttgaggatgaaggataagtttttgaagcatctgacagggcccctgtacttctctccaaagtgtagcaagcatttccataggctttatcacaataccagggactgcacaattcctgcctactacaagaggtgcgcccggctgctgactcgcttagctgtttcaccagtctgtatggaggataaacaatag

SEQ ID NO: 6112 - DNA, 411 bp, Artificial Sequence
  Description of Artificial Sequence: Synthetic coding sequence
atggctaggacaaaacaaacagcccggaaatccaccgggggcaaggctccgcggaaacagcttgcaaccaaggccgcccgcaaatcagcacccgctaccgggggcgtcaaaaagcctcaccggtaccgaccgggcacagtggccctccgagaaatacgtcgctaccagaagtctaccgaactcctgatccgtaagctgccgttccagcgcttggtgcgcgagatagcgcaagacttcaagacagacttgaggttccagagtagtgctgttatggcacttcaagaggcgtctgaggcatatttggtgggcctgttcgaggataccaacctgtgcgcgatacacgctaagcgggtgacaatcatgccaaaggatattcagctggctaggagaatcaggggcgagcgcgcttag

SEQ ID NO: 6113 - DNA, 1209 bp, Artificial Sequence
  Description of Artificial Sequence: Synthetic coding sequence
atgagattacctcggagagcggccctgggcctgctcccactgctgttattgctcccacctgctccagaagctgctaaaaagcctaccccatgccaccgctgcagggggttagtggacaagtttaaccaggggatggttgacacagccaagaagaatttcggcgggggcaatacggcatgggaggagaagaccctgtcgaaatacgaatcctccgagatcaggctgctggaaatcctagagggactgtgtgagagttctgacttcgagtgcaatcagatgctcgaggcacaggaggagcatttagaagcttggtggctgcagttgaagtctgagtatcccgatctgtttgagtggttctgcgtaaagaccctcaaggtgtgctgttctcccggaacgtacggcccggattgtttggcatgccaaggtgggtcacagcgcccgtgttccggcaatggtcattgttctggggacggcagcaggcagggagacggatcatgtcgctgccacatgggctatcagggacccctgtgtactgactgcatggatggctattttagttccctgcgaaacgaaacacattctatatgcaccgtgaggacgggtctaagtgactcctacccgccttgctgcctatctcttggttgctggagaggggtgggacacgcttggatccggggacgcaatacacatactcagcccggctacagctcaagagtttggatcgctgccttcagtccggcctgcgacgagtcctgcaagacatgctccggactaactaaccgggactgtggagagtgtgaggttggttgggtgcttgatgagggtgcctgtgtagacgtggacgagtgtgcagccgagccacctccctgtagtgctgcgcagttctgcaagaacgcgaatgggtcctatacatgcgaagagtgcgactctagctgtgtgggctgcactggagagggaccgggaaattgtaaagagtgcatttccggctatgcaagggagcacggtcagtgcgccgatgtggacgagtgctccttggccgaaaaaacatgtgtgcggaagaatgagaactgctataataccccgggtagctatgtttgtgtgtgccctgatggattcgaagagactgaggacgcatgcgtgccccccgctgaagccgaggccactgaaggggagagtccaacccaactgccttcccgcgaagatttatag

SEQ ID NO: 6114 - DNA, 633 bp, Artificial Sequence
  Description of Artificial Sequence: Synthetic coding sequence
atgtcagccggcaagatgatgaggaccctcatcacaacacaccccttacctcttcttttgctgccccagcagctgctccagctggtgcaatttcaagaagttgacaccgactttgattttccagaggaagataaaaaagaggagttcgaggagtgcttagaaaagttcttctcgacggggcccgcccgtccacctaccaaggaaaaagttaagcggcgagttctgattgagccaggcatgccccttaaccatatagagtactgcaaccatgagatcatgggtaagaacgtatattataagcacaggtgggtggctgaacactacttccttctgatgcagtatgacgaattgcaaaagatctgctataacagattcgttccttgcaagaacggcatccgcaagtgtaatagatctaaaggtctggttgaaggagtgtattgtaatctcaccgaggccttcgagatcccagcttgcaagtacgagagcctttataggaaagggtatgtattgattacttgcagctggcagaacgaaatgcagaagaggatcccgcatactataaacgacttggtagagccgcccgaacacagaagcttcctgtcagaggatggggtcttcgttatcagcccttag

SEQ ID NO: 6115 - DNA, 585 bp, Artificial Sequence
  Description of Artificial Sequence: Synthetic coding sequence
atgaccatgcgccataattggacaccagacctgagtccattatgggtgctactcctgtgcgctcacgtcgtgaccctccttgtgcgcgccacacctgtgtcccagactacaacggccgccacagcctctgtacggagcaccaaagacccttgcccctcccagcctccagtgttcccagcagctaagcaatgcccagcactggaagtgacttggcctgaagtcgaggtcccactgaacggtacactctccctgtcgtgtgtggcatgctctcggttccccaatttctccatcctatattggttagggaatggtagcttcatcgaacacctgcccggcagattatgggagggctctaccagcagggagagaggatctacgggaactcaactgtgcaaagccctggtgctagagcagctaacccctgctctgcactctacaaacttttcttgcgtgctggtggatcctgagcaggtggtacagcgacatgttgtgctggcccagctatgggccggcctgagggctacactgccccccacccaggaagccctcccatccagtcacagctccccacaacagcaaggatag

SEQ ID NO: 6116 - DNA, 4059 bp, Artificial Sequence
  Description of Artificial Sequence: Synthetic coding sequence
atgcgccatggtgtagcttgggccctacttgtcgctgccgctcttggcttgggagcaagaggcgttcgcggagccgtggcgctcgctgacttctacccatttggcgccgaacggggcgatgccgtcacgccaaaacaagatgacgggggctcagggctgaggccgttaagcgtcccattccccttcttcggtgccgagcattccggactgtatgttaataataacgggataatttcctttcttaaagaagtctcccagtttacacccgttgcattccctatcgcgaaggatcggtgtgtagttgcggcgttctgggctgatgtggataataggcgcgcgggagacgtgtattacagggaagctaccgacccagctatgctgcggcgggccactgaggatgtgaggcactactttccggagctgctcgacttcaacgccacgtgggtattcgtggcgacctggtatagggtaaccttttttggagggagcagctcctcccccgtaaacacattccaaacagtacttattaccgatggcaagctgtcattcaccatttttaactacgagtctatcgtgtggaccactggaactcatgctagcagcggcgggaatgctactgggctgggcggcatcgccgcccaagcaggcttcaatgctggggacgggcagagatatttctcgatccctgggtcccgaacggctgatatggccgaagtcgagacaactaccaacgtcggggtccctggccggtgggcctttcgcatagacgacgcgcaagtcagggtgggtgggtgtggacataccacctcagtatgtctggcattgcgcccatgtctgaacggcgggaagtgtattgatgattgcgttaccgggaatccatcatatacttgtagttgcctgagtggctttaccggaagaagatgccacctggatgttaatgaatgtgcctcccagccatgccagaacggtggaacctgcacacatgggatcaacagttttaggtgccagtgcccggctggctttggagggcccacctgcgaaacagctcagtcaccctgcgacactaaggagtgtcaacatgggggccagtgtcaggtggagaacggttcggctgtctgtgtatgccaggctggctatacaggcgcggcctgtgagatggatgtggatgattgcagcccagatccctgccttaacggtggatcatgcgtagacctagtgggcaactacacttgcctatgcgcggagcccttcaaggggctccgttgtgagactggtgaccaccctgtgcccgacgcctgtttgtcggcaccctgccataacggcggtacatgcgtcgatgctgatcaagggtacgtctgtgaatgccccgagggcttcatgggcctcgattgtcgggaacgggtgccagacgactgcgagtgtagaaatggcggtcgctgtctgggtgccaataccactctgtgccaatgcccgctcgggtttttcggcctgctttgtgaatttgagatcacagctatgccgtgtaacatgaacactcagtgccccgacggcggttactgcatggagcatgggggatcttacctctgtgtctgtcataccgaccacaatgctagccattcactgccttccccctgcgatagcgacccatgtttcaacggcgggtcatgtgacgcacatgatgattcatatacttgcgaatgccctcgaggatttcatggcaagcactgtgaaaaggcccgtccccacctctgctccagtggcccttgtaggaacggggggacatgtaaggaggccggcggtgagtatcactgctcatgcccctatcgctttacagggagacattgcgaaattgggaagcctgatagctgcgcctcagggccatgtcacaatgggggcacatgttttcattacatcgggaagtataagtgcgactgcccacctggcttctccgggcgccactgtgaaatcgctccatctccttgcttccggtctccttgtgtcaatggcggcacttgcgaagacagagataccgactttttctgtcattgtcaggcaggttatatgggaagacggtgccaggctgaagtggactgcggacctcccgaggaagttaaacacgccactttacgcttcaacggcacgagattaggtgcggtcgccctctacgcatgtgatcggggatactctttgtccgccccttcgaggatccgggtgtgtcaaccccatggcgtgtggtcagagccccctcagtgcttagaaatcgacgaatgccgaagtcagccgtgtctgcatggtggatcttgtcaagatagggtcgcggggtacctgtgcctctgttccaccggctatgagggggctcattgcgagctagagagagacgaatgtcgcgcccacccttgccgaaatggcgggagctgcagaaacttgcctggggcgtatgtttgtcgctgtcctgctggattcgtcggggtgcactgcgagaccgaggtcgacgcctgcgactcttctccgtgccagcacggagggaggtgtgagagcggaggcggggcctatctgtgcgtttgccctgagagtttctttggttaccattgcgagacagtcagcgatccatgcttcagttccccctgtggtggccggggatattgcttggcctcgaacgggtctcatagctgtacatgcaaggttgggtacaccggagaagattgcgcaaaggaacttttccctccaactgccctgaaaatggagagggtcgaggagtcaggtgttagcatctcctggaatcctccgaacgggcccgccgcacgtcaaatgttggatggttacgcagtcacatacgtgtcaagcgacggctcatatagacgtaccgatttcgtagaccggacgagatcaagtcatcagttacaagcactcgcagccggacgcgcatacaacatctccgtgttcagtgtgaagagaaatagtaacaataaaaatgacataagtcgtccggctgtccttcttgcaaggacccgacccaggcctgtggagggtttcgaagttactaacgttaccgcctctaccatctccgtccagtgggccctccatcgaatcagacacgccacggtgtcaggggtgagagtgtccattagacaccctgaggcgctgcgggaccaggctacggacgttgaccggtccgtggatcgctttaccttcagggcactgcttccgggcaaacgctataccattcaactcaccacactgtcaggcctgcgtggtgaggagcatccaactgaatccctggccactgctccaacgcacgtttggaccagacctctccctcccgcaaacctaaccgccgcccgggtgactgctacttcggctcacgtagtgtgggatgcgcccactccagggtctcttttggaagcttacgtgataaacgtaactacctcccagtcaacgaaaagcagatatgtacccaatggcaaactcgcttcctacacagtgcgcgatcttttgcccgggagaagataccagctttcagtaatcgccgtgcaaagtactgagctgggtccgcaacattccgagccggcgcacttgtacataatcacttcccctcgcgatggtgccgatcgccgctggcaccagggaggacatcacccgagggtactgaagaaccggcccccacctgcaaggctgcctgagctccgtttactcaatgaccattcagcacccgaaacccccacccagccccccagatttagtgaattggtcgatggcaggggccgggtatctgccagatttggaggttctccatcaaaggcggccaccgtgcgatcccacgtgcctggtaattgcagtgagaacccttgtcagaatggcggaacatgcgtgcctggagccgacgcacacagctgcgactgcggtccgggctttaagggccgaaggtgtgagctggcgtgcatcaaggtgagcagaccgtgtacgcgccttttcagtgaaaccaaggcttttcctgtgtgggaaggcggcgtctgtcaccacgtgaaacagagcaaatcgcagaccctggagaagtcttag

SEQ ID NO: 6117 - DNA, 957 bp, Artificial Sequence
  Description of Artificial Sequence: Synthetic coding sequence
atgctcccactgactatgaccgtgcttatcttgctcctgctccctacagggcaagctgctcctaaagacggcgtgacacgtcctgattctgaggtgcagcaccagctgctgcctaatcccttccagcctggacaggagcaactgggactcctgcagagttacctcaaggggctgggccggacggaggtacagttagaacacctaagtagagaacaggtcttactgtacttgtttgctttacatgactatgaccagtccgggcagctggatggccttgagttgctgagtatgctgacagccgctttagcacccggtgctgctaactctccaacaacaaacccagtgatcctgatcgtggataaagttctcgaaactcaggatctgaatggcgacggtcttatgacaccagccgagctcatcaacttcccaggtgtggcacttcggcacgtcgagcccggtgagcccctggcccctagtccccaggagcctcaggctgtaggccgccagtctttgctcgcaaaaagcccactcaggcaagaaacacaggaagcccctgggccgcgcgaagaggctaaaggccaggttgaagcccgtcgggagtccctggaccccgttcaggagcccgggggacaggccgaagctgatggggacgtgccaggcccaagaggcgaggccgagggacaggccgaggccaaaggcgatgctcctggccccagaggcgaagcagggggtcaggctgaggctgagggcgacgccccaggccctagaggggaggccggaggacaggcagaagctgagggtgatgctcccggccctcggggcgaagcaggggggcaggccgaagcacgcgagaatggagaagaggcaaaggagctgcctggtgaaacactggagtctaagaacactcaaaacgacttcgaggtgcatatcgtgcaggtcgaaaatgacgagatttag

SEQ ID NO: 6118 - DNA, 816 bp, Artificial Sequence
  Description of Artificial Sequence: Synthetic coding sequence
atgcaggcggcatgttggtacgttctgtttctgctccaaccgactgtgtaccttgtgacctgcgcaaatctgacaaacggtggcaagtccgaactgctgaagtcagggtcaagcaagagtaccttaaaacatatttggactgagagctcaaaggatctttctattagtagattacttagccagaccttccgtggtaaggagaacgacactgatctggatctgagatatgacaccccagagccctatagtgaacaggatttgtgggattggctcagaaacagcactgatctgcaggagccccgaccacgcgccaaacggcggccaatcgtgaaaaccggcaagttcaagaaaatgttcggctggggagatttccactcaaatattaagactgtgaagctgaatctgctgatcacaggcaagatcgtggaccacggaaatggaacgtttagtgtgtatttcagacacaacagtaccggtcagggtaacgtctctgttagtctggtcccaccaacgaagattgtagagttcgacctagcacaacaaactgtaatcgacgcgaaggattccaagagttttaattgtcgtattgagtacgagaaggtggacaaagccacaaaaaacaccctttgtaactacgatccaagtaaaacttgttaccaggagcaaacccagagtcacgtgtcgtggctgtgtagtaaaccgttcaaggtgatttgcatttacatatcattctattctaccgactataagctggttcagaaagtatgtcctgactataattatcatagcgacactccatatttcccctccgggtag

SEQ ID NO: 6119 - DNA, 999 bp, Artificial Sequence
  Description of Artificial Sequence: Synthetic coding sequence
atgttgttgctggctgctgctttcctggttgcattcgttttgttgctgtatatggtgtcccctctgattagcccaaagccactagctttaccaggcgcacacgttgttgttaccggaggatcatcggggatcggaaagtgtattgccatcgaatgttataaacagggcgcctttatcactttggtggctcgcaacgaagataaacttcttcaggctaagaaggagatcgaaatgcactcaattaacgataagcaggtggtgttgtgcatttcagttgatgtgtcacaggattataaccaggtggagaatgtcatcaaacaggctcaggagaaactgggcccagtcgatatgctcgtcaactgtgctgggatggccgtgtcaggcaaattcgaggacctggaagtctcgaccttcgagaggctgatgagcataaattacctggggtccgtgtatccatcgagggccgtgatcaccaccatgaaggagagaagggtcggacgcatcgtcttcgtgtcctcacaagccggtcagctcggcctgttcggatttacagcgtatagtgcctcaaagttcgccatcagaggactcgccgaggcactgcagatggaggtgaagccttacaacgtctatataaccgttgcctatccgcctgacaccgacacccccgggttcgcagaagaaaaccggaccaaacctctcgaaactaggctcatcagcgagacgaccagcgtgtgcaagcctgagcaggtggcgaaacaaattgttaaggatgctattcagggcaacttcaactcgtcactgggctcagatgggtacatgctgagcgcactcacttgcggcatggctccagtgacctccatcactgaaggactgcagcaagtggtgaccatggggctgtttcgtaccatcgccctcttctacctcggttcattcgacagtatagtcaggcgctgtatgatgcagagggagaaatccgagaatgccgataagacggcatag

SEQ ID NO: 6120 - DNA, 1497 bp, Artificial Sequence
  Description of Artificial Sequence: Synthetic coding sequence
atgtcattctccgccacgatactgttttctcccccgagcggatccgaagccaggtgttgttgctgcgcatgtaaatctgagaccaacggcgggaacacaggctcccagggcggaaatcccccgccctctacacccatcaccgtaacaggacacgggctggcagttcagtcctccgaacagctcctccacgttatataccagagagtggacaaagcagtgggcctggcagaggccgcactgggactcgcacgcgctaataacgaacttctgaagcggttgcaagaagaagttggcgatctgagacaggggaaggtctcgatcccagacgaggacggcgagtcgcgcgcccattcatctccaccagaggaaccaggtccgctgaaggaatctccaggcgaggcattcaaagcgctttcagccgtggaagaagaatgcgatagcgtgggtagcggtgtacaggtggtgatcgaggaactccgacaactgggtgctgccagtgttgggcctggccctctgggtttccctgccactcagcgtgatatgagattgcccggttgtacactggcagcgtccgaggcggccccactcctgaaccctttggttgacgattacgtagccagtgagggggctgttcagcgcgtgctagtgcccgcctacgccaagcaactatcacccgcaactcaactggctatccagagggccactcccgagacgggacctgaaaacggcacaaaattacctccaccacggccagaagacatgttgaatgccgctgctgcgcttgactctgcactggaggagtctggccccgggtccactggggagcttcggcactctctcggcctgactgtgtcaccctgtcgcaccagagggtctggtcagaagaactctaggcggaagagggatctagtactcagtaagctggttcataatgtgcataaccacattacaaacgacaaacggttcaacggatcagagtccataaagtcatcttggaacatttccgtggtcaaatttctgttggaaaaactgaagcaggaactagtgacatccccgcacaattataccgataaagagctgaagggggcatgcgtggcttacttcctgactaagcgaagggaataccgtaacagcttaaacccttttaaaggattgaaggaaaaggaggagaagaaactacggtctcggagataccgcctttttgccaataggagctcgatcatgcggcattttggacccgaggatcagcgcctgtggaacgatgttaccgaagagttaatgtctgacgaggaggactcactgaacgaaccagacagactgccttcggctgaggctcagttgctgccaccagagctttacaaccccaactttcaggaagaggaggacgaaggtggagatgagaacgcccccgggagcccaagtttcgatcagccccacaagacctgctgtcccgatctgaactcgtttatagaaataaaagtggaaaaagacgagtag

SEQ ID NO: 6121 - DNA, 966 bp, Artificial Sequence
  Description of Artificial Sequence: Synthetic coding sequence
atgcgcctgccccgtcgggctgccctgggcctgcttcccctgttgctcttattgccacctgcgcccgaagcggccaaaaaaccaaccccatgtcataggtgtcgtgggctggtggataagttcaatcagggcatggtggacacagccaagaagaattttggcggtggcaacactgcatgggaagagaagactctgtcaaagtatgagtcaagcgagattcgactgctggagatactagagggcctctgcgaaagttctgattttgagtgtaatcaaatgctggaagcccaggaagagcatctagaggcctggtggttacagttaaaaagtgagtatcctgatctttttgaatggttttgtgtgaagactctgaaagtgtgttgttctccggggacttacggacccgactgtttagcctgtcagggtggctcacagagaccgtgtagcgggaacgggcattgcagcggggacggttctagacagggcgacgggtcatgcaggtgtcatatgggctatcaaggacctctgtgcactgattgtatggatgggtacttcagctcgctccgtaatgagacgcactcaatctgcactgcctgcgatgagagttgtaagacctgtagcggactgacaaatcgggattgtggcgaatgcgaggttggatgggtgctcgacgagggagcctgcgtggatgtggacgagtgtgccgcggagcctcctccctgcagtgccgcccagttctgtaaaaatgccaacggcagttacacttgcgaagatgttgacgagtgttctcttgccgagaagacatgcgttcgcaaaaatgagaactgctacaatacccccgggagctacgtatgcgtgtgccctgacggattcgaggagacagaggacgcatgtgtcccgcccgccgaggccgaagcaacagagggtgaaagccccacccaattaccaagccgtgaagacctgtag

SEQ ID NO: 6122 - DNA, 711 bp, Artificial Sequence
  Description of Artificial Sequence: Synthetic coding sequence
atgatgggtatttttttagtctatgtaggatttgtgtttttctccgtgctgtatgtccagcaagggctgtcgagccaggctaaatttacagagttccctaggaatgtgaccgcaactgaagggcaaaatgtggagatgtcttgcgcattccagtcaggctctgcctcagtgtacttggagatccaatggtggtttttgcgtggccctgaagatttagaccccggtgccgagggggctggtgcgcaagttgagctcctcccggatcgagatcccgattccgacgggacaaaaatcagtactgtaaaggttcaggggaacgacatttcccataagctgcaaatctcgaaagttcggaagaaagacgagggtttgtacgaatgtcgagtaaccgacgccaactacggtgagctccaggagcacaaagcccaggcttatttaaaggtaaatgcgaatagtcatgctcgtcgaatgcaggcatttgaggcaagccccatgtggcttcaggatatgaaaccacgcaaaaatgtcagcgctgcaataccctctagtattcacgggtcggccaaccagcggacccactccacctccagccctcaggtggtcgccaaaattcccaagcaaagtccacagtctggagctcgcattgccacctcccatggcctaagtgtcctcttgctagtctgtgggtttgtaaagggagcgttactgtag

SEQ ID NO: 6123 - DNA, 273 bp, Artificial Sequence
  Description of Artificial Sequence: Synthetic coding sequence
atgaacatgaaacccgcaacagcgtctgctctgctgctgctgctgttgggacttgcatggacacagggatcccatggctggggagccgatgccagcagccttcaaaaacgagcgggaagggacgaccagaattataactacaaccagcacgcataccccacagcatacggaggaaagtacagcgtcaaaaccccagctaagggaggcgtctccccgagctcatcggccagtcgcgtacagccgggcctgttacagtgggtaaagttctggtag

SEQ ID NO: 6124 - DNA, 360 bp, Artificial Sequence
  Description of Artificial Sequence: Synthetic coding sequence
atgcctgccgttttcatgcttgctagctccagcgccctgcaatgcgggcggggtgtaccacgcttccctagaaccgaggttggcgccggtcattcagtgaacgaagaaactaaagccgagaaagtcggaaaccaaacttccgtcattccagccacaagccgccaggccgccctgggtacatcctggacccagcgaaggacccaacccctgcaggagcgcagccactggcacccccgtggtaataacgctagtggtatgggaggtcaccgcatgtttcctggccccctacgagggcccgcagctcaggttctcgagaacgaatgcgggtccctgggacgggctgcagaaggcagatcttag

SEQ ID NO: 6125 - DNA, 639 bp, Artificial Sequence
  Description of Artificial Sequence: Synthetic coding sequence
atgctatcctccgtcgttttttggggactcatcgccttgattgggacttccaggggtagttatcctttcagccacagcatgaaaccacacctccacccaaggctgtatcacggctgctatggagacatcatgaccatgaagaccagcggagccacgtgtgatgctaacagcgtgatgaactgtggcataaggggcagcgaaatgtttgccgagatggacctcagggctatcaagccttaccaaacgctaataaaagaggtcgggcagcggcattgcgtggaccctgcggtgattgccgcaatcattagccgcgagtcgcacggcggctccgtgcttcaagatgggtgggatcatagaggcctcaagtttgggctgatgcagcttgataagcagacgtatcatccagtgggcgcttgggattcaaaagagcatttgtcgcaggctaccggcatcctgacggagcgcatcaaagcaatccagaaaaaatttccgacctggagcgtcgcccaacacctgaaaggtgggctgtccgccttcaagagtggcatagaagctatcgccacacccagcgatatagacaacgattttgtgaacgacatcatagctcgggctaaattctacaaacgacaatctttctag

SEQ ID NO: 6126 - DNA, 387 bp, Artificial Sequence
  Description of Artificial Sequence: Synthetic coding sequence
atgcgtgttgctcggagaacccggaatgtgtgcagatgcccaagggcggccggccccggcgtccctgaaccaagagcagctccgctgcccctcctggctatggccccacctcctgcttgtagatcaccaatgtcccctccgcccccgccactgcttctactgctgctgtctctggctctcctgggcgcccgcgctcgtgccgagccggcggggagtgccgtccctgcacagtctaggccttgcgtggattgtcatgcctttgagtttatgcaaagggctctccaagatctcagaaaaaccgcctgttctcttgatgcccggaccgaaacactgctgcttcaagccgaacgccgagcgctgtgcgcctgttggccagcaggccattag

SEQ ID NO: 6127 - DNA, 399 bp, Artificial Sequence
  Description of Artificial Sequence: Synthetic coding sequence
atgggtccccgcgtactgcagccccctcttctgctgttgctgttggcactgttgctggccgctcttccgtgtggcgcggaagaagcttcacccctccgccctgcacaggtgaccttgtccccgccacctgctgtaaccaacggctctcagccaggggccccacacaattccacacacactaggccacccggagccagcggtagtgcgcttacgcggtccttttacgttatcctgggattctgcggactaactgcgctctattttttaattagagcttttagactcaagaaaccgcagagaagaaggtacgggctactggccaatacagaagatcccacggagatggcttcactggacagtgatgaggagaccgtcttcgaaagccgaaatctgcgctag

SEQ ID NO: 6128 - DNA, 585 bp, Artificial Sequence
  Description of Artificial Sequence: Synthetic coding sequence
atgtccgcgctgtggctgttgctcggactgcttgccctgatggatctgtctgagagtagtaactggggctgttatggcaatatccagtcacttgatactccgggcgcttcttgtggcataggcagacgccacgggctgaactactgcggtgtgcgggcaagcgagcggcttgctgaaatcgacatgccttacctcttaaagtaccagccaatgatgcaaactatcggtcagaagtactgcatggacccggcagttatcgctggagtgctctcccgcaagtcccctggtgacaaaattctagtcaatatgggcgacagaacctcaatggttcaggaccctggctctcaggctccaaccagctggatctctgaatcccaagtttcacagaccacagaggttttaacaaccagaattaaagaaatccagagacgtttcccaacatggaccccagatcagtatttacggggtggcttgtgtgcatactcgggaggggccggttacgtgcgcagctctcaggacctcagctgtgatttctgcaacgatgtactggcccgcgctaaatatctgaagcggcatggattctag

SEQ ID NO: 6129 - DNA, 441 bp, Artificial Sequence
  Description of Artificial Sequence: Synthetic coding sequence
atggtaattaccatttattatgatgtgaaagtccgctttattgttcggggctgtggacagtacatttcctaccgctgtcaggaaaagaggaacacatatttcgccgagtattggtatcaagcacagtgttgccagtacgactactgcaacagttggagctctcctcagcttcaaagctccctaccagagccacacgacaggcccctggccctgcccctgagtgatagccagatacaatggttctaccaggctctcaatctctcactgcctctccctaactttcacgccggaactgaaccagatggtctggatccaatggtgactctgtccttgaacctggggctctcatttgctgaattgcgaagaatgtatctattcttaaacagcagcggattactggtgctgccccaggcagggctcctaacccctcatccatcctag

SEQ ID NO: 6130 - DNA, 234 bp, Artificial Sequence
  Description of Artificial Sequence: Synthetic coding sequence
atgggatcgagcggccttctgtccctgctcgtgttgttcgttctccttgctaatgtacagggccccgggctgactgactggctcttcccccgccgatgtccaaagatccgcgaggaatgcgagtttcaggaacgcgacgtatgcacaaaagaccgccagtgtcaagacaataagaaatgctgcgtgttctcctgtggcaagaagtgcctggatctgaagcaaggcaaacagtag

SEQ ID NO: 6131 - DNA, 444 bp, Artificial Sequence
  Description of Artificial Sequence: Synthetic coding sequence
atggggcaggaggtccacggcagttgttgggccttgggagccggcggtggccaaagacagtgggttggccggagtatgcctcccctggcaccccagctctgtcgagctgtttttctggtgcccattctcctgcttctccaagttaagcctttgaacgggtccccaggtcccaaagatgggagtcagactgaaaaaacgcccagtgccgaccaaaaccaggagcagttcgaagagcacttcgtggctagctctgtaggggagatgtggcaagtggtcgacatggctcagcaggaagaagatcagtcatcaaagaccgccgcggtccacaagcacagctttcacctgagcttttgtttttcactggctagcgtgatggtcttctctggtggccctttgaggcgcacttttcctaacatccaactgtgtttcatgctgacccactag

SEQ ID NO: 6132 - DNA, 1695 bp, Artificial Sequence
  Description of Artificial Sequence: Synthetic coding sequence
atggcgcccaagaagctatcctgcctgcggagcctgctacttcccctgagcctgacactgctcctgcctcaggctgacaccaggtccttcgtagttgataggggtcacgacaggttcttgctagacggagcacccttccgctatgtatctggcagtctacactatttccgggtgccgagggtgctttgggcagatcgactcttgaaaatgagatggtctggcctcaacgctatccagttttatgtgccgtggaactaccatgagccccagcccggagtgtacaactttaatggctctcgcgaccttattgcctttctgaacgaggccgccctggccaacttactagttattttgagacccggcccctacatttgtgcagaatgggaaatgggaggccttccatcctggctcctacggaaaccggagattcacctacggacctctgatcctgcagacaatatgacaaagatctttacgctgctgcgtaagtatgagcctcacggtcctctcgtaaattccgaatattacaccggctggctcgattattggggacagaatcacagcacccgttcggttagtgcagtgactaagggcctggaaaatatgcttaaactcggcgccagcgttaatatgtatatgttccacggtgggactaatttcgggtattggaatggcgctgataaaaagggcaggttccttccaataactacctcatatgattacgacgctcccatatctgaggccggcgaccccacccctaaactgttcgctctgagggacgtaatatctaaatttcaggaagttcctctgggccccctgccaccaccctctcccaagatgatgctcggacctgtgactctgcacctggttggacaccttctggcctttctggacctcctgtgtcctaggggcccgatccacagcattctcccaatgaccttcgaggctgttaaacaggatcacggattcatgctttatcggacgtacatgacacataccattttcgagccgacccctttttgggtacctaacaacggcgtgcacgatcgcgcatacgtgatggttgatggtgtctttcagggcgtagtcgagcgcaatatgcgcgacaagttattccttactggtaaactcgggagcaaacttgacatcctggtagagaacatggggaggctatcattcggctccaacagctccgactttaagggactgttaaagcccccaatcctggggcaaaccatcctgactcagtggatgatgttcccgctgaagattgataatttggtgaagtggtggtttcccttgcagctccctaaatggccttatcctcaggcgccctctggacccactttttatagtaagaccttccctatccttgggagcgtcggagataccttcctgtaccttccaggatggaccaaggggcaagtttggatcaacggttttaatttaggaagatactggactaaacagggaccacaacagacactgtatgtaccacgatttctgctgttccccagaggagctctcaataaaattactcttttggagctcgaggacgtgccactccagccacaggttcagttcctcgacaagcctatccttaattccacttctacactgcaccgcacccacattaactctctctctgctgacactctgtctgcttccgagccaatggaactgtcgggacactag

SEQ ID NO: 6133 - DNA, 423 bp, Artificial Sequence
  Description of Artificial Sequence: Synthetic coding sequence
atgtttttcacgatttctcgaaagaacatgtcgcaaaaactatcgctgctccttctggtgtttgggctgatctgggggcttatgctgctgcactatacttttcagcaacccaggcaccagagcagcgtgaaactgagggagcagatcctagacttgagcaagcggtatgtgaaagcgcttgctgaggagaacaagaacactgtggacgtagagaatggagctagcatggcagggtacgccgatctgaagagaactattgccgtgctcttagacgatatcttgcaacggttagttaaacttgaaaataaggtggattacatcgtagttaatggatcagccgccaatactacaaacggtacctctggcaaccttgtgccggtgactacgaacaagaggactaacgtgagcgggagcatcagatag

SEQ ID NO: 6134 - DNA, 528 bp, Artificial Sequence
  Description of Artificial Sequence: Synthetic coding sequence
atgctgccccccatggcactgccttccgtgtcctggatgctgctgagctgcctgatgctcctgtctcaggtgcaaggcgaggagccgcagcgcgagttgccttctgctcgaatccgctgcccaaaaggctcaaaggcctatgggtctcattgctatgcactgtttctgagcccaaagagctggacagacgccgatttggcttgtcagaagcgacccagtgggaaccttgttagcgtcctgagcggagccgagggatcatttgtaagctctttggtgaagtcaatcggtaactcttatagctacgtgtggatcggtcttcacgatcctactcagggaacggagccaaacggggagggctgggaatggtctagcagtgatgtgatgaactactttgcctgggagcgaaatccctccactattagttctccagggcattgcgcctctctatcgcgaagtacggcgtttcttaggtggaaagactataattgcaatgtgcgcttaccatatgtatgcaaattcacagattag

SEQ ID NO: 6135 - DNA, 381 bp, Artificial Sequence
  Description of Artificial Sequence: Synthetic coding sequence
atgcacctttcccagctgctggcttgtgcacttctgctgactctgctctctctcagaccctccgaggccaaaccaggcgcgccacccaaggtccccagaaccccccctgccgaggaactggctgaaccccaggccgctggggggggccagaaaaagggtgataaggcccctgggggtggtggggctaacctgaagggcgatcgaagccgtctgttgagagatttgagggtcgacacgaagtccagggcagcgtgggccaggctcctccaggagcacccaaacgctcggaagtacaagggagctaataaaaaggggctgagcaagggctgcttcggacttaagttagataggatcgggtctatgagcggcttgggttgttag

SEQ ID NO: 6136 - DNA, 288 bp, Artificial Sequence
  Description of Artificial Sequence: Synthetic coding sequence
atggcaccccctcccgcctgtagaagcccaatgtcacctccacctcctcccctgctactgctattgttatcccttgctctcttaggggctcgcgcaagagccgaaccagctggatccgccgtgcctgcccagagcagaccttgcgtcgactgccacgctttcgagtttatgcagcgggccttgcaggatttgagaaaaacagcatgttctttggacgcccgcaccgagacactgcttctgcaagcggaacgccgcgccctatgtgcttgttggcctgccggtcactag

SEQ ID NO: 6137 - DNA, 423 bp, Artificial Sequence
  Description of Artificial Sequence: Synthetic coding sequence
atgttctttaccatcagccggaagaacatgtctcagaaactatccttgctgttgttggtatttgggttgatctggggactaatgctgctgcactacacattccagcagcctagacaccagagttctgttaagctgagggaacagattctcgacttgtccaagaggtatgttaaggctctggctgaggagaataagaacaccgtcgacgtggaaaacggcgcctcgatggctggttacgccgacctgaagcgtaccatagcagttctgctcgatgacatcctgcagagattagttaaacttgagaataaggttgactatatcgttgtcaacggttcagctgcgaacactactaatggtacttccggaaatctcgttcctgtgaccactaataaacgtacgaacgtaagcgggagtattagatag

SEQ ID NO: 6138 - DNA, 291 bp, Artificial Sequence
  Description of Artificial Sequence: Synthetic coding sequence
atggaacataaggaggtggtactattgctgctcttgttcctcaaatccgggcagggcgaacctctggatgactacgttaatacgcaaggcccatccctctttagcgtgactaaaaagcagttgggagcggggtcgagagaagagtgcgccgcaaaatgcgaagaggacaaagagtttacctgtagggcatttcaataccacagcaaagagcaacaatgtgttatcatggctgaaaacagaaaatctagcattatcattcgcatgcgggatgctgtcctatttgaaaagtag

SEQ ID NO: 6139 - DNA, 678 bp, Artificial Sequence
  Description of Artificial Sequence: Synthetic coding sequence
taagctgaccttccatcttgttggggggccggtccctgttacactggacataaggttggcgcactgcggagagataccgtcatttgctgctgtcggcacggcgattacagcactccttgcctgttcaccccaggaaagccatcacggaaccctagtccctggaagcgtacgctgtggacgctgtcagccccatgggcagggcccgctggctggacaggcgaggagcagaatgccactaaaactggcttaattacccgcaggcctcggccgctgcgccgtcggcctcaccctgcgcccgcctctcccctcccagaaatcatcaggggcaatatccccaggatgcttggaaagtttgtccccgttaattgggagcctccacagccgctgccctttcctaagtacttgagatgctataggtgtcttctagaaaccaaggagctcgggtgcttattagggagcgacatctgtttgactccagccggctcaagttgtattaccctgcacaaaaaaaattcttccggcagcgatgtgatggtatccgactgcagaagcaaagagcagatgagcgactgttcaaacacccgaacatcccccgtgtctggtttttggatcttcagtcagtactgctttctggatttctgtaacgacccccagaatcgcggcttgtataccccgtag

SEQ ID NO: 6140 - DNA, 684 bp, Artificial Sequence
  Description of Artificial Sequence: Synthetic coding sequence
atgggcgcagtcatgggaacattctcgtcacttcagaccaaacagcgcagaccatcaaaagatattgcttggtggtattatcaataccaacgtgataagatagaagatgaattggagatgactatggtctgtcatcggcccgagggattagaacaacttgaggcacagaccaatttcacaaagcgtgaactgcaggttctctaccggggttttaagaacgagtgtccttcgggtgtggtcaatgaggatactttcaagcagatctacgcccagttcttcccgcatggggacgcctcgacttacgctcactatttgtttaatgcttttgataccacacaaactgggagcgtgaagttcgaggattttgtgacagctctaagcattctgctaagggggaccgtccacgagaagttgcgatggacattcaatttgtacgacattaataaggacggctacatcaataaggaagagatgatggatatcgtgaaggcgatctacgacatgatgggaaagtacacctatccagttctaaaggaagatactccaagacagcacgtcgatgtgttctttcagaaaatggataagaataaggacgggattgttactttggatgaatttcttgaaagttgccaagaagatgataatattatgagatcactgcagctatttcagaacgtgatgtag

SEQ ID NO: 6141 - DNA, 546 bp, Artificial Sequence
  Description of Artificial Sequence: Synthetic coding sequence
atgcaggtgaacttcgtttcatatgtgcagttgacaagccgtgcgttgcctagtctgacggatagtaagggcagcttagttgtggtaagtagcttgctaggccgagtgccgacctctttctccaccccctatagcgccgccaaattcgcactggacgggttttttggttcattgaggcgcgaactagatgtgcaggatgtgaatgtggctattactatgtgcgtcttgggactgagggatagggcaagcgcggcggaagccgtgaggtcctccacatcacggccacggcagcccgaacatagaggtgtgccattacagagtcaaacagctatgtttctgcccccaacagtgcccggcgctaggacactgactgaaactccattacggggctggccccagccaaagatgaagtcttcccgccaaaagagtaagacagaaaagaatgatgggcacctggagcccgtgaccgcctgggaggtacaggtaccgagagtaaggcggctttgccgcggcctggcccgaccacatctgttcggtcacgattag

SEQ ID NO: 6142 - DNA, 423 bp, Artificial Sequence
  Description of Artificial Sequence: Synthetic coding sequence
atgagtgatcttctcttgctgggtctgatcggaggcctgactttgctcctgctactgaccctgctggccttcgcaggatactccggactgctggcaggagtcgaggtaagtgcagggtcgcctccaataaggaatgtgacagtggcctacaaattccatatggggctttacggcgagacgggcaggctgttcacagaatcctgtagtatatctcctaaattaaggagcattgccgtttactacgacaacccccatatggtacctccagacaagtgcagatgcgcagtcggttctatcctcagtgaaggcgaggagtcaccttcgcccgaactgattgatctctatcagaaatttggcttcaaagtgttctcattcccagccccatcacacgtggtaacagcaacattcccctacactacatag

SEQ ID NO: 6143 - DNA, 177 bp, Artificial Sequence
  Description of Artificial Sequence: Synthetic coding sequence
atgggccccgaggccctgagcagcctactgctgttattgctcgtcgcctctggcgacgctgacatgaaaggccactttgatccagcaaaatgccgttatgctttgggcatgcaggatcgcacaatacccgatagcgatattagcgcctcatcctcatggtcagattcaacagcttag

SEQ ID NO: 6144 - DNA, 2742 bp, Artificial Sequence
  Description of Artificial Sequence: Synthetic coding sequence
atgggcccagaggccctatcctccttactgcttctcctgctggtggcttccggtgacgcagacatgaaggggcatttcgacccagccaaatgccggtacgctctggggatgcaggatagaaccatccccgactcagatatatccgcaagcagttcctggagtgacagcactgcagctcgccactctcgcctagagtccagcgatggggacggcgcgtggtgccccgcaggctctgtgtttcccaaggaggaggagtatctgcaggtcgacctacagcgtctgcacctggtcgctctggtgggaactcagggaagacacgccgggggtttggggaaagagttcagccgatcctaccggcttcggtatagccgcgacggacgacggtggatgggctggaaagacaggtggggccaggaagtgatcagtggcaacgaggatcccgagggggtggtgctcaaagatctaggcccaccaatggtcgcgcgtctggtgaggttttaccctcgggccgaccgtgtgatgagcgtgtgccttcgtgtcgaactgtacggctgtttatggcgagacggcctgctgagttacacagctcccgtgggccaaaccatgtacctttccgaagctgtatatctgaacgatagcacctacgatggacacacagtaggtgggcttcaatatggcggcctagggcagctggcagatggtgtcgtcggccttgacgattttaggaagagtcaggaactaagggtttggcctgggtacgactacgtcggatggagcaatcattcatttagctccggctatgtggaaatggagttcgagttcgataggctcagagcttttcaggcaatgcaggtacactgcaacaacatgcatactctcggtgctaggctgcctgggggtgtggagtgccggtttcgtaggggccccgccatggcgtgggagggggagcccatgcggcataatctgggaggaaacctcggtgatccaagggcgcgagctgtatcagtgcctctgggaggacgcgtggcacgcttcctgcagtgcaggtttctctttgcagggccttggctgctcttctctgaaatatcctttatctctgatgtcgttaacaattcctcccccgccttgggcggcacctttccccccgcaccttggtggcccccgggccctccccctactaatttcagcagccttgaactggaaccccgggggcaacagcccgtcgctaaggccgaaggatccccaactgctatcttaatcggttgtctggtggccattatcctactgctcctgctgattatcgcactgatgctctggcggctgcactggcgtcggctcctttcaaaagctgagaggagagtgttagaggaggaactgacggttcacctgagcgtacccggcgacaccatactgatcaacaacagacctgggcctcgagaacctcccccctaccaggagccacgacccaggggaaatccaccgcactccgcaccctgtgttccaaatgggtccgccttgctgttaagtaatcctgcgtatcggttgttgttagcgacctatgccaggccacctcgtgggccggggccacccacccctgcttgggcgaagcctaccaatacccaggcttactcgggagactatatggagcccgagaagccaggtgctcccctgttgccacccccacctcaaaatagcgtgccgcactacgcagaagccgatattgtcactctgcaaggagttaccggaggcaatacctacgctgtacccgccttgcccccgggcgcggtgggcgatggtccccctcgggtggatttccctcgaagtaggctgcgttttaaagaaaagctgggtgagggacaatttggcgaagtgcacttgtgcgaagtcgattctccccaagatctcgtgtctttagactttccactgaacgtaagaaagggacaccccctcctcgtggccgtcaagattctgcgcccagacgccacgaagaacgctcgcaatgacttccttaaagaagttaagatcatgagccgcctcaaggatcccaatattattaggctcttgggtgtctgtgtccaggacgaccctctgtgtatgatcaccgactacatggaaaatggggacctgaatcagtttctctctgcacaccagctggaagacaaggcagctgaaggggcaccaggagacggccaggccgcccaagggccaacgattagctaccctatgttgctacacgtggccgcccaaattgcgtctggaatgcgttatctggcgacactgaatttcgtccatcgggacttggccacaaggaattgtctggtgggggagaattttacgatcaagattgcggatttcggaatgagccgcaatctatatgcaggagactactacagggtgcaggggagggccgttctacctatccgctggatggcatgggaatgtatcctaatgggcaagttcaccacggcatccgacgtgtgggctttcggtgtgactctatgggaagtgctgatgctgtgcagagcacaacccttcgggcaattgacagacgagcaggtgatcgaaaatgccggagaattcttccgtgaccagggcaggcaggtgtatttgtctagacctcctgcatgtccacagggcttgtatgagctgatgcttcgttgctggagccgggagtcagaacagcgccctcccttctctcagttgcaccgtttcctagccgaagacgccctgaataccgtgtag

SEQ ID NO: 6145 - DNA, 1146 bp, Artificial Sequence
  Description of Artificial Sequence: Synthetic coding sequence
atgcgccttctagcttggctcatttttctggccaactgggggggggctcgggcggagcccgggaaattctggcacatcgccgatctgcatctggatccggactataaagtgtctaaagatccttttcaagtttgcccctcggctggaagccagcctgtccccgacgctggcccctggggtgattacctatgcgatagtccgtgggcactaattaactcctcgatatatgccatgaaggagatcgagcctgagcctgatttcattctctggaccggagatgatactccccacgtccccgacgaaaaactgggggaagccgccgtactcgaaattgtcgaaaggttaacaaagctgatacgagaggtgttccccggcgcgttctattgcgaaaagctccccgggccgtcgggagcagggcggatcgtagtgttaaatacaaatctgtactataccagtaacgccctgacggctgatatggcagacccagggcagcagtttcagtggcttgaggacgtattgactgatgctagcaaagctggggatatggtctacatagtggggcacgtgccaccaggattttttgagaaaacccagaataaggcttggtttcgagaaggctttaacgagaagtacctcaaagtagtccgcaagcatcatcgagttattgcgggacagttctttggtcatcaccacaccgattccttcaggatgctttacgatgacgctggcgtccccatatctgcgatgttcatcacaccaggcgtaactccatggaaaactacattgccgggggtggtgaatggcgcaaataaccctgccatccgcgtgttcgagtatgacagggccacgctgagcctgaaggacatggtgacatactttatgaatctttcccaggctaacgcgcagggtacaccacgatgggagctggagtatcagtctaccctgcagcggtactatgtgtacaattcagttagttatagcgcgggtgtctgtgacgaggcctgcagtatgcaacatgtttgtgcgatgaggcaggtcgacattgacgcctacaccacctgcctgtatgcttctggaaccactcccgtaccacagctgccactcctgctaatggctctgctgggtctgtgtacgcttgtgctatag

SEQ ID NO: 6146 - DNA, 456 bp, Artificial Sequence
  Description of Artificial Sequence: Synthetic coding sequence
atgcgagtagctggagcggcaaagcttgtggtggcagtcgctgtgttcttgcttactttctacgtaatctcccaggtcttcgaaattaagatggacgctagcctgggtaaccttttcgcccggtccgctctagacaccgccgcccgtagtacgaagcctcccagatataaatgcggaatcagcaaagcctgcccagagaaacacttcgcatttaagatggcctctggggccgcaaacgtcgtcggaccaaaaatttgcctggaggataatgttctaatgtcgggagtgaaaaataatgtggggagagggatcaacgtggccctggccaatgggaaaaccggggaagttctggacaccaaatatttcgacatgtggggtggagatgtggccccctttatcgagtttctgaaagcaatacaggacgggaccatcgtgttgatggggacgtacgactag

SEQ ID NO: 6147 - DNA, 936 bp, Artificial Sequence
  Description of Artificial Sequence: Synthetic coding sequence
tgagcacccagtccctgttctcacttcaactgtgggagtcaggtaaccgacggaggcaccattaagcagaagatcttcacattcgacgctatgttctctaccaactacagccacatggagaactacagaaaacgcgaagatctggtctaccagagcacagtgaggttacccgaggtgaggataagtgataatgggccatatgagtgtcacgtgggaatctatgacagagcgaccagagagaaagttgttctggcttcaggtaacatcttcttaaatgtaatggcacctcctacatcaattgaggtggtagccgcagacactccagcgcctttcagtcgatatcaagcccaaaacttcacactggtgtgcatcgtgtcaggcggcaaaccagctcccatggtatattttaagagagacggcgaacccatcgatgcggtgcctctgtccgaacctcctgccgccagtagcggtcctttacaagactcaagaccattccggtcactgcttcaccgggatctggatgacacaaagatgcagaagagcctgtcactcctggacgccgaaaatagggggggcaggccctatacggagaggcccagccgaggtttgacaccggacccaaacattctactacagccaaccacagagaacataccagaaaccgtagttagtcgcgagttcccgagatgggtgcactccgcagagcctacctattttcttagacacagtcgcacaccgtctagtgacggcacagtcgaagtgcgggccttactcacatggactttgaatcctcaaattgataatgaagctctgttctcctgtgaggtcaaacaccctgctctttcaatgcccatgcaggccgaggtgacgctggtggccccgaaaggcccaaagattgtgatgaccccttctagagcccgcgttggtgacacgtag

SEQ ID NO: 6148 - DNA, 978 bp, Artificial Sequence
  Description of Artificial Sequence: Synthetic coding sequence
atgcagggcagagttgcagggagctgtgcacccttggggctactcctcgtatgtctccatctcccaggactttttgcccgcagtattggcgtggtggaagaaaaggtgagccaaaacttaggcacaaaccttccccagttaggacagccctctagtacgggaccatcaaactccgaacatccgcagcctgctttggacccacggagcaacgacctagcacgggtgcctctcaagttatccgtccccgcaagtgatggttttccaccagctggcgggtctgccgttcagcgctggcctccctcctggggtctccccgccatggacagctggcccccggaggatccgtggcaaatgatggccgccgcagccgaggataggctcggggaggccctgccagaggaactgtcatatctaagttctgccgctgccttggctccagggagtggtccgctgcctggggagagtagccccgacgctacagggctctcgccaaaagcctccctgctgcaccaggattccgaatcccggcgccttcccaggagtaactcactcggcgcgggcggtaagattttaagtcagaggcccccttggtcactgatacacagggtccttcccgaccacccatggggtactctgaacccctcagtgtcatggggaggaggcggacctggaaccggctggggaactcgacctatgcctcaccccgaggggatctggggcattaacaatcaaccgcccggcactagctggggaaacatcaatcggtatccgggtggaagctggggtaacatcaatcgctaccccgggggcagctggggaaatatcaatagatacccaggaggatcctggggcaatatccatctgtatccaggaatcaacaacccctttcctcctggcgtgctcaggccaccaggaagcagttggaatatcccagccggcttcccgaaccctcccagcccccgtctgcagtggggctag

SEQ ID NO: 6149 - DNA, 957 bp, Artificial Sequence
  Description of Artificial Sequence: Synthetic coding sequence
atgggcctgcacttgcgcccctacagagtcggactactgccagacggcttgttatttttactgctgctgctcatgctcctggccgatccagctctccccgcaggtagacaccctcccgtagtcctgggctggttcacaacaaagcatccaggccccccctcatttttgatggtctggatgtatgtaagcctcgcgctgggccgaccctctcactggtctagctggaccccagctaaagctgcctgggtacctattagcactccttggtggcgggccctgtgggctggagccacccatggagtcagaatgtcggagggactccctatgaccggggcggaacctcagagacagccccaagcatggaaggacaagtatatccgcgcttttgtctcgctcggcgcgccctgggggggggtcgctaaaaccttacgcgtgctggcctctggagacaataaccgcattccagtgattggtcctttaaaaatcagagagcagcagcgctccgcagtatctacctcgtggctgcttccctataactatacatggtccccagagaaagtgtttgttcagacccccaccatcaactacaccctgagggattatcggaaattcttccaggatattgggttcgaagacggttggctcatgcgccaggacacggagggactggtggaggccactatgccccctggagtgcagttgcactgcctttatggcacgggcgtccctacccccgacagcttttactatgagagcttccctgaccgcgacccaaagatctgttttggagatggcgatggcaccgtgaacttgaaatctgcactgcaatgtcaggcgtggcagagcagacaagagcaccaagtcctcctgcaggaactgccgggaagcgaacacatcgagatgctcgcgaacgccacaacactcgcttatcttaagcgtgtgctactaggcccatag
